United States Patent 6,812,339 (POLYMORPHISMS IN KNOWN GENES ASSOCIATED WITH HUMAN DISEASE, METHODS OF DETECTION AND USES THEREOF) - sequence listing, part 81

SEQ ID NO: 17490 - DNA, 141115 bp, Human
  misc_feature (1)...(141115): n = A,T,C or G
ggggtcgtggaggctccggagcttggtgaccccgtggtgtcctagggcgtgtagacacaggcctcttccatgccagggaggcgtggcagatctcaagcccacccactcttcccccaccctcgggacaccacaacaaaaccagagttgtgcatcaagacagctggaaccagaccaccggaaacactcagaccaccggcaccaagggttgtctgttttcagaacttctgttgttttgagcacagcccaaagggacagctggcccttgggaaccacgttgggccgtctgttagggagaagtgcactgcctgggcctgaaggcagtgggctgtctggcctcctgagtgcccggggagcccacgcccacgcccaggagggaggggcccactcggtgcatccacgcagaggcggctgcgaactcaggcacggccgcccttgtctcctgctgccgctgccacctgcagcacagacggagcctgtgcacggggcctggtcagagctgtttctgtctccccagcctgagccccgtcttcacctgcagcacagacagggcctgtccgccgggcttggttggaaccatttctgtctccccagcctgagcccgtcgtcccttgctggctgcccacttgctcagctgcgccctggaccgtggccgctgggctcctgggaggtgggccatgcccacagctccacctggctcacagtgagtgccgtgtcgtcgtgagcacctccaggctcccaagcccagcacagacagcaccggccccttctctccccgcctttccgctcctccaaggaagctcgtccttttgggccctcagtggctgttgtagcaccaccaccccggcaccagacagagagccctgtcggggcttgctccttggaagcgctgcgcatcctgtgttccaggggagcggggtcaatcagtgcctcacccctcatcctgctcaagtgaaatggggctccccgactgcctcacatgtgtcccacccagggtttcctgccaggtgagatggttcgtgtcctggcctgtcaggactcccatgagtggcgaggtgtgcggtgtggggcagtggctggactgacagtgggagatagacggggacctggaaggaggggaggccatgtcgatactgcatccgctctctgaattctctgcccgcgcgtcctctcagagcctcatggtggaagccgccaggtcacacaggaagccgcactgacaaggatatttgttgcactgctctttagctgtaaaagtttgggacagattcagcacgctgcagcggtgattgcttgagtcagaatccttgctggggacctcagagacatgtcgggggcctgggagccttgatggggcgggcggggcaggggcaccagtggccgtgatgccaggctcaggttcccggctctgccacttagtggaagtggccttgcgtgagttgctgctgtgtgtcggcgtcctcccaggctgtgagcaggcggcggagtgcctggctcctacacacgtgaacacacatgcatacacaggcacatgtgtacacacacatgctccggcacacgcgtgctggtacgtgctcccgcacacgtatgcacacgtgtgcacccttgctggggttgtgcctgggtgttgctaatggctgccttcctggtgagattgtgaccagttgatcttgaggctcccagaggctctgcagtaaacacgcataacatttttttaactagaaataaggcctctagatgattgaagaggcttctgagaaatctggactcttttctatggaatttacagtaatgggaaaatgaaaagcactggaaatataaataactggaagcacaaaggcgacgtgactcctagaatctgtccagaacccatggtcgcagacatggggccccgtctctgccagaccctggtggctcccaggctgtgggggcggtggagggggtggtgccacgtgtggctctgtggacggctccgacgaccctgacagtgtgcttctctccctccaggtcgtgcacacacacaagccgcacttcatggccttgcactgtcaggagtttggagggaagaactacgaggcctccatgtcccacgtggacaagttcgtcaagtaagtctaggggcaggtgctggtgcatgtccacttcccaggggtgtggggtgccggcgggggtcttttcatggtactatgatcaccagcctcaccattcgggactcacctgggggtcatcttggctgagtctcagttttccaaagagaggagtggcccagacgtgtggccacgagcctccttggggcggcgacagaaggccacggagtgacagcctgctgcctccacacggcgagggtctgtgctctcgggccaggggacgtgagccccagataccagtggagccgtctccgtgtgtgtgtgtctgaggcctgggcctgtggtggccggggttcacatcccactgcgcagtctgtctcaaggaggtcggcagggagcgtctatcctccttgggggcgaaatctccatcgtttaggaggaaggtgccccacgtgtattcccactgtacatgccctgaggcttctgacagggccggcccaactgggtcctgcctgggaagagggggcgcccggacctggggcatccaggagtggacaggagcaggcaggggcaggcaggcttgtgttcagacatggggcctcctataggctgttgctaatagtggctgctgtattttcccgaggccgcagccgtgaagcccgccctctgtgtcccctacagtgtggccttggcacattcccatgttgggggctcgtctccacctccagaccctgggcaagccctggcttcttcacagcatgagggcttctgggaccagcccccaacatcgcagagcttcacaaagctgccacactctgtgggccgacgccgctgccacgctctgtgggccgacgccgctgccacacactgtgggccgacgctgctgccacgctctgtgggttgacgctgctgccatgctctgtgggtcgatgcagccacccggagtcgggacctgtgggcagagccgtcgagccctcccggcctggtgccagtgtgagtgtgagcgaggcttcaggcgatcccagccgctgcatccttgctgtgacataagccctccgtgttgaactcccagcgcagggtcctcgagcagagcaaagtggtttcagctgctaaaaaaaactgccacaacttcccaaaataatctgtaatttaaggcattttttttttctttttttttttttgttttgagacggagtctcgctctgttgcccaggctggagtgcagtggcgtgatctgagctcactgcaagcaccgcctcctggattcatgccattcttctgcctcagcctcccgagtagctgggactacaggtgcccaccaccacacccagctaatttttttgtgtttttttagtagagatggggtgtcaccatgttagccaggatggcctcaatctcctgaccttgtgatctgcctgccttggcttcccaaagtgctgggattacaggcatgaaccaccatgcctggccagtttaaggcagttttaatcaaaatcttagcggcatttttcctaacactcaacaaactaatactaaaattgccatataagagcaaagggtcaagaatagttaaaagaatcctgaaggaaaacaaagtgggttctcacccagctcgaccccaaggctcattccgaagaagcagtggggcaggtggcatgacgcaggcccggagaggagagcggatcgaggcaggtgcgcagcccagagagtggagagcggagtcgaggccccacccagaccctcgcggctgccttggaggagggtgggtggggacatgggctggggcacggcatcattggtgtcctgttgggaaaaatgaaattggatccctgctttgtgtcataagcagccacttctcactcaccctacataagatgaatttcagttgtattaattatataaatgtaaaaggcaacattaaaaatttcagtctaaaatataggagaaaatatagttttgggatgagagatttcttttaaaatgtgcaggaagtgcagcctacagaatggaaggctgaaaaatgtggccatgtttgaactaagcatttgcttatgaaaaggcactcaaaatgaagtcactcaaaatgaagtcactcaaaacaaaatcaaaattcagccacttcgggaaaagatatctgcagcacaccttactgacaaaaacgagtgtttaaatatatgaagaactcagtaagtcggtaagagaaggaaagcagcccctgttgggaagcaccttccagaggagagaaagtgggggtgcaccctgagcacggaggacgccgccctcacagcaggcggggacaccgcaggccggacgggaacgatgccgccgtgtttggtgtgagagcttcacagtggagtgtggcccccacggccttgtgcccccgcgatgccgtgtgtgtttccttcctccgcgctttatgcctaatgtacagcgttatgatttttgctttaaacaattttctttttaaaagattaagacgtgagagaaacgcccttggtgtggaccagttcactggctttcagtgccctccgcccttttgtgtggattctgctttttatctggcacccttctctctctgcctgaagaacgttctttaacatttattttagcacaagtcagctgctcatgaattttctcagcttttgtttatctgaaaaaggtctttgtcctcatttttgaaagctgtttttgttgtaaatagaattctagcttgtcaattttttttcctctcactactttaatgatatcgccccattgtcttctgtattgcattgttgctggcgagaatctcgccattgttctctcttaattttcttgtatataatgtgccctttcctccactgctaggttttgtctttatagctggtttgcagcaacctgattatgttgtactttgctttgatgttctttatgtttatcttgcttggggccgtttgagcatttgcagtctgtgggtttatcgttttaatcaaatttggggaaaatttgtccttgtccattatttctttaaatactatttttcttttccttcccttctcttttgttcttaggctccagttacctgatgttagattgcctggttctgccccacagggccctaaagctcttctgattgttttcagctcattttccctgtgtttcggtttggatcgcctctgttgctgtatttttaagtggctgggctcttttctgttgcagattttgatcttctcttaggtccatgcagtcagttcgttttatttctgacattgtgtttgtccactccttccagaagcctcacgtgtgctttccctgtcctcgcttttccttccgtctgtgcgttcctttcgctgtctggtcacagttgcaatgactgttcccagttgctttcagctcactccgtcatttttgcctcttccgggtctgtttctgttgacggcttcttcgtaggatgacgggacacattcacgtggtgttgctgcttctcatatcaagttattttccgtaggatggcagacattgcgaatgttacgttgtttagtgtttgagccctgttttcttcctttaaagcgtgttgaaggttgtgtttaccaacagttaagccacatggggatcagtgtgggtctgtcaaggcattctttgccttgcccttctctactggtgcagttttattttcttcaatgtggaccccccttcttcctgacacatggactggctggatcacagggtgctggtctcctctctccccactggcttgaataagcatgcgtgggtagggggatgatggactgtctctgtggaggggccaggcagacggggcctcgtcctccgttcatgggctccaggggtgtgcggtggcctcctgtgcagccatgctttgcggagatggtggtgagcttgtctccttaaggccttcctgatgataaaatgtgaccagtaggatgaacggtcggggacaatggcgtgtccagaggtcctttccctcctgtgtggttgcaaggccgtggcaactcaaccaccattctcgctgccacttctgggaggagcagatggggacagaactacctgggccctggggtgcatgtgccccaacctgtgtgtgctggtggctactgggggtccaatttctctcttaagaccaagcgtgagctatcaggagagcccccagagcttggagttgcgcttccctggcatgagaccttgggtgagttctcaatgtctccatccctgggatgcctcagaccccggcatctcacaggctgcgtggagaccagagcctgtgggagcttgagctctgcacatgctgagagctgaacgtgaggccagctcctgcggtggctgccgccattccctgccctctgcctgtcacgggtggatggtctcacggtgatgtacctatgtgctggagcccctcttataccttgtggtcatctcatgaggtgcaaggcgtctgtgtggcttttcctcaggaacctactttcttccttccagagaactattgtcgagtgatgcgatgaaagaatataacagggctcgagtctacctggatgaaaactacaaatcccaggagcacttcacggtgagtccctcccgctgcctggtgcaggggtcagacaggctggccttggcagaagccagcccttctcctgtgtaaatggagagaggtcggggtgctccctgcctgaagcctcactcacgctgccctgcctggcactcccgcagcctgcttggtggtctgctcgtggtctgagcccatggctggcctggcagggaaggtggcccagcacgcacagggtcttggggctccagaccaagcccaagagggaattggggagtgacaggtggggagaggcccagggcctcagcgtgcatgaaaataagagggagtccggggctccaggcgtgtagatgagaggttggacagcagccggtattgcttcaagagccaccgtcgccagccctgctcccatgctgggtccgtcccttcctgatccctgagtgtgcagggctggggcggtgtcctgcctcggagagaggctgttcctcagggtgagcacagggggagtgggacagagccttccacagggctgggaaagacctgtccctcctctgcggtcctctgtcaggtggacacatgagagggtggccctggtggacgtggcagccacagagatacaggcaccaggtgtctgggaaggggcaggaagctcctcagaggaggggacactctgcaggtcgtgaataacttgctgttggttcagagacccacgtcttaaatcccgtctttatgccctgggtcccccggcctggatccatctcccccgtctctggggaggccctgggtcccccggcctgggtccatctcccccgtctctggggaggccctgggtcccccggcctggatccatctcccccgtctctggggaggccctgggtcccccggcctgggtccatctcccccgtctctggggaggccctgggtcccccggcctgggtccatctcccccgtctctggggaggccctgggtcccccggcttgggtccatctcccccatctctggggaggccctgggtcccccggcctggttccatctcccccgtctctggagaggccctgcatccttctcccccatctctggccttctgtccccagcatcagcgcccactagccgtcattgcgccgtcacgtgacaggcccttgttaatctgccctctcccaggtgggcccccgtaggctgcagtgctgagggtctcgctctccagtgcccccctgccctgcaggtgggactctcattgctgtttgggttcaagggccatctcacttgtttgggcatccagtgccagttgatcaatgtccttgtccctgagatggtcacacagctgtcatgcgtggtccccaccagtagtggagtctgtacaatcccgggaatcccccgttcggtctccgaccctcgccctgtcaagcagctgcccacacacaagcggcctctcctcacgctctgtggggcacacggggaccacggggcccccactcacaccagagccaaggccctcacccctgtgctcaggatgtagctcctcctgtcagccttcctccctctcccccttggtccctcctccctctcccccttggtccctcctccctaccagcttctttctctcagctctgccatcctttccataaaatggcagcttccttgaccctctcactctcctctgccatgacccaacgtaatgtgtttcccaagtaggggcttattcagatgaaaaagaaaaacaccactgggggagcagcaaattagacattgcagaagaaaagagaaggtgactgaacttgaagacagccacaaaattaaagtgaaacagagagaaggactgaaaagtggatagaaatcactgtgaaataccaggtgtcctaacacgtgtggctgcagccccaggaggagcggggaaaggaggcagacagggtgatgcttacagatgtcatggctcagatttcttcatcagtccatgaaacttacagaaagatccaaatactgcaacaagcttcaagccgaataaacataccaacgcaggccaaggtccgattgctgaaagcaagttacatgaaggcccttccttgccacccatcatcctcggaagagtggggctctgctccccgtctctgcgtgctgccctgccatgggagcctcatctgtgccagtcgccagctacctcttcctcatggggaccgtcgctcagctctttccagcttcctttagatataaagacacaggtattttaaaagtgaagggacggaggaggatgtaccttgtaaaacagtcgttagaagaaagtaggagtggctgtctgcatgtcagggtgccctcagaacgagcgtgttgtcggggctgagagcggtcatttcacgatgataaggggtcagctttttgggaggacatagcggtcgtgaacgtgcgcccctaatatcagagctcacttagacgcgaaaccgacagggctgggtggagacgggaggctctgcaccgcaggaggaccccacagtcccctcctgctggccgatgtgcaggtgggcggaggggcagtgcccgccacccgcacccttggcatctgaggctctccagccagagcagtggtggacgcagccaccgacagaaggcacccgcgtgctgggccctggccagagcaggcctctccgtctgtccgagcctggctgggatacctgagagcgaggcacacatgggctggcggaggggcagccgtcatgctgtagttctgtttccaccaaaacgtttttccacatgagggcgaaagcctcagcaaaacctccttcaggctcccgagggccgcggctgcctccacacctggctaccttcttcaggcccccgagggctgcggctgcctccacacctggctttcagggttttccaggtgggtccggagcggcctgtgcttaagggctcaggtccacccgagactctgcctggcgtgcgtatctgggcatctgcacctggctgccgggcacaggccgtgccaggcctgtacgagctctggggttgttctcccttctttccaggggtcctccctggccctgggtggttccagcaaaacagtcgccagggcacatgagtctagttccagaaagaccttgcccctgcctctgagagatggaaaggatacaaacgcattctcttaccaaaaagaattaaattagaagtaaataaaaaagatatatggaaaagtctcaaatatttggaaattaacttgtttgttaataatcccaagtcaaagagaattacaaggtattttaaattatgtgaaaagctagaaccttcaaaatctgtgagatgccaaaatagtctgcacccgctgcagatcgtacggcagccttcagcgcggggagcacggcgccccccgtcaaaggaaaggtgcctctcaggggaggaagcacaggggctgggccgggcccctcccctcaagaagccgctgtgtacttggtgcctcaaagtgcccgacagtgacgtgggcctggcagcccattcttcagcacacacgcttcccaattacgtctctgagatgtctgaaaccagggtgcggggcaccagggcggctgaacaggccacccagaggcagccgtgctgtgtctgaggccccgaggctgttcctccagtcaccctcacgatgagggtttccggaaaatgggacaggataaggcttgggagtgagagtgggtctcaggcctgctctcggggaactgtggcctggcaggagctcccgtgcctctgctgccgcccttcagctcagtgggctccagccccggcttccctgcctgggcacggacctgatctctcccacagccacggccctgagtgaggctttaggccaggtggatggtggagggcagccttgcctggcaggtaggagggtccaggatgccccagatgcccagttagctcatgccaagctggcgccaggcgggcctgtcctccctgtcttgtcactgagactgggctggcagacctcggaacgctgccccctgggccaccactggctgcctcagtggcctggtctttgctgggggccctcggggtgtctgtgtggcggggcctgacttccccggggtcctgggcagagctgggcagcagcggccagccagacaatcaccctcctgccccagccaggtgccctctggctgtcagagggaggaaaatttaatttttacaagattgatggtattggagcaatatttttagctgagtctggttcaaataataggccattaattgaaaaaggaaattgaaatgaatttatcttgtacataaatgctgtcacgggtattaatagggatcagaaaatagtggcctgttcccagaaggcgattgaacctgaagctgcgcctggcgcgtgagcctgtgggggggacgcggctgaggggctttgagcgacctgcaggtgcccattgccaccaggagatggcgcccacgcagcgcctgagagtttcctaccggagatgatcagaaggcaacttttaatgcttaaaaaatgaggatattaggctgggcgcggtggctcacgccggtaatcccagcactttgggaggctgagtctgggatggacatgcaccgactccgccaggcgaggtgggcctggctcagggcagaaggccccaggaggtgcccaggctgagccccgagctctgcgcccgcatggaaaatggaaaagtggcgagagccaggctggaagacacctgagtgccaggcggtctgtgtgcctcatccctgaagcgcctttgtcagagcccttgctcctgggttcagcctggtgtccctacccctgggaacacatgtccacccacagcactggagacagggctcagagctagccccgccgtggaggtctcggtaccacgttggtacccagagaaatttcttagccaccgcggtgcatcctcccacacaggcctcgacactgaagaagtgcctgggcgaggctttcccgggctgccaagtgcctattgatccacagctccaacagcacagaaatcccgtgtcttgtctgccgggcacgcagggagctccgagaacacatcagtcagcgcccagagagccgacgtcggccagaggacgcagggtaacggctttcctgaactccgcttccaagagggttctgtgaggaagaggttgcaaattcattttcgtttaacgtcacccgcatctggtttcaccacagaagtggagccctgcagtgggaggggtggggggcctgtcactgggctttgctgctgatttggcctacctgggaagcccagaagatgtatttactgtagggacttgaggcttgcttggggcctggtaggagccaaggccaccccatcctcccagctcagcttggtgacttaccatccatggctctggttcgcttgtcacccgcccctcccagagaggctgcgtggggctgcaggcgcctgagtgtaggtcccagcctgtgtcctgggctctagtcccattgaagccttgtggctggctgggcatgggtcccatgcagactggtggggccaggagggcctggcgtgggcacctgcagcagcttcttcaaggcctcccagcactgaccgtggcctctcaaagcttcggctgcttcagcagctttcctgctgggagctgtgagcactgctggggcccatgcccaggactgtcctgaccggactgaaagccctagagggaagctggcagtggggacagggtgcaagaggaaagaccctctctccatgcagctccttcatccacccacctggaggaactcctagagggaaggtggcagtggggtcagggtgtgagaaggaaagccccactctcctcttcatccacccacccagaagaagtttgaagaaaccatgccttttaatggcttaaagttggagcagaagggtttatctgctgatacaattaagatagcttcgggagagggctgagaaggtgtggcctggcggacacactgcctccagggacacccctgcccccgccagctgtgcctgctcagagagtgcctgctcctcggagggtcccccctgcttgggaaggtacctgctgcacaggaccccagctggagtcaaggagtcagcagaagagggggttggaggagcggctggggacaggaggtggctgtgccggctgccccacctcgcctcttgcctgagcccctctgtggccacatagacagaaggaggggttggaggtgcagccagccagctgggccaggtgagccggtcctgaagggcaccaagcagggttgccccgggctcctgagaggatttttcacatgcagcagctggagacagtttggaggggcccagggcggtgcagacccttccacagctgctcaggtggcccggaggcgtgtgcacccttccctatgcagcagggctccacaggcctgggcactcagcccagatggtgcatgtggggaaccgtgggaccccatgtgccaggagtctctgggcagacagcagcgacagggctgtgtggggacttgggcaggcctgagcctggggtccgatgacctagttgggtctggggcagccacaagccgaggcgttgaggaagagagagtgaagtctgagctccttgtgtaggagacctccgtgtggagtagccccagaggcaggaggctgcctcagccaggatggccccatgcacttgctaagctgcgccgcctgctcactcaaggctcttgggctcggagcagaactatgagcctgcaaggcctgctgggcagagtggccacagcacgtggccgctggtcaccaaccgggggcttacccctctcccacccgctagcgctgcctttgcacctcggagggcaggtctctgctggcaccatgagtgacctgcaagcactgccatggtggactctgctcgcgccttggtggcttctaggcttttccaggggctctggcctcctgcagagcagggtctgcctcccccgcggctgggtctgtggagagtgaagtggggcacagatgccctttgcaagtgctgtgcacggcagctcacagcccccacccccagctctgtagtctgtaagaggcaggctctcggcatggcccccaggcagtggccctggtgctcttggggtggggggccccagtacccagcggtggcccaggaatgagaggcccgctgcttcctgggagaggcccttctgctttccctcctcctcctctgtgagctcccccttccactctcgttctcctaaataagactttagggagaatttatggaaaattgatggagtttacggatgttctttgatccagagaaggggaaggaaaggcaaacgcgtttatgatgaggaagctcatctgccttagggctccagccctgccctggggctcgctgcctcctcacctgcctgggggcaagacagtcctgatgaagtgagagggggcgagattggttttctgagggcaccgggcccttcatgctcccctaaatcacgggctgtctcctcagcgggcaggtaatgacctgctccccggccccagcacctgcagtcccgtgggacgcgatgatgtgcggctggggctgcagtgaaggtgaaactgtcatatcgatctttttagcactaaaatatgagccactttactccgctccccgctgctgtgatgtgaaaaataataactcggatccaaattaaaaatattgatctctggaaggtgttgaaagtaaataaacaccttccgaagtttttgggtcagccgagaaatggtattcagcaataaatgtgtcagagtccagggttcttgatctgttttttctttgaattgatttttcattatttacttcctaaaagtgttggaatttggtcctccactgtgaaatcccagtgtttgggcacattatttctttggggcttatgaggtgctcctaatccactcccttattgatggattgatgtttgactccataagcctgctttatttaggaccttccatcataattttttgtacatttaggcttgactcttttatttccttctaacagatgagctgacattgggctatcaaacgggtgggaaaacaattgccatgaggttaatttcatggtcggctccgtgcgttctgagcagacgggtgtttcctggctgcaggccgggccttggatgcagccttgacgcgtgtcgatctgtttacacacagggctgagtccgccggccccccgggggtgctcatgggtgcccgggtgtctgcaagctgcccgcagctgggtggtctctgggcacggatgctctaggccctctgggctccaaggaggctgggttgtatgtctcttgagaagctttcctttcgaaaggccaccaagaccaccgagactgctgagaccgccaaagccaccaagaccgccgagactgccaagaccaccaaggccgccggctgctcccggtggctccatgcacccggcaggagagtggaaggcgtcgggcctggggcagtttgaaaagataggtgccgccagcatctgcgcttcctcgtgggtgctcaacaggctgcctgggaagctccttctgccatcacctggagtcagctgccgtccacagtggaagctgccagccaccaaggctaccgacctgggccctggggatgagcagcccaggaggcgaagatgcctaggtgggtccccagctctgcaggtgccactccccacgccagtgttctccaaacttccggggagacctgtctgtgctcctgtaggtgtcaggcagactcagaggcacaggggttcagattgaggcctggggctgaggaagcaggaagtcctgtcaggagctggagcactgagaaaggcaccttgctgagagcagccttggaagggtccagaactggaaagatggagagctgccattggcccgtagctctggggctggtcctggccatctagccatgggaccatgggcagagggttccctagctctgggtgaggcgggagtggtgggcagtgctggccatgaggtccctgtggggtgcatccacggacgcgggtctggaggcgctgctgtctaagctgaggcttttgaaggatgaccgtgcccaggttatccagtgttccttctcagcgagcagctcccatggcagtccattcattcaacatgccctggtccagctgctgcacagccatgggtattctgtgctgagcgccgtggctgatgcacacccaccgtcccctgcagaggagacctctgcacgcaggcccacagcaagggccggatcaggagaacaacccacttggcaggcggcaaccttgcctggcactcaccagggcctcctccccagcactgtcccgagtcaggtctgcacggcttcatggctgcctgccctgggaggtggagcatggagaaggccagtgcctcatcacagagccagatgcccacaacaggatccagtgctgtcagctgggctccagaaacctgaggacatgcagcctgcagctcctgacacatgacatgtgacatacaacacatgacacgcggcatactccctgtgacatggcacatgacacgtgacacaacacattctcatgctccgccgacgcgtgacccacggcacgttcccgcgctccgccgacgcgtggcccacggcacgttctgacgtctgccaatgcgtgacacacggcacattataatgatgtaaatattgattattgatttaagtgaaaatattgagagggtgggggtgagagatggagtgtgtgtgtgatattgagtgacggggaaagatagtagaaagtagttaaatcctcttcttccagcatggaaaaattgaaaaatcaatgttgaaaactggaaaatcaagaagtggcaatataagctttagaggtatggagataaataccaaaagaaaacaatcaaaagaaaataattgcctctgggaactagaagactgaagtggacaggagctactgttttcatagtgtgccttgcagaactcgtgtgtgtgtgtgttactagcttttaaaaaacaaaattccaggaaacttcttaggaggaagagactccttctgttgatggtgacatcaaacaagacctgcaggaggaggtagcactgacaagaaggtggtgtgccagtttgtgatctggtgcggtgaggcacctgtgtcagcaacaggtgggagtggctctggtgtctgagcagaggctctggtgtctgagcagaggctgtctggatgccattcacggtgagagaagagcctagaatcttgactgtcctttgagtatcaggtaaagaaatttgaatgtgattaggtagtcagtggggaccattacagagttcagggagagaggtgaggcagtcagaactgggggaagatggagaagggacaagtgtgttgtttcaaacgtagagtcctctgatatctaccttttaaattcttattgaagtaaatgcacagagaggaccagaagtggtgatccatattggtgcacatttatttttttgactctgattcctttaagcctaaaactagggcagtgtcccatactgagcactaaagagaagtagggtcaaacccaggagggaggaaaaccagatccctgcaccttggccaagatgaggatgccggatggagcatagccagtcctggaatgaggcctgcatctctcccttgcacaatgcccccacccacaatccagccaggtctctctgtgtccccagctgcatgctcccacctcttcgtgatatggtttcaaaaacacaatccagcaccatgtgtaaattgtttgatgcttgagatcaactttactgaattgcctacattgaaagtgatgaggacaatacctccttcaggaagaaaaaggcaaaatgaagtgctttcatgaatagtcagaagggtcttactaacataaaaatattttgattatgtcttcagaatctctttatgtagttagtggcttgtaagctgtcaacttgtaaatgatgccgttggaaattgaaatgtaaataacattaccatttataatagcatcaaaaatatgaaatatttaggaataaattaggtcaagatgtgtaagacctgtatactgagaactatgatatattgctcagagaaattaaataagatctaaataaatggagagatatactatgttcatggatcagaagactcaatcttgttaagatgtcatttctccccaaattgatgtaaagattcagtgcattactaatcaaaatctgagcagacttttttttttggtagaaattaagctggttctaaaatgtatatgtaaatgtaaaggaattagaatgggccaaaacaactttgaacatgaataaagatggagtccttatactacctgattaagacttctttgaatctcaataattaaatcagtatagtattggcataaaaccagataaacagatcacagaacattatggagagtctagaaagtggcccactattgatctttgtcagaggtatcagtggacttcagcagtgagtgaatgatcttttccacaaagggtgctgtagcaattagagggccgtttgcaaaaaactcacttcaattgttacttgaaaccacatgaaaatttagcttgaactggatcatagacctagcgtaagagctagaaccatgcagcttccacaagatcacacaggacttctttctttaaatatgacaccaaaagcagaaaccactataagaggaaaccagtcagttggacctatgaagacgaccgtggcaagcgctggggaggcggtggtagcactgcagccgtcgtgttagtgctggaaatgtaaaacatgcgaaaacatggaggtcttaaaaaaaacgttgaaaatacacacaccgtatcacccagccgtttccctcttcagtatttacttaagagaaatgaaagcacattccacactaagactgaatgttcatagcagctttattcagaatagccaaaacctgtcaacagcccagatagccacagcaggtgagtgggaacaggaggggacagtctgtgtacaccgtggtgtgtcagctgtcgcagtaattatggtgggcaaaagaatccagaccaaaccaaaaatgcattctgtatgatttcatgtatatcatattcttaaaaatgcaaacaagtctgtaatgacagaacacagatagtggtttcccggggaaggggttgtggtgggggctggagggattccagtgagcactaaggagaagccaggtcaagcccaggaggggagcacggtagatccccgcaccttggccgaggtgaggatgctggacggaaggcagctgtcccttccacactgcccaccccacccgcgctccagcctggccgctctctgctcccaccccttcatgctgtagtttagcaaacacaatccagagccaagtgtaaattgtgtcaaggggcgaagggacccagggaaccttctggagcgacgggcatgttagtctcctaattgtggtgatggtttcacgtgtggatgtgtcaggactcatccagttacacgtcacatgggtgcaattctgtcagtgccacttacacgtaccttagcactctagaaggaaaatctagtcttgtggtggatggcttgtgaggggtcaaactgcagatttaatggaaaagggaagtacttccatcagcagctggcccctcgaacggactgtgcacaccactgtgtgtctcacaactcaggcaactcggcacgccgcaggacataacggcagagtgtgagtaattttccattttatatacacatatgcgtatgttatataaaattgaaaagactttcttctcgttaaatcttattttattttgacacaggatgtcactctgttgcccaggctggagtgcagtagtgcaatcgtggcttactgcagccttgaactcctgagctcaagtgatcctgtggcctcagcctcccaagtagctgaggatacaggtgtgcatcaccacgcctggctaaaaaaaaactgtttatagagactgggtgtcaccgtgttgcccagtcaggtctccaactcctggcctcaagtgatcctcttgccttggcctctcaaagtgctgggattacaggtgcgaaccactgtgccctgccaaaaagacatttttaaggttaagtaaggctttgttgattttgaatgtaacattattcccactcaatgagtgattttggtcgacgttcacctgtactttctctgcactctgagccggcaggtgccacttctagcttctggctggggttggtttgcagtggagtctgtgcctgtggcagccgtctgcatgactttgggtcattgcgctttccttgccttttggggagggtccctggtgctctgtgagcagattcgcccctaggggtgaagtcatctcgctcctcttctgagccgtgagctgggcagggccgcgctcacatcattcctctccccctgtcgccgggtgggaaatccgtaacaggctctgtggcaaaggctgggccaaggtgcctcgtgggcagccgatccatcaggcggccgacaggcgtgatcgagtgccgtgtcacacgcagcccaggaaacaaacacgccgcgcgaaaggtattggtgaacgaactgaaaaattgtaaagctcttaaggactttcatgcttgttagcattttttgacagaaaatcactgaagcagtgaacataaagaaatagccatggttgattcacagtttagcttgttgttctgttcatttggcctcaggtgatgtttcacttccggagccccgtgagctgctccttgctctgcctggctttctttcctgtgcaaattcttgcgggtccctcagctgtgctcacccaaccacagcctccctggagatgggtttttatgattttgaaggagaccgaaggaaactgaatgaacaaatattttctccaaagcccgtccaggtttggcttcagatgctgtgagccgtgtgtacatttctaggcttaatccacagaatgaatgtgagcttttatgtcacagcctgcccaggaccctgctgtgtgcctggagggcacctgacctgctcttgaggcttcactacctgatgtcccaaagggaacatcgtgtttttcagtgtgttcctgagcagatgggtgtctacacagacctcgcctgttgccctgtgcgtttgtgtgatgagttggggtgtggcacaccgctgtgtgggggtggctgggcctctgagtgcgctctctcacagccacgtctgctggggcccacagctccccatcagcagcagcccagagctgagcacagaagtgtgggtgattttcatgagtgcaccttgccatttggcttggcacctgttagaactgctatgtgctctttgaaaaccacccatccttctgtcccaaggaaggtgacaagcacgatgttttcctgggagaaagtggctcccatcctggccacacatccctgtcagggcagcgtttagtgcatcccacctgtgcacgtagagatgcatcctgctgtcttaagtatcggagtccccgatgtaggcttgttggggtggctcaggttttcccgttgcaactgaggcgttgagcagtcaggggctgcccctgcctgcccagaactttcctgaagtcgtggcctggcagcgccccgcctgtgcagggcaggtccctcaaggccaagccctgttgtgcatgagggcacccccagactgaaggaaacgaagctggagcttcagagatcatgcccacctgaggccttccctcgcctttgcagacacacctgtgtttccaaagaagggggacagacggagcacttcacttccatcccgagagtgtctcccagacagcgcaccccgcagcggccactggctgacccgtggccttgagaacacaggaaagccccctcttagattcacagaaacgcccttcctaggagtaaacggatcctgtgtttttcccctcgattctgtgtcgctaattgttaattatgacaaaggaaaagtgatattaagattcggggtatttgtttcattgtgtaatttcttccttggttaaaagggaagaatgggctgggtgtagtgcttcacacctgtaatcccagcactctgggaggctgaggcaggtgaattgcttgagcttaggagtaatcccagcactctgggaggctgaggcaggtgaattgcttgagcttaggagtaatcccagcactctgggaggctgaggcaggtgaattgcttgagcttaggagtaatcccagcactctgggaggctgaggcaggtgaattgcttgagtttaggagtaatcccagcactctgggaggctgaggcagatgaattgcttgagcttaggagtaatcccagcactctgggaggctgaggcaggtgaattgcttgagcttaggagtaatcccagcactctgggaggctgaggcaggtgaattgcttgagcttaggagttcaagaccagcctggccaacatggggaaaccccatctctactgaaaatacaaaaattagccagctgcaatggcgtgcacctgtagtcgcagctacttgggaggctgaggctggaggatcgtgtgagcctgggaggtggaggtagcagtgagccaagatcacaccactgcactgcagcctgggcaacagagcaagatcctgtctcaaaaaaaaaaaaaaaaagagaagaatgatataaccacattagtcctttaccaggtttgccttaaaactgagtcactgtgtgcctggcctttactcagcgcttcctcccatgtcgtgactgttataatgcatcattacttcctcactatgattcatctaggaacttgggggagtaattcatagtcagggatatttatgtttaaaccgacagaaagggagagccatttgaacacattattccatgttttcactggttttaaatctgatttctgctggctgggggaaacttgaggaactgtgaagtcatcgtaggcagtagggaggtaacggataagggcctttcaagcatgcagtgaagagacaccagctgtacagctccctcctgtatggaaaaggtggaatttagacagttaaagtattaaagtatacatcactgggtttgaaaacagccacaaaaaaacccctgtcggatcacccaaaaccgctggccccgtggcgcaccatcccgaggctgccgactttgcagtggggctctctttccttctggagtgcagcagcatctggaattgtctgggaaaaccctgaaggatggcccacaccgagccgaaacatctttcaaacggaaattgttacactgtgctcttcatcttgaaattaatgtttggttgtcaatttttattgctgacctaatggatgaagtccagcaattgcagctgtccccttaaagcggcccccagcgtgtgctgtgcagaccttctcggcaggctacccacccacctcatccgtaagtggactcgggtagagaaagatatctgtgcattgagagctcgttggagataacttgagtcataatgtgtactgagtgtgctgggaatcataggagggtaaaggtggtttttaaaaaagttattttcattaattcctctcacccccaaccccctctgccacctgggacaaaaaaatggcagggtcctgctggatgccgctttccaagctggggcagacccgccagtgttgagcaagagggaggtttcatctgaggctggctgagttttatatatctatttatgagatccaataatgtaatgatgtgcttgtctaataaatgctgctgtacaagctcaggacagcagacgtttccagtatgacctggattgtctaagccgcagccccttttggttggagctcggctgtttaataaatgtcggctgttcttccaaccatcataattatttaaaggggcttcaaaagagagagaacaaatcaaatcaagccattactgttgaagctcgttctggagttaagtgtgtttttaaaactgtgggccttgtgcagaggctcctcccagttttcatctattatcacaataattgagtttgtagctggaattaaatttatcaaattgcgttatcctctttagaaattggataggcatgctggcagggcgaggcagaagttaatctgctttgctgaagcctccagtggccctgcacagcggggctgaagaggcccagacagcttcctgtcaccccggacacgatgtaatttctcctcaatcccttgtgcaaataatgacatttgaatcgagcattaacaggcttaattactttaaaattgtcattttaatttacactgatatagtattgatcatacaagcagagattaagctgttcagtggagcagatgatggggaattaaacattaaagggtcctcagggggccgtgtgcgctgcccggcgcgagccggaagagggatgatatttctcggtaatgaactggcggcatgcggggacatgaatcttgggctcttggaaaaggggaaataatggggtttgggaggcatttgcaggttattcattcgccgccatgcaccaattctccagtgattcatccgcctcaccaacatttatttatccagcaaattccggagctttgacctttttgctaagtacattgaacataagttggagtggagatctttcaagtgtaacttttacaagtatttgttatttttccttatttctaggcaacattaaacaaagttattcagttttttgagtgtactggagtctgccggccttgcagggttggtgtggtggtgagggactaatgggctcctgcagcccagccccacacttgacttttgaaaattccagtggcagatcccaggctcaggtgtcactgatcctttcttaggtgaaatgacacgagagcctcacgttcctgccatgggctgatggcctcggcctcctttcagttgaggctttctgttggtggttagggggcaaagtgacgccctgtaacttattgatgctgccatggaaaaaatatggaaatgaagcagaacatgagtttctcagaagcacatttgacggacttcttttggcgaaaatcagagcacttcaaatcctgtaacctcaaactgtttcacttttcagaggttatataataaaaagttaagtgattgattttatagttcagtagggagtgatgaaattcttgatcactatccataatggctttattttaaacagtgggctagagatttaattaaagcatgatcagggaaatgaaaaaatgttgatatttctcctcaaattaaacatgaatttgcacagggagcattagaagggcttatcattcctcctgatgtttttattctcttccgtaggatttaaaagcttgcggcccacttcacccctctctgaatagctcagggggcttcagcccctgttgaccgtgctctgggtttggtccatttctgtggctttctttaaaaactgccgagctccatcgcacgaccaccactgctggcgtttattgagcgtgtactgcttgtgaggctttgttctgggggatcatttccccactttatctttggggtgccggagacacaggaaggttaagaaacagccggtgaggccgggcatggtggctcactcctgtaatcccagcattttgggaggccgaggtgggtgggtcacgaggtcaggagatagagaccattctgccaacatggtgaaaccccgtctctactaaaaatacaaaaaattagccaggcgtggtggtgggcgcctgtagtcccagctactcgggaggctgaggcaggagaatggcgtgaacccaggaggcggagcttgcagtgagcagacatcgtgccaccgcactccagccttggagacagagtgagactccatctcaaaataaacaaacaaacagccggtgagtagcaccagcttgtgtgaagctgggaagtagccccgtgagcgccaggtgttgccgggccaggccttccctgtgaggcgggttccctggtgcccactgtggcctactctgaggggcacaatgcaggctcctattcttaacctcgaggctttctatgtagcacgtcctcacgggaccacagaacgagagggagctgggggtgtggtggaggagtggcaagtgacagggcagaaacagctgctcgaggaggccccgtgttctcctgggggaccgtcggtgacatttcagcctggcttagctgcgtccttgaaagtggttctgcttctcttacgtgcttgcagacaccattcatgtgtccttagtctgacagtgacttggtcaagcttggaggatgtggggcctgcctgtgcgtgccccatgggcagagagggcgggcgcggttcgtgctggactctagatgtgcagctccaagtgagatgtgggtagatgccattgggattttggcgtgagcgtggacctgggtttctggaagggcattgttcccgtgtccctgtccccactgtggccttgctgagcccccagggagccaggacccgctggtgactgctccctctctgtcctcagggtgcagccctgcacagcccttctagccctctcaggtctttcttttgtccaaactcttatcttctcttgggtccccagggtcaccaacctctttgcagaaaatccctctgcagccactgaccccacacccccagcccccatgccctcactgcacacgttctcagcccccatgtcctcagcttccaatccctaaaccccacgtcctgaaacccacaccctcagcctccacccccaagaccctacaccctctgactgcgcactcccagaacctgcacctgaccccacaccccctgaccnnnnnnnnnnnnnnnnnnnnttttccggaaaccctcatcgtgagggtgactggaggaacagcttcggggcctcagacacagcacggctgcctttgggtggcctgttcagccgccctggtgccccgcaccctggtttcagacatctcagagacgtaattgggaagcgtgtgtgttgaagaatgggctgccaggcccacgtcactgtcgggcactttgaggcaccaagtacacagcggcttcttgaggggaggggcccggcccagcccctgtgcttcctcccctgagaggcacctttcctttgacggggggcgccgtgctccccgcgctgaaggctgccgtacgatctgcagcgggtgcagactattttggcatctcacagattttgaaggttctagcttttcacataatttaaaataccttgtaattctctttgacttgggattattaacaaacaagttaatttccaaatatttgagacttttccatatatcttttttatccacccccccgaccccacaccccctgaccctacaccccctgaccccacaccccctgaccccacacccctgaccccacatcctctgcatactcccagaacccacacctgaccccacaccccagaccctacatcctctgtgcactcccagaacctgcacctgaccccacccccccgacctcacaccccctgaccctacatcctctgagtgcgcactcccagaacccgcacctgacccccacaccccctgacaccaccccacagcccccatcttcagcctctcctctgctgtagtccccagcccctggctggcttgcttctcagcacagccctggcccagaagcaggaggacactgtcagcccctccttgctggggggagagtggttggggcacacctgtcccctgcccctctgctgcccacagcacagctaagtcttcaccctgcctgcgcgcatccctgtggccttctgggaggtcccagtggggagcctgtcttctccccagaacacccagtctccctttgtgccgggtcacccctgtgagcaaacaggcaggcatttccctcttagggaagaagcctcccttgaccccgtatctccccagctccttgtcctatagaaactgatttcttggcagtgtctttctttcttttttttttttttttttttttaaggaaaatgatggatattcatgtggtcaggacagcggtgccaaagtggagaaactgcaaacggcggtgacggcttgacgggcgtcacttttccttggtctttgtcagtcaggtctaatttataacagggccattagtgggagatagctttctttggatgtcttttcccgtaagggttgctcatggtttggcctcagtaaagaaaagagaaggtctctctttcatattgttggaagcagcaggtggcccactccttctggagtgaggcatgggcatgtgggcacgcctccatctgtcaggagtgtccctgtctctcccttctgattgggacagtgggtcacactggtggccagtgggcaactggggcccctggagccgtggcctcccctgggcccaagggaggcacagatgacttaggagtggagagttcaaacgtgggctgcggcgaggcttgtgccctccctgcttcggactccgccctccctgcttcggactccgccctccctgcttcggactccgccctccctgctctggactccgccctccctgcttcggactccgccctccctgcttcggactcggccctccctgctctggactccgccctccctgcttctgactccaccctttctgcttcggtatctacctccttgctttggaaggacacaaccttcttggctggcacagcccttcctgccatgcctgttgatcccatcatcagccaaggatgtgttggggccgtattctgcggctcctccagcatgggaaggtgctgacaggaagcagcaccaacacctcctggaatagccgttggcacatgagcttcctgatactgtttcatgtgccttacatgtgccacccatgcagggatcagagcagccctatgaagtgggtactgttatttgtcttccccgtgtcacagatagagatgttgaggcacagagaggttcagggaccaaccagaagaggccaatgtgggatttgaacttggttctggcctcagagcctgtactctcaaccagcctgctctgctctcagaaggggacagcgcaggaaaggccagcttcagccagggtgacggtgggggtggtgctcagggtggacagcattgattagaggtgactgttgtccaatattcagctaaactgtaggttttaaagcttgaggacaggtttcgttagaggtcaaaattcagtagttcctttcccaaggatgtagggagagaactacgttttgttaagtggctcttattgagcattgtgacattcttttgctaaaaacatgtttgtgcatgtatacacttgtactaagaaaatatcttcattttatttccttttcctttatcatgtgacataagatttattcacttcatatcagcatttaagtattgtcaactttatgaaataatatttgggttggcgattggttttgaaatgtgaggacaggagatctgggaggggtcgggatggaataatatggtttggctgcgtccccacccaaatctcatcttgaattcccacatgttatgggagggaccctgcgggaggcaaggggatcatgggggcaggtctttcccatggtgttctcatggtggtgggtgggtctcatgagatctgatggttttacaaagaggagtttccctgcacaagctctttctttgcctgcttccatccatataagatgtgacttgctcctccttgccttctgccatgattgtgaggccttaccagccatgtggaactgtaagtccatattaaacctctttcttttgtaaattcctcagtctcgggtatgtatttatcagcagtgtgaaaacaaactaatacaaggtctttcctaagtttggaaaaacgtgatttctcatctcttcaaaaacgacttccactccccctctgcattccctctaggttccagttacatgtgcgttggaccccacgccttccacgccccaccccactcccctggtattgatgactgccttcttctactgtccattctgtattccctttgccttcagcatcacctcagcgggtcgtggtttttttcctggtggaatgtcccaaaccttcattcctgaggggtctgggtcacttgtagtcttgcctggattgggctgttgtagtttcccgttgaccttaatcacaaggcatggtaatactatgggacgccctaatggatctcctgtattccatgtatactcttccttagcttcgttgcagagtagtagactgatttcaccttgatagaccagatcaatcaccccaacagtgtaactcctttcttagcctattgacataaaggtaggaggagcccagagtatccaggtgacaatcttaacttccagttcagtgggattgctgtttggtctcgcggtggcagcgttcttccctctggaactaataacgctaggccagcagaacgtaatgttgcaggaacaggaagcaaaacttttgctagtggatcattaggggtgatggtgagtggtgccacttccacttccacccttgattcccggacccgtgaatcctggctatgggagaaacagtatcatatattggacgctgattcagagcatccatggccctctggagaactttgccccagccctgcaaagtattgccacctagttggtgttgtaattgtgacttcaaaaggccattccaccattctgtcaacccagctgcttcaggatgatggggaacatggtaagaccagtgaattccatgagcatgagccccctgccacacttctttagccataaagtgagtgccttggtcagaggcaatgctgtgtggaacaccatgatggtggacaaggcattctgtgagtccatggatggtagtcttcacagaagcattgcatgcaggataggcaaacccatatctaaagtaagtgtctattccagtgaggacaaacctctgcccttcccatgatggaagaggtccaatataatcaacctgccaccaggtagctggctgaccactccaaggaatggtgccatatcaaggactcagtgttggtctctgctgctggcaaattgggcactcagcagtggccgtagccagatcagccttggtgagcggaagctcatgttgccgagcccatgggtaccctccattcctgccatcatggccactttgttcatgggcctattggacaatgacaggggtggcttgggaaagaggctgaatggtatccacagaaggggtcatcctgtccacttgattatttaaatgctcctctgctgaggtcacccattggtgagcactcacatgcgatacaaatatcttcacaaattttgaccactcagagaggtctgtccacatacctcttccccagatttctttgtcacaattttccaatcatgcttcttccaagtccctgaccatccagccaaaccattggctacggcccatgaatcagtatataatcacacatctggccatttctccttccaagcagagtgcacaagcgggtgcactgcttgaagttctgcccactgggaagatttcccttcaccgctgtccttcaggaatgtcctagaaaggggctgtcatgctacagctgtccactttcgggtggtgcctgcataccgtgcagaaccatctgtgaaccaggccccggtcttctcttcctctgtcagctgatcatagggaacttcccatgaggccatcggtgcaggctgggggagagaagggagggtggcgggagtggagaccatgggcatttgagccacgtcgtcatgtaacttacttgtgccttcaggacttaatcaagcccaatcacatacatgccacttccatttgatgatggaatgctgctgtgcatgacccacttcatggctagatgggtcagaaagcacccagttcatgacatgcagttcaggtcacacggtgacttgatgacccatagacaaacgttcagtttccaccaaagcccagtaacaggccaagagctgtctctcaaaaggagagtagttacctgcagaagatggcagggcctcactccaaaatcctagaggcctccgctgtgattcacctatggggacctgccaaaggctccaaacagcatccttatctgccactgacacctcaagcaccattggatctgctgggtcatatggcccaagtgtcagagcagctggcacagcagcctggacctgttgcagagcctactcctcttctggaccccctcagtcctccatacccaaagtccagaaagttgggaatcccagtgaatccctagcagcatcaaaaaaataaaaactcatacccagtcagattataacaaatcaagaaaaccatagagagcataggggtgtgccgcagtcacactgacaggccaccttcctgttcctgcagaaatggtaaccgcaggggacggtgcagccgcatcttccgtgtccttggaggaaatgtcagcatagggtcttacccggcaaaacatctcctaagattgaaggtgaaatagacattttaactcaaatgaaaaacagtaagtactaacggatgttcttcaagcggagagaaaatgatctcatatgaagtcagagaggagaaaggaatgagactcaaggcagttgggggaagcgggcaaatggccatgggcattggttgtgtaaaccgaggcacctcctgcagtgtaaaacacggagagaagtgcggttgagcatgggggtgggtgcgtgtggagtgagcgttccaggggccttgccgtgcccgggagagtgagggtaacggacattcccacggggatattcccacgcggagaactgggaccccgatcagggtctggagggagcgtgtgcccttggaatactgctgttttagcatttctggggaccgggaactaaggtaaattatttgaaacagaagtagatggcaatttcctaatataatggacatttaaaactcaattaaggcttttgagtagagttttatatgccctgagcttttgtactggcagaaggtattttgtaaacagcttgtgttcagtgttggccatctcttaaagtgcattttactttaattattctatatccataatgcacataaccagtttctccagaacatgtatacatgaaatgtaattgaaaagctaatgatttttagaagacaaaagataagagtcagaaccattttaattaggatgcaaactccttacataatttaattggcataaaagtttattgatttacttgtataatcatttatacgtagaaaaatataacaaatttcataattaaaactagttattttaagactgatatttttctttgttcattattgaaattttcaatttgtgaaatatttattattcaaaaaatagcatctgcgttgcaaatgaatctcattttgagaggaagagctctaggtgatacaggtttaaaatgactggtaggcacccacagggaaactaggttcctcacacagcctcgtttttcatgagacctgcggaaaggctctggggcgtcacgtctccctgtggccgaggctgctgttgtctggcacaccgtgagttctgggccaggacctttccacctgtctccctccactccgggtgaaagaggcatggggaatttacttgcttttcctttttgtctggcatcagctcgtgaaatatattacatcagacaaaagtcaatagagatttcccttttgaaaagcaaggtccatgataatgggctgaacacaagcaggtgactgtgtgggacagggctgcccaaaccgccgctggcctacagactgctgtcccggccagtgctccgctccctgcgcccctgatgagatggcagccctgggcacctgtggctgctccctcctcctgactctgctccaaggtgccacctgcccaaggttccgtcctagtccctgaccggcccctcctgtttcccccgtggctccttgccccactgactgctggctctcacctgctcctgtctctccacagtagtagcctcagtccagtgcttgaccctgcccttttctctggctccagctcctccttggcaagctgagtcttccccagctttgaggcccatccacatggtgacccccaccgtcacccaggcatctgtcctcaactgcagacccacaggtattcacatggtgacccccaccgtcacccaggcacctgtcctgaactgtagacccacaggtattcacatggtgacccccaccatcacccaggcacctgtcctgaactgtagacccacaggtattcacatggtgacccccaccatcacccaggcacctgtcctgaactgtagacctaggttcagtcacctttgatgcctccctgaggtgtctgaagctgtttcagcctctgcaggtccatggctggacgctgtctctccagagcccatcccagctcacattggtcttggaggtcctgtggatgctgcctgggtgcagagctgaacctccccactggggctcctctgtcatggcccccctcaccacgctgccgtcttgggctctggccatctggtcactcatgtatctcacatgtctgagaacatatgtggcacagaggaaggagaaagtgccgggtgcatatttgtggaatgtgagtggtgactgaattctctcagcaagggtgggtgtccttagaccggccaatgactttgcccccgcagtgtgacagagagcccagtgctggtagcaggcgagaagccaggactgctggtcaccttgccgccctcagatgtaccccctttggagaagcctgccgcaggctgttttacaggccatctcgttccatttcagttgctcctcaccgtggtaatcggaaatgttaacgggcgcactcgtctggtggaatttatcgtggccagcgagggcgattaagcggctggtatgtggcgtgtttaccctcgtgtcagcatgactggtgttccaccctggcagatgaaggcccggtccttcctgggctcctaattggggacactacatccaagagccgtgacagggttcagcaccccgcgtgcagaatgccggcttccacggggcacgctttataaaatgctctttaattcaggaacagaatatcattagctttgtaaagtggatgaatacaatggacaaccaatttaattaacctctagcgtcagctgtcgaacaggaggcagaatgagattacgtgtgcatctctcccgccagcagccagccgggagaggggctcggcaggaggccagacagggggacaccttggtgccgtcatcccgtttggccccaggagctgaaattggaaagtcagtgctttgtaaataagtcagctgtcattttgtggtggtcacggagctcctctgagagcggacggtcacagccccccgtatgctgcctgggggtggcactgggggaagtgggcagtagtgaggacgccgccttgtccagttgggtcagccgcccatgagttcattatacaggaaaagatcaatgaagcgctacattgatttaaacaaaagctttgtttcatttattattgtttataatctaatgactgttattataactttgctttgatttattactcaatctgttaaattgtttcaaaacaaggtgtcttgggacttgcctttgtgatagggttaaatgtgtgacttttgcaagtgtgttcagcttctcgggagcaccgtgaacctgtgccttgggttgtgctttgagacctgagctgagggttctgtccagcggtcctgagctgctgctgctcagctgggcgcccagagggtgtggtgcctctctcattgcccaggagccgtggaattcctgcctgccgtgacctgggcattgtggtggaggactcagaggcgcccaggccacatgcctgccctcagggggcttcccttccctgaaagaatttagatgaggaaaccagtgagtgctggaatatgcagcaccttgaaggaaaggctggggactgggactgccaagcctctgcccagagtagccaatcaagagggctgcttggaggaggctgcatttccacagagacctgaagcagcagggggtccatgtgagaagctggaaaaggggaggcagcagaggtaccctcctgacagaagggcgcagcctcctcaggcccagatggccaatggggctggagctctgtcagctgggtgtgtgagggccagaggacagctggggtggccactgtgcaggacgtggctgggaggaagtgcagtggcaggcccagaggtgcatgtggaaaaggccaccttggtgcccggtggagaagagaccaagggggctacagctgtggaggaggcgggggccccacagggagatgagggaggtgggtgtgcagcagtgcagagacgtggaaggctagagatggacagggttctgtaatccgtagaacctgtggaaggaagggatgtttgggtgaggcatatggacaagatgctggaggaatctggagagatccgtggtttccagtgggagctggaggagggtgagggtggagtaggtctccagtcctgaaaggtcggacttgtcacgggagacccaagtggagactgtgcagccgccgggccaggaggctggcctttaggaggctccatgctgtacacacaagagctgcccgctggaagatgggacagacgggccaccccagcgggaggaggaggtggaggagaagggctcgtagggtaccctgagcagatccagagtgctgttattcccaagtaggaggaggagatccagggaaggagaatgtggagtcccgtagcctagaagtaacagagtttggaggagggtggagggcgtgagaaggtgatgagacaaataaataattctggattatatttaaaaattaaaaatctacaaaatgagacaggaaaatgggcaaaggatacaaagagttcacagaagaaacttaaattgccaataatcttaaaaagagatgcgccagacacacagaccatggagcagaggggacagccaggaggcaccctgcctgggcagccaggtggtctctgacaagggtgcaagagcattccatgggagaggacagcctccagccagtggtgctgggacgctgatacccacacgcagaagaatgaagttggcccctcacattacattgtgtacaaagttaacccaaaatgagtcaaagacctaaaactataaaacttttagaagaaaacatgggccagaaccttcacaacattggatttggcgatgatttctcagacgcagcaccaaaggcacaggcagcaaaagaaaaaagagacaaattggactgcattaaaacacaaccactttgtacagccaaagacaacatcaacagagtaaaaaggcaaccgtggaatgggagaaaatatttgcaaatcaaaaatctgataaggaattactatccagaatatatagagaactccgaaaactcaacaacagcaacaacaaaaaccaacctgagtcagaaaggggtttgaataggcgtcttccctccaaggacggcgtggagacggccgataagtacacgaaaaagcgcccagctccacgaacctttagggagatgcagatccaaactgccattttcatttgtcagtttaaaaggacttgcaaaataccttatacccattaggatggctgttgtcaaaaagcgcagaagatagtgagaggtgacagcgtgctggcagtcctcacagccctcgctcgctctcggcgcctgctctgcctgggctcccactttggcggcactggaggagcccttcagcccaccgctgcactgtgggagcccctttctgggctggccaaggccagagccgactccctcagtttgtagggaggtgtggagggagaggcgctagcgggaaccggggctgcgcgtggcgcttgcgggccagctggatttccgggtgggcgtgggcttggcgggccccgcactccgagcagccggccggccctgtgcaatgaggggcttagcacccgggccagcagctgcggagggtgtactgggtcccccagcagtgcccacccaccggcgctgcactcaatttctcgctgggccttagctgccttcccgaggggcagggctcgggacctgcagcccgccatgcctgagcctcccacccgctccgtggtctcctgtgcggccggagcctccccgacgagctccgccccctgctccagggcgcccagtcccatcgaccacccaagggcttgaggagtgcgggcgcacagcgcgggactggcaggcagctccacctgcagccccagtgcgggatccaccgtgtgaagccagctgggctcctgagtctggtggggacgtgcagaacctttgtatctagctcagggattgtaaacgcaccaatcagcgccctgtcaaaacagaccactcggctctaccaatcagcaggacgtgggtggggccagataagagactaaaagcaagctgcccgagccagcagtggcaacccactcgggtccccttccacactgtggaagctttgttctttcgctctttgcaataaatcttgctactgctcactctctggatccacactgcctttatgagctgtaacactcaccgcgaagatctgcagcttcactcctgagccagcgagaccacgaacccaccagaaggaagaaactccgaacacatctgaacatcagaaggaacaaaccccggacacgccgcctttaagaactgtaacactcaccgcgagggtccgcggcttcattcttgaagtcagtgagaccaagaacccaccaattccggacacaatagcaggtgctgataacgatgggagggagttggaacctttgtgcacgtgggtagaaatataacagggggcagccactgtgaacattgaggtgattattcaaaaagttaaaaatagaattcccgtctgattcagcagtcccacttctgggtacagaccccaaagaattgagagcagtctccagcagatatttgcacacctataatcaaagcagtattattcacaactgcaaaatgcggaagcagtaccatggaatatgacccaaccgtaaaaaggaaagaaattctggcaagcactacaacatggtggaggaacttggaggacattatgccaagtcaagcctgtcacagaaacacgaacatggtatgattccacttacatgaggtactcggattagtcaaagtcatggagacagaaagtacagtgcctggttgccaggggctggggagagcgggaagggaagagcgggaaggggagagcgggaagggagctgctgctggacaggaacagtttcagctgggaaggtggacagcgtcctggaggtgggaaggtggacagcgtcctggaggtgggaaggtggacagcgtcctggagatgggaaggtggacagcgtcctggagatgggaaggtggacagcgtcctggagatggatgttgtgatgggagctgttgctggtcgggaacagtctcagctgggaaggtggacagtgtcctggagatggatggtgtgacgggtgcagacgttcgttaggcgcggactgcgtgccactgacctgctcacctgaaggtgggtacgatggtcaagtttatgctgtgtgcattttaccacagccacacagttcgatgaagaggtgcccaactatgctagtataatgaagatgcaaattaaaacaataaggtctaatttcacacctatccagttggcaaaaactagaggctggcactgggccatggcaaggatgtggaacgtgggcactgccctgatgagaccactgggggatcgtcatggcaacaggaggggcaacgtggtggtgcctgggagggcatgtgtctgtggtgacccagcaaggccatctgtgtattatatacatatgcacgcatgtttaatcagcgtgtaaactgtgtgttatcctatgtggaaggcacgtgtctgccatgacccagcaatgctgtgtattatatacatatgcactcatgtttaatctacgtgtacacgtgtgtgatcctatgtggaggacacatgtctgccgtgacccagtaaggccatctgtgtattatatacatatgcacgcacgtttaatctgtgtgtacacatgtgtgtgatcctatgtggcgggcacgtgtctgccatgacccagcaatgctgtgtattatatacatatgtacgcacatttaatccacgtgtacacgtgtgtgttatcctatgtggagggcacgtctcctgtgacccagcaaggccatctgtgtattatatacatatgtacgcacatttaatccacgtgcacacgtgtgtgttatcctatgtggagggcacgtgtctgccgtgacccagcaaggccatgtgttgtattatatacatatgtatgcacgtttaatccacgtgtacacgtattatcctatgtggagggcacgtgtctgccgtgacccagcaaggccatgtgttgtattatatacatatgcacacacgtttaatccacgtgcacacgtgtgtgttatcctatgtggagggcacgtgtctgccgtgacccagcaaggccatctgtgtattatatacatatgcacacacgtttaatctgcgtgtacacatgtgtattatcctatgtggagggcacgtgtctgcggtgacacagcaaggctgttatatatatatgcacgcatgtttaattcacgtgtacatgtgtgtattaccctatgtggagggtgcgtgtctgcagtgacccagcaaatcctcctgcatagtatgtctgtgtgaacactcagtacccatgtacctggatgcttgttatctctgacacacttgctcagtaacaccatgcagggaagattattatagcatcaattacaatactcaaataattggaagtagtctttatgtgcaacagagaaatggataaattacagggttttttgtttgtttgtttgagacaaagtctcacttgctctgtcgcccaggctggagtgcagtggcgcgatcttggctcactgcgacctctgcctcccaggttcaagtgattctcctgcctcagcctcccaagtagctgggattacaagcatgggccaccacacctggctaattgttgtatttttagtagagatggggtttcgccatgttggccaggctggtctcgaactcctgacctcaagtggtcgacccaccttggcctcccaaagtgttaagattataggtgtgagccactgtgcctggccaaattacagtatttttatatggtgaattattatgtagcattcaaaataagctaaaatatgtctttatcttggtatcacgccataggacatttgagaaactgtcctctttcttggcttcctttgtgaaatccacctgtgtttctggatgtaactctgatctgtgtattttccttgctgtatctggttctatcataggaatatttcaaatttgatttacccatttgcacgttaagcatttgggtcattttcagttggtgttttcagaggtcatatgccattgtattctcatgcctgtctcctgagagctccagcgtctctgagagaggtctgtgtgtgcattccacgtgtgtatacagacatatgtatgtctacaggtgtatgcatgtatgtgtgtgtattacatatgtatgtttgtctatagtgtatatggatgtgggttatgtacatgtgtgtgcatggatgtgtacatatgtgtgtgtgtgcaggagtttctcttgggtgcaaagcagccgtgagggtgtggggttgtaagttcacaggatgtggtgtgtccctgtggctcatgtcttcagcagtcactcattagtcactgtgagcctgtcttctcatttctcctgtattacaagggcagaggaaatgtctgaaagatcaggctcagaaccacatgcctgcctcagctcgggcaggtgctttcaccctaatgaggacggaacgtcaggcttggcctctccgtgatgtccttagctttgttctcagagagcacagatgtttgccactggccctcacagggtgtgtcagagcccaggtgagcatggtttcgtgcccctgggctcctgcgtgaggccgcgtccttcatttgggggtcctgtgtcctcacagcatgcagctggggaaggagtgggctgcgtatgaggggagtcatgtttagtaatctctcgactctcatttaaaacaaatgaagttctctattttgttgcagacttgaagattagttaccaacaatatcttatgaagtttttctttctgctcctagatttattttatttaaaaaaaaaactggaggtgaaaacgctttatctgtagaaataacaaaatgtcatgctgtctcagagtgagatgggagtcaccaaatgctgccactcttttttctgagtcactgttgataagcacggtcggccttagtcagggctcccctgggccgcgggccgtggcctcctccctcaacactttttcccttcccagtggcagaatgcagtggcaggctccacagagatccccctggggcgcactgggagctggcacctgtggtcacgcccgcgacgcggttggaaccagcacaggggaagggccctgttgccacctggggcctcacatgggcactgcttgtgcatttcccctttctgtctcgagcagagtgtgtgctcatgtgcgtcccttagcgcggggtctgtgtgactgaagttttaggaatgtgttctgttttgtgcacgagggagctgggtgcagaagaccaggttaatgatgtgtgctttggtcgttcacctgattgcggaaatgataaattaccggccatctgacttgtttgcaaataaaaagtgatggaggcatttccaatggcagctttgtgttcctggcttgtcagcctctgccccggcctgagtcatcccgagccttccagccggtggctccgtccgggaggtgggaccctgctcaacaaacacgggctttgtgattgcacagtgcctgccgggacgcgttgttctttccaaatgtgtgagaagtggtctgctcccgccctgagttggctgtgtttgcaaagtgggcccgctatcagaattcagctcccgaaatcaagctaagtgacacggtgtggccatttatcacattaccggactccaattgaagttgagaggttgttttaatagcatttgtaaatactccatcttcactagccgcccctgtgagaggcactgagcccccatggtacgcagggttcgttgcgccctggtcgccagttggtgtggaagcctgatggtggtgactgggagcttcagttgcccattagctcccaggctgccttcagagaccagggtcccaccagtgcagccccagccagggcccaggttagccggggtctggatctcctgtgtggcccgcaccggatcgacttttcggtgccccaggggcttggctttgtccagtggaggccgcttcccggctgtgccgtggcctccgggggctggaggactcctgcccgtgtctgcagtcctcgcagaagcatcacagctaatggctgcatttcactaatgcagaattaatgagcactcttgacagtcttgtttatcaatacgtaaaaagtattttgtttttagcaagaggcgaggagtcattattctcagatgtgacagacatactcttgacaagtactgtggtcagagacctgggcgagctggggacttcctgtcggcaggccccggacacgctcctggcccaatgtcctggtgtctgtgataaatgggtgccctgaaccgtattgatgggacagggtaaacaccgaaaaagttgggtcgaactttgactttaaatgttcattacagctaattatggattttctgactatgaattgcagtttctatccctgcactggcaatttatttttcacttatttattgcaaactttataatattctgttagctttaacattcaatgaggtaatgatttaaatgtttgcagcgacatttattatgttttttcagagtgctttctttatctgaaacaaatgaagggatatcttctataaagaagggctgatgttggtggaggagacattaagtttcatccatggggcataggcctgcagttttctctcttaactctgtgctgaaactctattttgccaaagaaaaggatgaacactggctttttaattttaattttctatttttttgagacggagtctcgccctgtcacctaggctggagtgcagtggcatgatctcagctcactgcaacctctgcctcccaggttcaagcaattctcctgcctcagcctcccaagtagctgggattacaggctcatgccaccacgcctggctgatttttgtacttttagtaaagacggggtttcaccatgttggccaggccggtcttgaactcctgacctcgagtgatccgctgcctcgcccccacaaagtgctggtattacaggcgtgagccaccaagcctggccaacactgggtgtttttaagacctgctgtaaaggtggctcagttccccgggttctgagcaggttcacagcagatgcctagtgagatagcgggtcagtcgagcagtgtccatgtcacagccgagtgcatcatggccacacgcagccttctggacccagcagcagctcaccagggcatgtggcctggggccagggaccacagagggcctgaggacacagccccatgtcaggcacacaggttctcccaccttctggctttcccgtggaggcagagatgctgcctgctgcaccctagacccacctgcgagagaagaggaagtgcactgcgtccccctcgggtatccttcatctccgtcccctagacagaaggtccctgtcatctagcctgggggctcccatctgggtggtggccaggatgcagggctgggaggcccatggttaccctgcagctttgggttctcccaccgaggtctggcactcatgagtgtgcatgtgtgtgtgcacatgcaagcgagcactcgcacctgccacctgtgctgggtggaggcggcacgtgtccctgctcctgcctgtgggtgtgttcccttccccaccagacgcagcagagacaggaggcagaggccaccatggcgtcggtgcacaggactcaggcttgccagccggcctctctttttaggagtttaaatgcactccttgaagtgtgttctgtcagagggcagctgtgtcatccccaaggtgaaacactgttttctggtgaggtgtccatgtggccagcgtccccgggagcaggaccatcaccccagcccaccatgcactgcacacgccctaggagcaggagctgcacagcctccagggagcttcccatgttgtggagtcggcatcaaaccagagacggcctaacaggccccagagagctgacccaggggcccagggggctgcagacagggaccaggccagagttactggcacgattggccctcagcaggcccagaacataagtcccctcaccatgcactgtgcctgccgccctgcgcctctgagggagcagcagcctcctgacgccccagtgtggtgcaccttcttgcagccctgcccccaggacagccaccccagtgaccagtcgtcagggagggagcagcagttccctgggaactgcagagcctgaagtgtgtgggacgtttagcttgggccatggaattaggtgatgttcaggcattgcctttgactttcttagagagacaatagctctgcagccccgtagggcagcatctcagcaggaggtccacactggggcactcagaactgcagggttgtggggtcatggttctgcccaaaacaaagcaagagtgcatgagtgcgtgtgtgcaagtgtgtgagtgtgagcaagtgcgtgcgtgtgcatgagtgtgtgtgcaagtgagtgtgaacaagtgtgtgcgtgtgcatgagtgcatgtgtgtgcaagtgtgaacaagtgcattgtgtgcatgaatgtgtgcaagtgtgtgagcaagtgcatgtgagtgcacgaatgagttcgtgtgtgagcaagtgcgtgtgtgcaccagtgtgagtgcatgactgagtgtgcaagtgtaagtgtgcgtgagtgcgtgtgtgcatgagttagtgcatgagtgtatgagtgcaagtgggagagcaagcacgtgagtgtgcatgagtgcatgtgtgcatgttagtgcctgtgagcaaatgcatgttgtgtgtgcatgagtgtatgtgtgcaagtgtgtgtgagtgcctgtgagtgcttgtgcgtgagtgcatatatgtgttaatgtttgcaagcgtgtggtgtgcatgtgtgtacatgaatgtgcaagagtgtacaagtgaagccttggaatgaggtgatactcaggcgttgcccttgtgttgcccacaggctcacacagacacagtgagggatgcaccacgccctgtgctttcagctgaggacaggccctgttcagaatgcagagttggggttagagcccccagtggctcagagtctcttccctgtggaaggccctgtgtgacctggtaacggttgggctccctgcaggcagcccctgccctccgtctgcagctgcgcccgtgtgccctcctctctggcccacctggcaccgccgcttcaaactctcccctgctttatcccaggacctgctacccccacagggcacacagctatctcctatgagataggtttgtttgttaagtcaggtttataacgattaatgtatagatggtgagattcgccctctttggggtataatttagtgagttttgacaaaggcaaccactgcaaaccagtgtagaatattctgatcaccccagagttgcaccaggccccgtgttggggttgccagatttagcaaaagaaaaaaatacacagaaataatacacatgtcagtacgaacacactgctgcatgtagacacaggttcatctgtagaaaataccacgtgaaacttgcagttcagatcaacaagtaactgtctgtgtggtatccgtcgacccagccctgtggcgtccagccgcgtacttttgccttctctggtatgaagagcagggatccctgtgctctgcaaccatccggctaatttgtaagtgggagacactggcagctcctggggcgatggggcagggtggggccaggcgcagtggagctgatggttggaggccccaggacgaagccgagcatcagtgctgggaagggtctggtccactcaatgcccggccggtgggacctgcgcccctgctggagccagcaccggctgcacggctcacctgggaagggtctggtccactcaatgcccagcccgcgggacctgcgcccctgctggagccagcaccggctgcacggctcacctgggaagggtctggtccactcaatgcctggcccgtgggacttgcgtccctgctggagccagcagcggctgcacggctcaccgcatgcctggagcttggtggagtttgggtgtttgcaggttacctctgcctgacatcctgtgcctcagtaactgtgattaaattataactggtgaaactcttgctctagctagtttaaaagagcttcttttattgttaaaaatgatctttagaaatattcccagcaccagtctctcatttgatttctctttttgctctacaggcactaggaagcttttattttcttcatgagtccttaaaaaacatctaccagtttgactttaaaggtaagactgcgtgccgtcttccgggattttgtctcggcactcacccctcctggtgtctggcttccccagacctctcctgccctgtctctgtgagtggccactgtgggctgggtgtcttgagccactgtccagaggtcactccaggggcctcctggacctggactcgaggccccttggctgtcccacactggctccctggcaaggctctggtggggacctggctttcctagagttgagttaagaggaaggaatagtttgtatctgtgttcccatccagtgtgagaaaatgaaaagccgaatgagagggttgcatgtttcagaaataagaacgggcagggacggtcctccctgccgtgaacagcatccccgtttgatggtcatgtgctgtgtgtcttcacggaaaagacttgccctgagacgctccgctgacacaagctgtcccctcctgttcatttctttgtcgggggcaggtgcgtgagctaggccgggtgtggggcttccgtgcgtgctccacacggcctgggggtgtttgtgcgatgacttcccgtctgacgctatcgtttcctgctgtgtgtgagttctcagaaccccacgcggcctccggagcagatgacatccatgtgaagtgccctgcacgtcgtagtaactgtggagccacaaacgatgtcgtttcgttcggattccgtgtttgtgctccctcgggagacggagcggctcctgtgaaattgcgcggtagtcttatctcagttgcttgagtggtgatttcattgatgacgagagcaagattctggccagcaaaatgatttgtcactgccccgttacctgaagaccttcagatccttccaaattatagcatccaagcccttctatgaggcccgtggcaggatcagccgcacagaattgcaggagccggccggtggcgctctccgctccgttttggagacacggcgtctgcgtgctgtgcgctcaggcacggagcggccggcgagagtggagagagcgcgccgacgcagcgtgtgctgcaggaagctggagccaaggagctggtgcgtcaggctgcgccgtgccgcggatctgcagaccttttgtgtttttcagtagccatttgaatacctgttttactactaagttaaatcagtcataaagtgcctggtgaacctacagtgtatttaaaactatacatgagatacacacttcactctagcaaaactttccccagagccctccatgtggccaaactaacaagaacaacatgaggagtgggcagcgagcatgtcctgagcacgtggtgcgtcaggaaggcatgcagacacaggaggcgtgtggacgcgggagacgtgtggacatgggagacgtgcggtcgcgggagacgtgtggtcgcgggagacgtgcggtcgcgggagacgtgtggtcgcgggagacgtgtggtcgcgggagacatgcggtcgcgggagacgtgtggtcgcggggtgtgcggtcgcgggaggcgtgcggtcctggcaggcgtgcggtcccgggaggcatgcggatgctgacgatattctcagtgccccacacggcaggtgttgctgctgatgctcagcgcagtcggggggcctcgggctgggcggttgggctcgagggtcaggctcgggggtcaggctaggggctcgaggctctgagaaggactcaaaaagaaaacctagaaatcagaaacagtaccagaaatgaagcagtggctcatgtgcacacgcggctgagggaagaatcagcgagctggaaggtgttagaaacttcacaaactgaaaagcaagaagaaatgagaataaatttgaaaacagaagaaaatggccaagacctgtgaaacagcgacaacaggtgcagcttgtaaagggaaccccagtaggagtagaaggaaaggaacagaaggaagatttaatgtagtaatggtttagaactttccaaacttgtaactgacaccaaaccacagatccagaaagctcaacgaatgccaacaccaagcaggataaatgccagaaagtcaaccccaggccaccttgtattcaaactgcagaaaatcaaagaaaaaagagaagatcttgaaagaatccaggagattccttataggcgaggtgattccttatctgtaaaggaacaaggataacaattacattggaccttttcccaggaaccatgcaagaaggaagagagtagtgtgaaacatttaaagcattataagaagaagaatatcatattcagaaaaagattattcttcaaaagtgaaggaaattgactttgtcagataagcaaaaattgaagtaatttgttgccagtagacctgccttgcaagaaatgctaaaagaagctcttcaacggaaggaaatatcatatagcccagaaactctggtttacctaaagaaagaaaaagcattagagagggaataagtgaaggtaaaatgaaatatatttttcttacccttaattggtctagcagataacttttgctcaacgtaacaacagcaaccatgtattggttaactgcagcttatggataagtggaatgaataacagaaaagtcataaggacaggagggaggaatttggggtactctgttataagaaacctgtactatcgttttaaggaatatagtattatttaaaagtggacatggattagttatacattatattgcaaactatggcaaccactaaaaagctttttaaaagaagtataattgatgtgttaagagaggagagataatggaatcatataaaatgcccagtaaaagccagagaaggcagataaagaatgggagaccccaaagatacaaagaacaaaggcaacaaatagaaaacttacaaatatggtaaatattactccaactatatcaacgatccctttaaatgtgaatggtctaaatataccaattaaaggacagagactgtcagagtggattaaaaaaaatacccaactatatgttgtcttctagaaacccatttatataaacacctaaagattaatagataagggatggaggaaggtatagtgttctaacatgaatcaaaggaaaacttaaatgggccaaaagaaagctggaggagctatattaatttatagcatcaaatacatatattagaaaagcagaaagatctgaaatcaattatctaagcttgtaccttaggaaactagaagaaaagtaaattaaaccaaaagctggttgtttgaaaaaaacaataaaatggataaacctctagccagactaagaaaaaaaatgacacaaattattcatatcagaaattatcagaataggcagagcagacttcagagctaggaaagttttcagcagtaaagagggacattacatcatgatgaaaagatcagatctccaagaatacataacaatccttagtatctagctgcctaacaacagagtgtcaaatacacaaggcaaaccaagtagagctgccaagagaaacagatgaacccactatcatagttagagacttcaacaccctgtatcaggaatgaacagatctggcaagcataaaatcaggaaagacatagtttaactcaacagcaccatcaaacaaattgatctaattgacacttataggatacctcatccagtaacagcagaatctacgtttttgtcaagctcgcctggaacattcactgagacatcacattctgggccataaaacacacctttacaaatttaaaagaacagaaaccatatacagcatgctcatagattacaatggaattaaaccagaaatcagcaccagaaaagtagctggaaaatccccaaatacttgaacattaaacaacacatatctaaataacatatgcgtcaaagaagtctcaagagaaatttaaaaatattttgaaccaaatgaaaacgtaaatacagcttaacattcatgggatattagcaaaagtaatgtttagaggtaaatttatagcatcaaatgcatataagaaagagctaaaaagaaaaaagtgctaagaagaaaggaagaaagagctaaaatcaattatctaagcttctaccttaggaagctaggagaagaaaagaaaattccaaagtaagcagaagaaaagaaataatgaaaattggaacagaaagcaacagaattgaaaacaggaaatgaatagagaaaattagcaaaaccaaaagctgattctttaaagcgatcaataaaatcgataaacctctagccagactaagaaaaagagagagaagacacagattattaatatcagaaattagagaggggccattactgccgatcctgtggacatttaaaggataataaaagaatatcattaatttctgcctataaatgtaataacttagatgggccaattccttgaaagacacaatctatgaaaactcataaaaggaaaactagagaatctgaacaggtctatagctattaacaacactgaataagtaattaataacctgctgaaaaagaaagcatcagaccaaatggtttcactggtgaattctatcaagcatttaaggaagacgttataccagttctctacaatcttttccagaaaatataagcagaggacaaacgtcctaaatcattctatgaggccagcattaccctaatactaaaaccagataaagacattacaaagaaggaaaactatgaactgtaaacaaaaatgctcaacaaaattctcaagagtcagttatatactatgaccaaccgagatttactcctggtatagaggctggttcagcatttaaaaatcaattaatgtaatccatcacagcagcaggcaaaagaaggaaaatcacatgatcataggatagatgcagaaaaagcatttcccaaaatccacatctcttcattgtttgaaaaaaaactcccagcaaactaggaatagaggggaagttcctcaacctgataaagaagagctccaaaaatcctacaatgaataccacacttaatgagaaattagatgcttttcctatgagatcaggaacaaggcaaggatgcctcctctcctacttctcttcaacatcttactgaaaatcttagataatgtaataagacaagaaaaggaaataaaagccatgttgatggggtgatgggagatagaactatttctgttctcagatgatatgattatgtcaagaatctcaaagagtcagcaacaataacagacaaacctggtaccagtaagcaattatagcaacattgcaggatgcctagttaagatacagaaatcaattgctttcctgtgtagcagcaatgaacaggtggaattttaaattaaaaacataataccatttgcttaagcacacaccaaaaggaagtacttaggaataaatctaacaaattaatacaagatctctgtgaggaaaactataaaactctgatgaaataaggaagatctagataaatggagagagatttcatcttcatggatagttctatggttggaaagtaggtgccccccacccccaaattcatctgctgacctcctaacccctaaggtgatggtgttaagaggcggggccttgggaggctgattagaatgtgaggtcagagccctcacgaatgggatcggagccctcatgaaagaggctgggagttcatttgccccttccatgcatgaggacacacacaaggcactatctgtgaggaacctcatctcctagcaccctgatcttggacttcccatccctccaaactaggagaaagacacttactttgtttacaaaccacccagtctattttgctatagctgcccagtggactaaggcagatgggaaaacccaatactgtcaagggctcagctcttcccaacttcagctatagattcaacacaaccccagcaaggtgtgtcatgccattgacaaactgactgtaaaggttatgtggaaagcaaaatacccagaatagcccagagttttgaagaagaagagcagagtcagagcctgcacttcctgacttcaagacttgctgttctgccttgtgggtgaatgggccaagcagactgtggcatgtcagctccacggggtgttatttggtgataaaaagaaatgagctttgaagctgcgagaagacacagaggaggctgacacacctgctaccaatgaaagaagccaacctgaaaaggctacacactgtgattccaactctgtgacactctggaaaaggcagaactgtggagacagtgaaaggatccgtggtgtctaagctccgagtttagggaatggcctctatttcacgttctgtccatgctccataagtcgctgaaacatctcatgctgtctcctgtccatgaggcacccacatccaggactgtgcgcctagggctgggccgggtcacagcacccagggccaggtcagaccacagcacccagggccgggccacaccacagcacccagggctgggccagaccacagcactctgttttttcctgaaactcctgcccaccccagtggtgacccagtaccttggcccatggtgctgtggtcctcaggttgccccctctgttcctcctgccatagtggggtggataataccccagaaactgcaggttggagctgcttgtgggacacaacacactgctccaaagcggtctccaggaacctcgttgacacccaggagtgtcacctcagtggcccaggagccatcctgtggcatcttgcaaagaggccagcagccacctgcccactggacccagcaggagtttgaggaatggatccctgccatccttgatcacaccccaccttgggtgtggagctacctgtccataaaaagaaaggctgaggcctggttgtgaacaatagtgagacgggccctgcccatggcgaggcctgtgtccctgggcctggcctatccactggggggtccaggaaaggtgccaagcagccactggcaaagcccatctgggaggcaccctgccgcgcgctgcctctctcaccatcacacataaacctcttccctggaatatgagtgatggaggctggatacggggaggaaatcgatgttattaaataaattcatgtgaaggtctgagtgaatggtaattctacagccctcttaaatatattcacgggtttaaaagaggatgccaattagctcctgtaaatctgcagtctgggagctctcaggcgataatggagtggagtgtcagattccaggtcatgggaggggaatttatgagccacaggcatggagtagccggcccgctgggggtctgttctgggtcggacccctcatcagggcctcctctcggggggcctctctggctcccatcgggctgaagtcgggtggaaacaggttgtgctccaggctggttggatggggcacagtgatgggatagtcacctcgtccttctggtctcttccagctaagaagtatagaaaggtcgctggcaaagagatctactcggataccttagagagcacgcccatgctggagaaggagaagtttccgcaggactacttccccgaggtacgtagcgaggctttctcactgacgtgtttacttctcagagtgagccagtcagaagtgacatggaacacggaattttcgcattgcactgttactagtcacagctgcctgttgttacctccgataatctgtcttcctgggagtccaggcttctgtggttggtctgggctgtcacacgtaagggcagtgagaatctaaggcattagcaccaagtaatcagtaagttcctgaatcctcatatccaggagaaagaaccttcgccaaaagatgtaggaaaatcattcagctcccttggcgtgcacctggggtctcccgcacgcccagctgggagagggtcaggctgactggtggtaaccaagacagtggctgacagtcctgtgtgcccgtggtgtgagtgtggggcaggggcacggtcctgtgtcagatacagccttggtggttgtgccaggctgcgagcagcagggtcccggcagttatgcctgcgtcacacggagagattagaatcaaaatgtgtggaaggcatttgtcgtctcactgccagacacggtgttgatgagaaattggtgtttccttctggcggccatgcactttgctgagctgtgtgcgcggctgttgctctgtgcacgtgatctttgggtaaacctcacacgcggcattgtcggcgtctccctggctgtgtagttaacctgtcgaggcagcgtttgctgctttgcccttcctcatctgctgaatcacagtggggtgcaggcactgtggccagaagcagcccaggcactgagacggaagagctggcagctggacgcaggtttgggggcgtccaggctgtgatataggagctctcgtccggacttgtctgcgcaggcagccccaagaaggattgctctgcggtcctgtctccacgagagctgtgcaggctgaggctgctacggagctgacttccagcaaggccacaactttattaacttgctttatggcccgcaccttgagtgagggactgtggccgcccgtgaaggatggggtgctcctgtcaccctgtggctcggcctcctcatccgtcttcccaaggccaaggacgccgtgtcagtgggccagcctcccgtcctcggtcctgcttccggcaccgcccgtttgcctccctccgctccggatgtccagcagttggaaaggacatgcaagaaagctccatggtcttctccacgcacagtagttgcgtccctgggtcatgacagcctccctgaaggggccacctgtggtgcaggcccatcggaagggcagggcgggggctgtggtgcaggcccgtcggaagggcagggtgggggctgtggttcccctggagagcctgcgagctgaactctggcctctcttgaacccgggcaaggctctcatctcagagtgaccagagaccgactcagggccctttgtgggaagcgtgggtgctggggtgggggggggctgggctgggcagggccaggcgctgccacctgatggcatgaggagagcagctgtgggtggctgggctggtccaggcagaggctgttgacccggcacctcgtctcaggacccatgtggctgcattgctgtccagggccgtggccggaccaggtgctgctgggctgtcccctccccaccaggtgtccacttattcactgggtcctgtccactccggatggggtaggagagcccatagggagccccatagctcttgggggtgggggccgaggtgtgtcctgagaggccagggcccgcagggtcagccagggtgggaagctcgggggcagcgggccctcagcaaggaacagacactctagggtcctcccaggcagccacacaggctcctgacccctccgtctctcagccccgccccgaagcagccctgccactctggccagcgggacctccttcttgcacccatgcctcaggcttctcttttggacccagcaagcggggagctgaggcccggggcccagactgaagttgggcaagatctgggggcctctgctatgactttgccaccctttgaagggtgggtgccctggcaggggtctgagtgtggcccctggccttggtccctaatgccagtactctgaggcctctgtgatgctgggggcctgctggcatgggtctgtggagggcatagcacgaggggccgcccctcccccaggaagagcagcctcaggcccggtttgtatagaaaccccagcccccagcctgggtccaaccccagtgttgtgcagtgttgtgtccacaggcagaggagaaggcacattctggaaagtagacgattcctgggaggaaaaggcaccgagcctctttgtgtggacccgtctctcccctgggaaagcagcgtgtcgctgtctgcggcctggtggtcagctgctcagcagatccttgtggctgctggtggctgggacggggggccagcccctgccctgggccgaggcctccctgtgggtcagggccagccctgccacgtcatcgtcttagaaatcctcccgggacccgtgtgtttgatgatctgcaaaggttttctgacgtttcctcttccctggtaaattaacaaaaggaaacccttattttaaaaactgtaagcttctaacattctgtccctagtgtgggtttttaaccccacagagcctatgtggcaccctgtgtccttgctggagggaggaaggaggagggaggggcccggggagccatgggagtcccggcctggcagcctggccgggcccgcccctccctctgtgcctctgcacccgacctctcgctgtgtttgaacacattttggaggaaggaactagtttcagactgatttctctttcttttattaccatcacttaagggtaatctaaatgtaattaccttgatgggggtataatgcagtctcagataattacagccgcagcagaaactaacaaaactttctctgctgatttatggatgcttttggcttggtatgaatttcaaatgatgcctctgggagccacactccagataatgtgaggccatttttaaaacgcagatttgtgtagtcgatcagggtgagtcatttttttccttttgcccgtagtgagaaattggttgctaccatagatcacagggccggctgcaagctctcatgaaggatgaattaattccactaatgctctgagcgggccttcggcgtgagggttgtgtggcaataacctccccgcagcctctcttttctccgtggcgatttatgccgtcttttagtagatgaaaccggctggattcgctatccatctgcctgctgaaggaaccctattaacaggggcctgagagagacttcatatcatcaggtgaaggatgtacccccacccccacgggatgtgggtgtcatttctgaggtgaaaacctctctgggagtagaggagccaacacaggccagggggcggccacctcgggagagcggagccacggccgtcccatctgcaggctcctgagggctccccaagtgagggcttcgaaggtggccggtgaccagaaagttcccgcacacagcctgggatggaggagacccccagccctggccatacaccctctgcctccatttgccgtggctggagcaacaagtatgtacatccagaagcttctggggtcttcctgagtcctgagcatgtgagcgttggctgaggccccaggacgcccgtctctgcctcccagcacttcccggccctgctctggaggacagtgttgggtgtggggtgcatccacctcaggctggggtgctcaggtgcgcccgtgggggcgtggcctctgggaggggcccctgaacctgctgatgactctggggacctccttcctcttgggccaccccaccccaccccagccctggctgcctgcttggggcttggccagcaaggggagtggggcgtcgggaggcggggacttcagtgcaggaattggggcggtggttcccgttctggttctttctccaaagagctggaggtcttcaggccccagtttcctcgctggggaaatgagggtggtacctgtcctgagtgctggtggggccaccgaagggtgcatgggacgccctctgtgaggactctccctgcaccgcgcatcccaccctaaacccaaggatgcgaccgcacctgcagccacgggccgtggaagtgtcaggacactgtgggctgtggcttcatttgttcctgctgtaaaatccctcgaaacatagtcttagtgcagtggtagctgctctgacgagcttacctcaaaaggaacttattttctacaaatactttagaaaatagttggttatgataatatactgttaaattttctgagattcatttgcaatttatttaaaaatcttagaatcctaaaactacagttattaccaatttatattattcaaaaataacattgtttctcgttttatttattcagtctatggataattaatgttggaaaaaattctccattactgtggaaaacttaaaaatttaaaaaaccaagatgtacccacatgcacatagattcaagacacacaaacacacaccttaacacaaataatcgaaaactcaggagaagaataattaattttggttcaaaaatttacaaatgccttccatttttaatggaagtaaaactgttgacggttatcgcaaattctaggtaaaaacctgggcatgctcagtttggggtctctgctgtacctgtcagaattcagaggcgtgcgtgcagggaggtgctgtgtccctgtgtcccgggccctactgcctgcctggaagcaggagaggcagtgcccgggcacagctctgacgcacatgggaagcgcttgcctccacatgccacggagcacctctgctctctcgttccacagtgtgctctggggctctggccccatccagcaggactgagacccatgggctgtcctagcagaggatgtggacagcgcctgcacccaggaagtgggctgtgggatgcttggggtgggccggggcacttgtttacacaggggtgactgtgggcttgggggagtggcaggggcactaccgcgagtctggacgtgggagctggcagagggcgtcctgccggtgctggttaggagcggcctccaggctccctgccgagcccacacaccggggttgggactcccctccctcccgttgggtgccccccacccttcggactcaccgtttctcccagaggagctggtcctgactgtctcacaaggccagcttcccctgcggtcacccctgtgacttggtgcaggcaagacacctgtcccggtcgcttggtgattgcatcagcgaggacagatccgggctcttgtgattgtcatcagctggcgaggacatggatctgggctcttgcggtcgttgtcatacgtgcctcctgcacaaccctgtgcccgcggtgcctgtcttcccatccatgttgaccgcaggtttctcacccgccagccgcaggcccctgatggagttggtttctggggaactggccctcggccatcttcacacacaagcggcttcacccccccacatacacacagcttcacccccacacacatgcttcacccacagacacacgtggcttcaccccccacacagtgtcttcacccacacacacacacacacactcacatttacccatacacacacgtggcttcacccacacacacacgtggcttcacccctgcacacacatggcttcacacacacacgcacagcttctgccccccaacacacgcgcaccttcatccccgcacacccccacacacacacacgtgcagcttcacccccgcagacacatgcggcttcaccccccccacacactcacggcttcacctgcacacacatacacgtacggcttcaccccccccacacacacacacagcttcacccccacacacacgcttggcttcactcccacacacacacgtggcttcacccccccccacacacacaagcttcacccacacacacacgcacggcttcaccccccacacacacacgtggcttcacccccacacacacacgcaagcttcacccccacacacacgcggcttcacacacacatgccacacacacgcaagcttcacccacacacacacgcacggcttcacccccccacacacgcgtggcttcacccccacacacacgcagcttcacccgcatgggttctgaaggcttggcctgatctctgctgcagcatctggttcccaaagcatgtcaggccccccagtccccccagacaggaggtgtcgaggcacggaagatgagctgctggtgctctaggggagtcgtgtattgaggcgccttggcctgcagggacggtaccttttctcctggaaagacgcctgcctcccactgtcactagtagaggggcctcacccagttactgtagatttgtcaccagtcacacgtccagccttctcccatggcagcccccatgggtgagaacccagccttgggcccagtgactgtggcctaaagccaccaagggaccataggtgcagttcttaacctgtgagcctcagtttccctttctggtcggcccgagggttgggtgtgtgcctgtgtgttggacgccagcccgcggcggctgctggtgcgcagagccacccctcgcagcccgccggcaacatgggctctgtcctcccctccttgtacccgaggccccacagctgggacttgaacctggcagcctggcagtcctgtcttacccactgccttgaggccctgggtgctgctggtgtggatcctgtgcgtggctgggccgtgggggggcagtggctgttccaggtgggccgtctccccggaaagtgcaggctggatttggacgtgtgggagatggaggaagggcgtctagtcaggcagcaggcagctcctctggagtgtggaggatggaggaagggcgtctggacaggcggcaggcagctcctctggagtgtggaggatggaggaagggcgtctggacaggcagcaggcagctcctctggagtgtggaggatggaggaagggcgtctggacaggcggcaggcagctcctctggagtgtggaggatggaggaagggcgtctggacaggtggcaggcggctcgtctggagtgcaggctgagtggaggggagagagtccaagcattgggggtgtcccagctgcaccgttggtgggagcatggagcccgctgtggggcatcagcagcacccacttctccccacagctcagcttcccactgatgtgtttccattgcagacacagttaccgacaggaaatgaacacagaggctccccggggcaaatggcctccccgagagaggaggcggacatgtttggaatcagagacaagtgtctggtgcagcacgcagggagcctgccaccccgccaccccgccatagagctccctgggtcgtctgggcatggccccatgcagcagccagaccagtagcctggggatgccttggccagcctcctggagctttggcacagcccatgttgtttggcaagcagggcagcctgagcacagcaggggatgtgggctcagtaccagagccagctcgtggtgtgaggacggatcctcctcgacgagtagagccatagcctggcgtccaagtgcgtggccaggccgggaggagtgtacaggaagtctctgtaccttatgctcaattcttctggaagcctaaagctgctctgaaaaataaagcctattacttctttaaaagtctgcttacctggggcccgggactttacaggtgagggaagaaggaccagccctggaaggaggaagcttggagccacctgtggaccctgagggtgcgtctgtgggtgcctcagtatcactggggagcagagagcccagaccttttacaatgctgggtggggtggccatggaactgcacaggtgaggagggggcgcctctcactccccaggagactgcaaaccaagaacgtctatgagacgagcagacaccagaatacagactcaccccaaataaagttgatttcttgggaaaagctgacagactttaagtatgtttaaattgctcaaagagataagtgaaagatagggttcattaaaaatgttattcaactaaaacagaaataaaacaagaaaagggaatatgaagaggagcctgtagaaacattaaacattctgcattagaaattacagaacagattctagactagatgtggtcaaagagagaatcagagaattagacaatgtcattaaggagttcatctaaacatagtcaagacggacaaagatttgtgtttgtttggttgtttgtatgttttttatttttatagaaaggagcagttaaaagacataaagactattaagaggctcaaataaactcaaaataaattccagaaagaagcagtggagcagtgttggaagtgataaggggaaattcttaaaaatttaattcccgagcacaatttggatacagagcaggatatataaaaataaacccatacctggatggcagtgaagcttcagaatattgatgacaaagagaaaaactttaaaacagccagagagaggaaaacatacattcagaggattcacagttcgtgtgccggggtgcttcttacagcagtggtggatccagagtgcaggggaagaatgcagtgtgtacgggaagggttggctggcttcagcatcacccccaccagtgtgtggggcttggaatttcccttcttgagcatgagtgggagcacttagggagggggcagggagcacttgtggtgggggcaggcaaagaagggcctcatgcctgggaatccacagccctagagccttgcccaggagggagctgtgggggccactgtcctggagggagacagggagaaggagacggggctgcaggggccactgtgctggatggggaccaggagaaggagacagggctgcaggagccactgtgctgccaggtgccgccaacaggccaggcgagatgaagggcgagtgtctgtaggagtttgcctgtggaggctgtggtgaccttgcagagagcatttgggcagctgttgtctggcacgtgcgcatactggaggagccaaaggggacggtggccagtggcaaggtggggtcaaagggagagcctctgatcactgcgctctccgtgttagatagagggagcacgccacgctggaccctttcttcacgggtgtttcgtccacagttaactccagattcccatctgctttcatctcctcagcagaccttagggtgtggtggaggagacagggtcttccctgtcctgctttccttctctgccagcccatgagcaccaagaacagcagcccctgtccacctccgcccccgatggcgccaggcatatggctgctgctgggaacggaatgggcggtgccctgccctgttggctgccgttcccccgccactgcctgaagcgctttgctttgtggaccttggacttgactctgtcagcctcttcccagtgccttctgtggttttcaagggtttcccaagaggcctaggctgtgaagctaccctgttctgcatggctgtttaaattaaaattaatgaagataaaatggaatctaaaattcagttcttcagtcatacactttgcacgctcggtggccccggtggctggccactgctgtactgggtggcccagcagaggaacctaccatggtgggaggtgggagggcaggagggcctccatgccatctcgaggggagccctgccacctcttaaagaacacccctctttggaatctcatgctgttgactgtttcacttgaattttgggggtacttttagaccagagctcaggctctacgttcggtggctctgctaggtggtggggatcagtgagaggcatcggtgggtgagaggcatcggtgggtgaacggcatcggtgggtgagaggcatcggtgggtggtggggatcagtgagagaccacacacactgttggggtgggcaggtcacccactgtccaggacgcctggctgggcacggctgctcaagtcttccctgtggtccagccgagggcggccgtgtgtctcgagctccctgatcagcatctgtggtgacagtggtttccctgcagctgctctcacatgggggcatggggctcacaggcggcaggctggcacgtttcttcatatcttccccccaccccaccccaggctgggcatcagcagcccctgcaggcatctctgtgcgaagccccacttgaggataggtgcacagctcggttctctttagtggggcggcatcagtgccggaagagccctgctgttttttgtttggaaagcatctcctgtgtcctttaggtgtgtgggacccacgtgttgctcttgctcacttactctggctcatttgtgtgacgtgtttatttttcagtgcaaatggtcaagaaaaggcttcatccggacgaggtggtgcattgcagactggtacgtggtgtctgtgctttgtcaatttccataacgtttcttacccttttatatcttgcaccagcggcatgttccacacacctcattggaggctctactgattttgcatgaggacccccagctgcctgacccccacctgccactctgacccttttggttcacggcgatgcattcggagcattgtcactgttccctgtaagtcagacatctgggtgcccagtgccaatggagacacagtgacggccccagtccctccccgcagctggagagttccgctggccagagcccgctgcacagagaagtcagcagggaggccccctagtactggggccctgtggctgcccagtgagacggcgtaagcgctgcctggcagcctggtccatcagcagactgagcacagacgtagcggagcctgcgtctcatccacatatcctctggcctggcctttctgcagtgaacatgttctcgatagcgccgccccaccttttctgcatcataagaaacagaaacctgttatctgctttcctaaggtggcttccaggtggctccccaacgtgtccctccagccatcacatctcatttgaatactgttttcattttcttttcatggattttccaaaacttggctgcttgattatctgctgccatgtaacagaccgccctaaacttagcagctttaaaaacacatacgaggtcatagctgtgagtgtctcaggacccaggagtggcttttctggggctctggccctggtcaccttggggcttccagaggactcatctccgagctcactggggctgtgggcaggggtttctgcccctccccctcgggcctctccctggggctgctcagggcaggacatccccaggaggagcaagagtccagaaagtgagggggatggagggagggagggggcttcatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggaaggaggggcagggggaaaagaaggaggtgggggaagagtgagagagaagggtaggagaggagaatggggagggggaagagaggaggagggaggaaggagggggagagaaagaggaagaagagggagggggaggacagagggagctgagaaggagccgcggtcccgtgcccaccccaggcagtgtaggctgcaggctgccctttgctgttggtcacagggaacagccttggcatggtgtgggggcacatggggcacgttcaccaggcagcgtcatcggggtcattgtggcagctgggccacaggctggaggagggcaagaccgcctgcacgcactcattcctggcgcctcctggtagggagacggccaggtcttggagcctgtggaggacacgcaggcagtgagggctttgtgggacagtgtccagactgtgccaagccctgcactgacctcccctggtgagggggcacgtccttgccagctgaaggtgctgagggtcccctgcagtgtgacagaggctcaggccttgatcaggccttgccgagtccatgtgcctgcaggcccacagccggcccacggggcttcccaagggtcttccctttgggagtgaaatgaagcactcttcttgcctgtccctgtgcccccaaccctgccttacagggtccccgatgggtgcagccggcagccctgagcagcatcagctgaggctgaggggtggcccttcctcttagcttagccatcagggagagtttccatagtcacctgtaagtttttctctttaaagaaaagtagctcactttttagttgcccagagtaactgcatttgtaaagacatattcagacttcactggaggtttcctgacctctggccttgtcggaagacaggtgggtggacaggtgccccgcctcgggtggctccgcacggcggaggccagtgcaggtcttatcttcccggggactccttgggagaacgaagtgtgacccggaggctccggcccttggtgacgtgtccttttctcttttggttgcagtgcctttgacttggtgaatatccatcttttccatgatgcttccaatctggtcgcctgggaaacaagcccttccgtgtactcgggaatccggcacaaggcactgggctacgtgctggacaggtaggtgtgggcgggcaggtaggcgtgggccgggcaagtaggtgtgctgggcaggcaggtgtgagtggagaggtaggtgtgggcggacaagtaggtatgctgggcaggtcggtgtgggtggacaggtaggtggggtggacaggtcagtgtggatggagaggtaggtatggatggcaggtaggtgtgctgggcaggtaggtgtgagtggacaggtcggtgtggatggagaggtaggtgtggatggcaggtaggtgtgctgggcaggtaggtgtgagtggagaggtaggtgtgctgggcaggtaggtgtgagtggagaggtaggtgtgctgggcaggtataggtatgggtggagaggtaggtgtgctgggcaggtataggtatgggtggagaggtaggtgtgggcgggcgggtaggtgggtgggcaggtcggtgtgtccactcaccctgttggccactgggaaaggctgtgcctgctctgggaggcacactctgctctgcgcttgctgatttgccgatgggccttactggagttgccccatggaggtggcagagcccccaagccctggcaaaggctggagctgcaccctcacaatggacttggatggggatggcttcactttctctctgacttttttgtgggaaagataagaaaacggtgccatggggtgctgtggtgggaggtgaataggacactgaagagtcagtgggagcgtgggggccacctccacctgcgcctgggcccctgccccccagtgctccgggctgctccaccggtgatactgtggagatgacgggctgtcactgggaagcaggggacccccattggtgggatgtgtctgatcttggggcccgtgtccctccccatctacagctgggccttttgctgaagctcaggccccacagccaggcagtctgggtttattctctgcccattccagttaggcctgtcatggaaacctttcccgccagcatccctgtggttgacaagacagtgctccgtcagcttgggcttgcagcagtgatgaacacaggcctgagaccagcagttctgccctggggtggtccctgatttccacctgaaccccattctgctccctagagggcccctgacctgagcccccgcccagcccccgtgcgtgcagaatgcggagttacactcccgactaagcgtgcgagggcctggagctgccctgcgcctcgcccaccttccagcagctggcatcctcagacgccgaccttctgttcccggggccggttctctcccacccacacctgtcttagcctggacttgtgcagagcagaataactgagtcattcccaggccaccactgtccctggggcagtcacaactgcctggggctgcacaggcagaggcagggattggcaggcactgaggtctggacccagagagggaggaggctgggcagggcctggtaccctctgagcctctgggaggcttcctggggaagacagtgggaggagcagtccatgtggaggggtccgtgggtggggcccctgccccagagtcatgtgtggtatgtgaccagcgccgtcagatgctcaagagcaggagtgggagagtcctatgagaggcacccctggggactgtgtggagcacatttctacccaagacccacgtcctgaggggtccctaaggcaggtggggttatgaaggagaacagcagccagcaggtccctgcctcctaatagtgccttgtaaggatagtgttcagtgtgcatgtgtgtgcctgtgcgtgtgtgcatgcctgagtgtgcacaccttgtgtgcatgcaattatgtatgtaattgtgtgtgtgcacacatgcacatgcatgtgagtgtatgcacagttgcttgtggggtttgtgtgggggtgggtgtgcgcacatctgcgtgtgtgtgttcgtgtgtgcatgtgtgtggatgcttgtgtgtgcatgtgtgggtgcacgagtgcatacatatgtgtgtgcacgcgtgtgtgggtgtgtgtgggtgcatgtgtggtgtggatgtgtgtgggtacatgtctatttgggtgtgtgcacacttgcaggggtgtgggggttgcattgtgtgtgcacacgtggacacatgtgagtgcacttgtgtggctgcatgtgagtgcgggtgtatgtgtgcgcgggtgtgtgggtgcatgtgtgtgtgggtatatgcatgtgtgggtgcatgtgagtgggtatatgcatgtgtgggtgcatgtgagtgggtatatgcatgtgtgggtgcatgtgagtgcaggtgtatgcatgtgtaggtgtgtgtgtaggtgcatgtgtctgtgtatttgggtgtgtgcatgtgtgcaggggtgcactgatgcatgtgtgcatgtgtgtggggcctcgtgtgggtgcatatgtgtaggcttgtgtgggggtacgtgtcgatgtgtaggcctgtgtgggtgtgcatgtgcctgtaggtgtgtgcatgtgtgtgggtgtgtgcatgcatgggtgtgggcgtgtgggtgtgtgggtgcatgtggatctgtgtggatgcatgtgtgctaaggtgtatgcatgtgtgctggggtgtatgtatgtatgtgtgcgtgtgtgtgggtgtgtgtgcatatgtggggagagcatatgcacgtgggttggatatgtgtgcaggtacatgtgggtatgtgtgcatgcaggttgtgggtgtgtggagtgcatgtgtatgtgtgtgtgcgggtgtgtgtgcatttgtgggtatgtgcacatgtatgtgtgtaggtatgggtgtgcacacgtgtgtgtaggtgtacaggtgtgggtgcatgtgcacataagtgtgtacctgtcatagctcagcactgtgcatcctgaggaaggggtggaaggctgcattctccagtaggtgtggctccagggggagttggagctgatggggcccctcctgaatgctggctccgtctgctgctgtggtgagtgtggcctgcgtggctccttgcctgccgccttcacgatcctcccgggttccccacagggctctgcacaaggagtctgggctgggctcccatccctgtgctgttattagcgggtatatggccttggctctcctctgcatctggcccttgctgagggccctgaggcgtggccccttatcccctctgaccgcccctgacctccgtctccagagtgatggagccctggtcccctgccactagcctggtcccggggagggtggcaactgcgaggcctgggtgctgctgtgctcgtggccacacactgaggccggccctcagccctgtgcacggccacaccctctgcaggggacctgtccggcctcccggatatctctggagctggcactgacaccgaggcagggatcggtctgagcctggggactgtgctctcaactgcccaccgtagggaagcagcacaggtgggggatgggggcctggggctttgtcagcgacaaagtgactgatgaccgcctgtgccctgggcgccctccctggacagcatgtcagtcgcccagggagaagggcctcacccacaggagcggcgcggttcttcctgcctgatcagccctcggcttgcaggcaccaagcgtctcggggacctcccacggagcccaggagcagggagggccctgccgtgtctgctgttgggtcttggtgacagcggttaggttgtcagcatggcatggcattaaaatgtgtcattgcccctcgctgccatggctccgcggcctcaagaaagcagcctttgggcttttgggccacttttctgcgtctctgcattcccatgaatggctcctgcggcgcgctcagccagccgcagatccggacctccgcggcgtggggcgggccgcgcaacacaaagggcggctctgtcggagtctggaacaatgggtcgccctttcaccgcggctgctaacctcttggcagccaccagcagaccacattctgctgtgcggatcgggcaggacaatgccgcgcggcctctgaatggacgctgccaccaacggggccccattcacggcgttgggaaccgggcgcacattgtctgccccgcagggagacagcgaggaggctcctgcagcctcttcctggtttaatctccccgcgcggcttcccaggtccatgtcccgtatcagctgcggggccggcagcaccaggcccaggagggagggcaggtcccagccctggaggaggatgcaggccaggttaaaacccagaggcaccgtaggaccttcgcaccgttgctctaaacctaaacgcattccagagtaggaagatgattgtaaaacaactgagagacaagctctgagttaaagtcttcagaagcagccccagggcgagtgctgcggggtgcctgccaccaccacagccagtcacagggctccactggacttcttatcacagatgcgaacctttacttttttgtgtgtaatttttgaaattgttgctgttaacctcttgttatgagaagtttaaaaagaagacaaatccctaatgagtgaggaggaccaggctctgggcaggtgttggcggcatctgtgctgggctggggtcctggaccctgggtgaggccgggccgtgcacacccttgtgtggctcttggaggcgccgagcactcagcccgtgttgggggcagccccggtccctctcctggacacacaggtcagcccttggggggcatctgggggctgagccagaggtgcacgtcagccttcctaggcaccatccactgaggcgtcccgaaaccttcctgagctttcagctggaaaggagattttcccataagtgacgggactctttgtctcccctctgaaatgtggcctgggctagttcaacagaaacattttacattacaactgtgaaatctcggcataaagcacccctttgtccccccattattttctcacaaatacagtccattgtcatggcgctgaagttaatttgatcaacattgggacatttaacttttatgtccagtcaaaagagttgtttcatgctcattttgggcattcaaaggaaatgattgccagaaaaataatgttcttctgaacaattccaagcaattagtttcccagggagaggtgacgtgatgcccgcgccccagccccgctttgtggctttatggagggccatcagttagctgtcagccgctcaaagagcccccaacctaaatgtttctctttagacgttcccagaacttgccttgctgtgcagccagtaaagaaaagctgctgcgtctccaggcaaaggcaaactcggcattaaagatctgggtcaccctgagcgctcctggccacagggctggttctcgcgctcctcacactcccgctggcctcggagaacagctcacaggctcttgctggtcgtgggctcgtcccaatcaggctttctcagactcggagacctcagggtggccgaggtcatgtgtctgtggagcccaccaggcaccctgtggtgtccctccgcatgcccgggactcctggcagcacaagcccgtgccctctgccgttccgctgccgtgaagcccgctgcctctgtgtcgccttagcctctccagggcgtggtcggtccactgctgcccggcaggaggggctcctttcgcctgtgcctcagctgatccatggctgcgatcttcattttgttgaacatggagtcaagagccaagaaaggtggtgccgctatgcagatgcaggggcagcgcctgcacccgccacgcaccctgcacgttctccgcatgtttcctttccttaagaaacaaaccatgtgggcccgcaggtgccccgtcctccatcctgaaccccatcctggcccccagcatcagcctgaattcagcacctgtcgctcctttgcagctttctggcctcttgtgacacaggcacggatgtttctgtacttttattatgtgccagctggaggcaagcgtcgacgtgacgttgctgtgacgcctgtgtgtggtttatgtctttacacatgtcatcgcctgtgaccaacatgtccagcatcctgtgaacggagtctgccggacgtctccacgagctccagccacggtgctcggtcatgggactcgctgccggctgtctggagagcgtttgggtggttcccggccctttggtggcagacaggacgatgcctgtgctgggccatgggggccgtgtgtctccactcccgctggtcctttccacaccctgaaccccagcgtcaccactggcatctcagccagttgtgttttctgctagctggagaggagtggggggtcctggaggttgaggcacttctgtgccgcaccagtttttgtggtttatggcggtgtccaagcagagtttgagagggtgggtctcagagtgagaaaaacaaaagtaaaatggcgatgctccgtgtggagagcatgagagcggcggctgccgaaggagagccctgcacagccctcctgccgccctgcacggggctccccgcacgactctgcccgagagcacttgatgtggggatggactcatcgaagggagtgtgggctttaaaaggtgccagacactgagaaggcacatactgctggggcccaggatgcccccagccccaaggctgaggtccagaggccatctcagccccgcccaccgcaacacaactctgtggcggggctttgcagccgaccttagttctcagtttgagatctgagttctggtgacagcttgcagacggccgccttctcactgcgtcctcacgtggtggagggagggagggagggaaggtgagcttttggtgtcttcctcttttacaaggacacccttcctcttgcatcagggccccgcctccctcccccacccccgtgacctcaggtgctggcccctaaagggttggggctccgaggctgggactcactgggtggggaagtcagggggcctttgggtgcggcactggggatcagcgggttggtcaaggagcttcctcaagagcagtggttgctgtgactccacccagtgagcagcctggctgccccaggcactttgggggctctgctagccctgaggctgaccctgctgcttcagaacatcccgccatctgcctgggttctgcctggaggagccttagacgactgtcttcagggttctgtggtacctgggttctgtctgagggcgccttagacggctgtcttgtgggttctgtggtacctgggttctttctgggggcgccttagacagctgtcttcagggttctgtggtgcctgggttctgtctgggcgccttagacggctgtcttgcgggttctgtggtgcctgggttctgtctgggcgccttagacagctgtcttcagggttctgtggtacctgggttctgtctgggcaccttagacgactgtcttcagggttctgtggtacctgggttctgtctgggcaccttagacggctgtcttgcgggttctgtggtacctgggttctgtctgggcgccttagacggctgtcttcagggttctgtggtacctgggttctgtctgggcaccttagacggctgtcttgcgggttctgtggtacctgggttctttctgggggcgccttagacagctgtcttcagggttctgtggtacctgagttctgtctgggcgccttagacggctgtcttgcgggttctgtggtgcgtgggttctgtctgggtgccttagacggccgtcttcagggttctgtggtacctgggatctgtctgggcgccttagacagctgtcttcagggttctgtggtacctgggttctgtctgggcgccttagacggctgtcttcagggttctgtggtacctgggttctgtctgggcaccttagacggctgtcttgcgggttctgtggtacctgggttctttctgggggcgccttagacagctgtcttcagggttctgtggtacctgggttctgtctgagcaccttagacagctgtcttcagggttctgtggtgcctgggttctgtctgggcgccttagacgactgtcttgcgggttctgtggtacctgggttctgtctgggcgccttagatggctgtcttcagggttctgtggtgcctgggttctctctgggcgccttagatggctgtcttgcgggttctgtggtacctgggttctgtctgggcaccttagacgactgtcttcagggttctgtggtacctgggttctgtctaggcaccttagacgactgtcttcagggttctgtggtgcctggtttctgtctgggcgccttagatgctgtcttcagggttctgtggtgcctgggttctgtctgagcgccttagacggttgtctggcgggttctgtggtacctgggttctgtctgggcaccttagacgactgtcttcagggttctgtggtacctcggttctgtctgggcaccttagacagctgtcttgcgggttctgtggtacctgggttctgtctgggcaccttagacggctgtcttcagggttctgtggtgcctgggttctgtctggacgccttagacggctgtcttgcgggttctgtggtacctgggttctgtctgggcgccttagacgactgtcttgcgggttctgtggtacctgggttctgtctgggcgccttagacgactgtcttgcgggttctgtggtacctgggttctgtctgggcgccttagacggctgtctcgcgggttctgtggtacctgggttctgtctgggcaccttagacgactgtcttcagggttctgtggtacctgggttctgtctgggtgccttagacggctgtcttgcgggttctgtggtacctgggttctgtctgggcaccttagacgactgtcttgggggttctgtggtacctgggttctgtctgggcaccttagacagctgtcttcagggttctgtggcaactgggttctgtctgggcgccttaggcggctgtcttcagggttctgtggtacctgggttctgtctgggcgccttagacggctgtcttgcgggttctgtggtacctgggttctgtctgggcaccttagacggctgtcttcagggatctgtggtacctgggttctgtctgggcgccttagacggctgtcttgcgggttctgtggtgcctgggttctgtctgggcgccttagacggctgtcttgcgggttctgtggtgcctgggttctgtctgggcaccttagacgactgtcttcagggttctgtggtacctgggttctgtctgggggccttagatggctgtcttcagggttctgtggtacctgggttctgcctggaggagccttagacgactgtcttcagggttctgtggtacctgggttctgtctgggcgccatagacggctgtcttcagggttctgtgatacctgggttctttctgggggcgccttagactgctgtcttcagggttctgtggtgcctgggttctgtctgggcaccttagatagctgtcttgcgggttctgtggtgcctgggttctgtctgggcgccttagacggctgtcttgcgggttctgtggtacctggattctttctgggggcgccttagacagctgtcttcagggttctgtggtgcctgggttctgtctgggtgccttagacggctggcttcagggttctgtggtacctgggttctgtctgggcgccttagacggctgtcttcagggttctgtggtgcctgggttctgtctgggggccttagacggctatcttgcggtttctgtggtgcctgggttctgtctgggcaccttagacggctgtcttcagggttctgtggtacctgggttctgtctgggcaccttagacagctgtcttcagggttctgtggtgcctgggttctgtctgggcaccttagacagctgtcttgcgggttctgtggtgcctgggttctgtctgggcgccttagactgctgtcttcagggttctgtggtgcctgggttctgtctgggcacctgagacggctgtcttgcgggttctgtggtgcctaggttctgtctgggggcgccttagatggctgtcttgcctgcgtctgtggtgctgggagattcaccctgagggcttgaggctttatgggggtagagctcacagtgggtggagtaaaaagtgaagtcatgaaaaatagtccagcagtttctaggaaggtaaaaataaacaggctggtatgtttattttggggggatgagtttatttaaagtggcttaaacacatctgcgatgaaccatgcagtgaggtgtttatgattattaagagaaacttttaagcgattaactaaaatattctcagtagttttagtaattttatactgtcgatgtttttgcttatgtaaagttgtttgatcagagaatgtggtctctaccatagcagagaaacaaaccaactttaatagattcccaattgtacacaacttaggcctttaaaaatacagtgccaaaggtttcagctacggtcgctttcaggggttaaaaaataaaaaaggaaagaaggaaaaaaaccaactcctagcaagttaggtgtcctggttggatgaatgtctcacggccagtttgcttcccacactgcactagctcctccttgggggaaaaaaaactagccccattcgagtctgatattttttagggccccagtgagactgccgatgacgctctcccgccacctgccctgtcaccgtggggcctcccacggtgtcccaggccccagcagcctcgcgcccggttcccactgctgtgttagggaagcgcccgctgttggaaatgtaattcggaacgttcaacccgtgactctccctaagtctttaatctgcggtgtcgtgaggtcgcagttgtcctggagacacgctgacgagccccccagccgtcgcggtggagcagctgctgggacgatgaggcagcccctcctcccagtgcctccgccgcgtaatgagaccacttgtcaaaacagagagagacacccattttcaaggcctaaaaaattgatttttatggctcttcttgtaattctctttttgaattaggcacatgatattgatgtgggcctacgttttaatcataatagctactgacaaggtaattaattttagaacaactgtttttttttctcctgctccaaatggcactatattgaaattgaaagtgagctctgggagggcagcggggctggcactcaggtgattgcctcggccgtgacagccccttcgtcttgcggccgccgtgcaccctttagaggcagctgctgttattaatgggctcaagctgttctgtcagcagagcagggcgaggaagtgtgatccagtttagggtttcatgatgatcctgcaggattccagacaggacgatgacgcggcgtctccagggcgttgcaggcccacctggtgcgtcgcctggcggctttctcgggaagaaggagcagccaggcctgggcagggcctcctgtgaggcggcaccccagagtattgagagaggaaactcggtcagtggagtgagggccagccgggaggccgcatttcctctctctccgcactggggaactcattagagtttgttccgtcagggttctgctgtttgtttagccaactgacggccgcgtctgttcctgcgacaccgcacacagatgcttggccatgtggggattggccgtgtggggattggccatgtggggattggccgtgtggggattggccgtgtggggattggccatgtggggattggccatgtggggattggccgtgtggggattggccgtgtggggattggccatgtggggattggccgtgtggggattggttttgtggggattggccatgtggggattggctgtgtggggattggccgtgtggggattggccatgtggggatggctttggtatcttgtggtctcgcctacacctgggcttggctggctgcatcctgcccgctggccggcgggcgttgccgccctccctcgggagcctctgtgccccgggctgccgctctcctggggtctcggagcacagggccctctgtcttcctccatgcaccctccgagctttctgtgctcacgggacacagcaagcgcttccctttctcctgggcagagcttggggctcgtttaagcaaatcacactagaatagatcaaacttgttacaactgagatttaacctaaagtggaaggaattccaattaaaaaggtaaacaagactttcgtgggctttgccaagccaaactatagcaattaacaggcaagaggagcacgaaatagctgggaccatttttgaaagaactgtcaacaagaaggacttccctataaaaagttgtactaattaaaagcatgcaggaattgattttttaaaagatctgcagaaaagaatagattgtctcaaaaaaacccgtgccgctgggaatgttgtgttgagatacagacttggtgggaagatgggacacgttgaataaatggtgccgatcaattgaccgtccgcttgggaaatcgatgaacttagatccctgctctacaccttaattccggatggattaaaggataacccttaaaactctaccataaagatgaaggtgggggctccatgcccgcgtggggactggggcaggtgtctcagccacaggggaaactgatacatgtgactatatggaaattaaaacttttgcctgacagaagccaccacaggcaaaacggaaaggccagccccaggccagcaggagcacgtgttcaccacagacgggggttactcaatctccagaactcacaaggaggccccaggccagcaggagcacacaccatattcaccgcagatgggggttactcattctccagaactcacagggaggccccaggacgacaggagcacacgccatattcaccgcagatgggggttactcactctccataactcacagggaggccccaggatgacaggtgcacatgccatattcaccacagacgggggtcactctccagaactcacggggggccccaggctagcaggagcacatgccatattcaccacagacaggggttactcactctccagaactcacggggaggccccaggatgacaggagcacacgccgtattcaccacagacggggatcactctccagaactcacggggagaccccaggacgacaggagcacacgccatattcaccacagacgggggtcactctccagaactcacggggggccccaggccagcaggagcacacgccatattcaccgcagatgggggttactctccagaactcacagggaggcccctggaatcaaagagaaaaggccaggaaccaaagagaacagcaggctgtgaacaggtgaaatcgggagaaaatgcaaattttgatatgtagatttaaaaatattgagggtgtgcaagttaagatggaaatgaactcctacgctccatagccaaagtgaaatacagtggtgatggttccacccgcactcagtcatgaaagtgtgacctgcacggatgctccgtcctccctcgctctggtctaaaggccctggacagtgcagagcgggtccacagccattggtggccccggctggtgcctcacggccacttggctctccaacccgagggtggaggtgtcagcggtggcggcggggcaacgcagaacaagaccacataagaactgggaagcgggagaccatctgctcacttggggattcttctacttctcaagcgaatggatcaagctggaaaaggctgagttagtgattggttgggccccctgcctcccggcctcatcccactgggccctaccgtgcccctcatgcccctgtcaccagctccaggagggcacagtgctcccagcagtgacctgcccgggctggcactccctgcctgtggacagctgtgcacacctgcagttaacctgattggaagctctcacttttgcctggctaataacctgagtttattatctccaaatgcagcgtagttggatgggcagcctctgtgctgcctgcccctgccctggcagccccacctggctctgggctgtgaaattaggaaatttggcaaccagagtatttcctttttttgtctacagatcacatgtttctgttccactgatggttttggtggccaatgccacgttgcaagggttctcgtgttgctttcacaccagaagggttgagtgccttgccctcctcaaaagcaagcagttcacggcgttactgactggagccgctgaggggagatttggggtttgagtgagttggcggtttctgagatctttttacaggcttatatctgtaagggaagccgcagtggaaaaacctttaggaaactgattgtgattgattgaaaatatgaggaagaatttttcttgagtacagctgtacctggctaaaaacatacacacacgtatgcagccactgttaccctctcactttgaaacgtccgagtggagatcatatgtaaaccttcaaaacaggtctgaggggacatccctgtctgggaggagagagcgggggctccggttcctgccggttcacctgcacgcgcctccccgtccatctccctcccgctgtcggtccctcctcccgtctgtctccctcccgcctttcctgagctctgcggtggattatttggtttgtggtggattattcaggcatccttgtccggccctttcccgttctcggggcagccgtggttttccatgcgtgaggctctcacgctgccctggcccagtgggtgaggaggcagctgagactctgcctttcctcttcctccatgtcgctggcaacagatgcgtgtccgtgttgccaagggctgagcactgctcagtggacctctattgggggtggtctcagagctgaattttgggtgtgcaaagaggcaaccactgaggttcccctgcagcaggtgacagaacagagagtgtgcggatggggagcgtggaggagcaccggggccgggcatgagggctggccggcttcagcgccctcggtaacaagtcctctttttctttccagaatcattgatcagcgattcgagaaggtttcctactttgtatttggtgatttcaacttccggctggattccaagtccgtcgtggaggtaggcgctggcttccctcccgccctggtctcatgccttgctctgtgttgaggaaaacagtggaaggagcgtggccccttactggcactttcaatgccatccgcctcccgggatgcactttttaaggcaaaacctttcaatgaagaagcatgttttgctgtcggcagagggatccgtgttggaatccggggtgcgcgggccctcaaggttgccccggatggcgggtgacagtgctgtggggctttgccctgtggcttccgccgtcggcacacaaggagctgctggagtgccgtcacagcgccaccccctcgatgcccacagagctgcagcctctgcagagtgtcagctccttcacactgtccaacttgatctcagcgattttttgtcataacacgtagaaactgtcagagcccgttttaaacattgtgcttttctgtctgcaaagtcattattccgtgagttaacgagtcgtcacccccgcctgggaactcaggggtcccgggtgctcctgggtgtgggaactcaggggtccagggtgctcctgggtgtgctttcgggctggccggggaccagcagcttgggcgccgaggtgccaccgacaggaagtgggcctctaggctcagtgcaagggccgatgtttctctgtggtccagtccacgctggctgtgggtcctccctcccagttttcatgacttgggattccacttcccgggcagctgtgaagaggggggtgtgggaaatggtggagcacctgttgcccacccgccctggccctgctgccctcaccctcagcctccctggtggcccctccaggtgctgggcatgagctgacagcccacagcggggccacagtaagttggatggggccacggtgagtcagatggggacacggtaagtcggatggggacacggtgagtcagatggggacatggtgagttggatggggacacagtgagttggatgggaacacggtgagtcgaacggggacatggcggtccccgagactgttatcttcccattttagtctccagttccaaacacccacacgtattcatcttccaacggtggcaggacattgtttctgaaagacagactgagctggctttgatcatcctgggtctcttgtggttggcagaaatgagtgcccctaaaaccctctgttgggttgagctggcagcaccttgtcacaaggccccaccgcatgcctgtgtatcaacatttggccgtgctggtggcattgcctaaacgttcagtggctcctggtcgaggcatcccttcatctggctgtggaggaggaaggcagggcctctgcgtgtggtgggctgaggagcacatggagtttttaaagcacacatcccccagcaggggccccgaagtcctttccatcccgctgctgtgcttcctttctcctcgtagaggctgtcaaatggatcggtctctggcctgccatcccacaggctcggtgagggctcgagggcaggggctgtgcccatccttgctagaatccatgtccccgcgtccgaggctgtgcgggacccgggagcaaggcctgggggccacagaggcggggccctgtcataggctcctcctccacccccgccaagccacagggggctggaagcggcatttccggcaggtctggaacatctctgagtgagctcatttctaacctgttactcgagagccagtgagtccacagtgcacataagtacttcccgctctgactgggaggggccaggatgaaagtcaagaagaacccgcgaaagaccaaagccgatcaatcccgggcgcccagcaattggggaaaggtcagggagcttggaaagggccttttccttctggtagagcaaatgtcacagtaaagggcagctggtcctggccgggtcagagccgtggtgaggcacgcactggagcagccgcgggagcctccctggtgaagggagccagctgctgagcccggtggccgggccgtgtgaccacaaggcgtcgggggcagtgggaagcctgggctccggtgcctgtggggcttgtgtggccgctctggtcttggcaggcgtgggggtcctggacgctgggtcccgtggggcttgtgtggccgctgtggtctcagcaggcgtggggggcctggactccagggcctgtggggcttgcgtggccgctgtggtctcagcaggcgtggggggcctggacgctgggtcctgtggggcgttgggcaactcctatgaaggactgcaaggctttcctttttctgctgagcagaaaaggaagaaagcacctcaccggggtttgcctgtgggtgtggccgtaagaggaggcatggcgggagaacagtgcaggggcctcgggagccggcctgagtctgccacatcttctcctgcatcacctggcctgctcccctggcctccctaagtgccttcacacacagccctcaaccctcatgggtcactgtcagcagtgttttttgatcaccaagatcagtcctatttcttaaagagttcctctcacacaggcagtcgcagcacggcagctcctgcccaggtctagatggccctggtgccctggaccccgccagggagggtgggtgcagagcaggaactgcctcccgggcctcagtgggctctccggaccttccagtttcaggtctgggacctgcctgagttttacccaggaagaagcaagaccatgctcgcccccacctgtaccccgtcctccgtgttcgtgttaggctgtcgctaaaggagccctcgtcccagccctctgcgctgctgaaggggtccacgcagagggccagtgctggggagggcactggcctgaagccagagttcgaagattcccatcaccaataaaccagtgggatcttccacggcagccttcatgcttaactttaaacatcaaactacagaggacgggaattctaatggctgtgcttaaggggctgtttactttgtgaactggtgataaacagttctccagaaactgccactttctcctgagagtcagtaaagagcttcagcaacctccaggcagctgctcgagcggctggtggagcactccagggcgagtgagcacctgtgtctgagagccgcccacaccaccataagcctcaccagctcccgtccttcaggaattgagtcgtcactgttttttatcactttcccatccacagtaattggaacagacatggagttacttgaaatgctgtttttcctctcagttcccccacagtagctggttttaaatggagtccagcagcctgggtccacctgccctgtcctcagcccctgcggggccctccccaccacctcctggtcttccctcagcccctctgccctggaccggccaggcccctttctgggctccacggggtgcatcattgccacccatctgcctccgcccccatcacgctggtgtcctgcttgccggggccacgtgggcgagtcgggtgacagacccagtgcagccgggtgggctggtggacgtgctggccggggctgcgtgggcagcgcgggagggggcgccatctgctgcaggacagttcacgtctgtccctcacgccctgtctgcaggctcctcggccgctctgcagccccacccactcagctctgtggagaggtgtcctgggtgtaggaagagcagctcctgcgtgcagcttgttaagacagcgggtgtggggcttgcctggccatcgaagcgtcagaggtgactataagtcaggaagggaaagaaaactgcggtcttcctggaacctcctctgcatgccccaagtggatttctcaaaggaacagtaagcaggaacgtggcagagctcctgcgggcctggctgacccaggtggcgtcctgaagtcccagccgcgttggcgtgtcctgctgtgagcctgaccgcaagctgcctcccctctgcccctgcagcggctgccaggacatgaggctaacaagcaccgagggcagcccaggaacccgatttttcacttcatttcattttaattcagatctgataattcagatctgatagagccgcgtggctattccatgggacagtacagaccaggtgactttcaaccagtgcaggggctaccacgggggaggaacattcccgtggacttgctgtccagccagcttgggctcagctgctccccagtgcatccctgttctcggaaccacagccctgaggtgggccctgggtggggtctccacgctgcctggcagacgtggcggtcattcacatgggatggcgtggtcagccctgcacaatcccagggaagagtcaggcctgggttccccccggtgagaggtcagagaacagagaaggcggccctggaggtgaccgcacccctcccgcatatcaggcacccctcctgcgtatcaggtgtccctcctgcgcatcaggcgccccctcccacttaccaggcatccctgggagtgactgcgtgcctcctgcatatcagatgcccctgggagtcactgcgtccctgccctgtatcagacgcccctggaagtgactgcgtccctcctgcgtatcagacgcccctgggagtgaccgcgtccctgccccatatcaggcggccctgggagtgaccgcatccctcctgcgtatcagacgaccctgggagtgaccgcacccctgcctcgtatcagacgcaggtgttttcagcagcaggttttcttcgctggtgccgtttgttggtgtcagacatgaggaggggaccaaggaagggcacgcaggaggtggtggctgagcctccgttgcatctgctgggagtgggggctctccagccccgcgatcagcttgggagggagctggtctctggtgagggtttcccccagtgagggtttcctccagtgcgggtttcctccagtgcagaactcagtgttcacacgaatcggcagaaggaaagccgcatgtgctctgtggttatcaccgaggcatgcccagggcgttcgtgggaaatccaggttctgtctgcaaaggtcccttctaaatggcaccagaattggacaccatgtcttcaacagacgtagatgccacccaggggagcccctgtctaaatggcaccagaattggacaccatgtccccaacagacgtagatgccacccaggggagcccccggcaccccaggcagtggcaatgcagattcctgggagcagggaggcctccacccaccacggctcattcacacgcccggccaccctggtctctgggctctaggatgctgcccgcgacagcagctgcccatgcagttaccaggccctggcttataatgccctcatgctggacagacgtgggtcttactgttctgcgctgtttgtctgccatttgcaaaggaatgggaagaaaaatgaatagttttaaactggattgtttactcagcaagtgtctaagatccttgcattagtgtttggagggttttcctgcccacgtggctctttaagactgtggatacatagctgttcatttgacaagtctttcgttacattttgcacacagtttactatgtaagtaaagcgagcctagtggaaaatagggaaaatgatgtgtagtgtagagttcttgtaggactgttcagtcaagggagggccacacctctggaataaggaccgcttttccctcctggcatcatcaacacagtcgtcagctgtgtgtcaaattccacagctcactgaagctaagtgcttggtgcagggactggcccgaagctgagcacctggatcccatggccgcagggatttcctgagggctgggggccgtgaggagtcacaggaccctggaaccgaccacggggaggaccctgaggcccagggcaggggcggtatccccagggtcacctgcggcccctcagtgctgcgtggcacctccacgtggccatgtcgcttcctgtgggccgcagacacgtgcaggctctccggagggtcacggcctgtcttctgtttgctcatctgttgacgtggaatgtgcgtgccaggtggatccctcccgcgcagagtctcctgtctccgtgtggggagattcctgcggcagtggctcagaggaccacaggctgggtggcttacacagcagaagtttattctctcacagtcctggaacctggacatccaaaatcaaggtgtcctagcgccacgctgctcctggaggctccaggggggacccctccttgcctcacccagccacaggtggcccagatggccctggctcatggccgcatcacctccgtctgcgcctccatcctcatgtggccttttcttgcaaggacatgagtccatggacttagggcccaccccacccaggatgtctcatcccgagatcttaactagttacacctgcaaggccccatttccaaacaaggccccaattctgaggctctgggtgaacatgaatctgggggcacaccgtacagcccaggacagcaggcagcgccggagtgactgtctcctgccacgtggtccactgaacactagcacagaaaacgtttctttgaaagccctacctaaaaataaatctcactgaaaaatgaccagatttatttgttggtggtgattaatttcagctgcattaattaaggtgccaattaggtagattattgaattttaaaataccatccaagcccctcttatggaaaatcaaaatctgctagttggcatggcatggtttttaaaaaaggtttctgactgtaaaacatttcgtagaaattttgtggaaaccaaagaaaattctgcacgattttcttttgaggctgacttggaccaaggaattgagggcaggtgtttggggacccctcataccggcaccagatcaggctgtgctgaacgctgatgccggcctccctctgcgtgtgaacggggtgatattggcctccctccgtgtgtgaacaagctgatgccggcctctgcacctgaacaggctgatttcagcctctgcgcgtgaacaagcttgatctccacttggccctgtggcacgtccctgttgcagtttccttccacatgaagctttttgatgaagaactgacaggagtgcctgggagctccttagcacacacatcctgggctctcccggacctgcgagtctcctgggagctcctcagcacacagatcctgtgagtcaggcccagggcccaggcagcgtctcctcacgtctgcctggcaccaggctcagtgcagctggtgaaccggggctgcgcaggtacctctggtcgggattcaggctcggtccacgccacccgcagtgccatgcccgtgcagcctccagggatgcatcgctgcaggcgcacctgagatgccagctatgctctcgtgtgacgcagaagcatcacctctgggctggactgtcatggcaggaccacacccggcagtggccaccgtcactgcccactgatctcggtgctccctgaggctgtgcgcttctccttcctcagatgaaaagtggacgaggaatccctgtggtccagggcctcattttcctcgtacagctttcatttttcgcactgtggtccagcctccagtgtctttgcagctgggaagtatcaggaggaattggagcgtgcagcagctcagcatggcctgggcagagtgcggattcgcagcgtttccagctgctcagctgagcaggttctttttcacacaggcctgtggatggctgaggttctgggtgggtgagtgtcccactgttggctgccttgtgggcagccccattggtccagcaagtgtgtcctgtgcgtttgctatgtgggcccagcaccaggatgagggtaccgcctgccctcaagaccatggccttgggcaccaggagtgcccggggcagtgggtttgcctggcggctgcctcccccacctctcttcagttctccccctgcctgggagtgatttcccaccgaagtgtctgtgcacatctctctgccttcctagaagcatctgcattttaaaggagagggagtgtcggagtcaaaggccagcaggagtgtcttgcagggtcctcggatggagctagcttcggggctgaatggagtgggttcagtccttgagatgggctctgcccttcctcttggcagagcagctgtgtggtgagcccctcagagaaggccacacagaggcgggcagggcctcccagagggcttagaagtgttgtctgctccccagccgtgtggagcaggtgcatctcgagcacctgtccttccttcccctgagcctttctgtcaaacagcagcatgggttagagtgagaccctgtgggctccatgcaggctagtcctccccaccctctgcaaccccccgtgtggagataccacattcagaggccacgttggtacctgcagtctggctccttgggagccggaaaaggccacacccagcctccaccctgggtttgtggggagatctgtgccctcctctggggtggttttcagattgcccaggatcagagtaagcatacgcggttctgaaggtttgtggacagtgacacagtcgtgcatagccagagcgcatcaggaagccgtgtttatcacagtgcagagcgtcttgcctgatggagtgttctgggaatgctggaggctgggggcaggcggtgcccggtggcacgggcgccctggggcggtgttggtacgaagggacacgtgagtgtaatggtctttcagaaaccacggctggcctggctttggtttcactgctgagctcccacccacagcagcccatccttgccccctcggtcctggactggtggggtcatcctcttgctctcactgccgaccgcgttcctctgcctgctcacagcgcctccttggtgccctcagtggcaggcttgctggaaagactcatcagaggttaattaaatccatctccacagcaatgggaggccgggcagagccgggctggcagcagcagattaaatacagggttgtttgccctgccgagagttcaggggcagggtgtctgggaggacgaccagcttggtggccctggaggctctcagaccccgaggtggagacctgcttgtgatttttggtggcaggagggttgtagggattggatccgggagtcctgccctgccccacaccagtctgtgaaagaggctctgtgtgcaaagcgaagagactgtcccccaggaatgcgcagcctcctgtgtttcagatgcagattaatgcagacttgctcacagagcagaactgaaaagatactggagtcagatctggcaccacggaagctgtaattacaacccaccacatgaaacacgccagtcgtgtgccatctgagagggccgtgcgtcctcacacgagtcagtgatgcagcctgcggctccagctgctgctgggatgttcagagggtgtgtttcctgcctcgcgcggtggcaactggcagctggggcgctcagctggccgtggtgacaaagagtgacagcagtgccaggcgcacccgtctccacgcggcccgaccgcacaccacacctgccgtccatcacgtctgacagtgacggtgatggatgcgtctttggaggctggtggccatttttaacaaccagttaccaatcactgacaggtacatgctcaggtgccagctgggcctgcaggggaatggccgttgggggcgttgacatccagaaggagccgtcctcggagaggggctgacgtcgcaaggagacaccccgagagccgggcttcccaaaacacggctctcaatgggcaccagggaggataccaccactgcccgcgaggcaggatcccagcacctgcctcaaaggctgtgtctgccgttcagtggagaccatggccggcaagagcagccaaggccaggctgcccagcagcataagcccaggcccagacctcagacattcctggcgcccaggcgtccttccttctagtgtgcactgcgtcctgggaggaggggcagctgtcagccagtaggtaacatcgcacctggtcatggccccccacagccccacagactcctgagacccgctggctgctccggccccagccaggctccaggtgaagttgtgacctcatctggttaccggctgccttgttgagcccctctgccccctgatccctcagccgtgggcacagtgggcgccgtgaggctgtgggcaggagaggccaggtccctgtgtccactggcagctcccatcaggcgtgacagacagggatgactgtgcagctgtcgctagccctgtgtatgggcaggcctgagctcctaaaaactgagagcatggcggccgactcctcagtctgacgatgttcctgcatcggctgcagtcggcgcagccctccaaagccctgcaccattcaggatttggcccatcccacagccatgagcggactcgatgtggcaacatgggcacagtgtgtgtccagagggcaggtggcagggacggtcccttctaactcccacagaccccagaaagcctggctcagagtgacactcctgtagagcctcagcaccgtctccagagcagcatggatggaaagatgcacacagccccatcctcctgccgccgtgggttaatgttagcgcagccccgtcctctgctgccgtgggttaatgttagcgcagccctgtcctcctactgccgtggactaatgttagtcatcgtcaagttctcatcttacctggggacccagtgtgtagacagaccttgtgcagacccagtggggcactgccctcgccacgtgcccagcgtgctctggatggtgaggcaggccagtggcagcctctctgccctccctgccagctcctcagccacagggacgcccttccctgagggtggaggtcagggcggtgagggcctgcagagggcacgtgagctaagccgtgctgctcggttcactcacttgttattctagagtcttggtgtaaaatagcaatggcaacaacagaagcactgatttaaatcattaaatttattttttaatttttctgtttagaaagagattttatttggtctgtttctatatagggcctatgacatcaactgaaaataaaataaaatgttatacttaattatagtgatgacattaggcttcgtatttaggggattttttctaggaagttcactttgcaaatattacccaatattttcaactggtatattgatgccaagaatcttctcattttatagaaaaagaagacaaaaaacaaaagacgcttggcattttctctggtctatgctgggactctgttcgaggaactgttttttggactcactcctaaatgattcataatccgtagtgtgttcactaatctttaatgcacttttctatattttttatgagctcatactttatttaaaaattcctctgactgcccttggtttaaaagaaacccatgggaaaggtagggcacagagcaggtctctcgtgccaaggcagggggttgctggagaccccggacactgtgtagcctcattcgtcctcctccttcacacatcgcacccggctcccttactagcaatcagtggctctgacaagcatacaggggaccctgggacgagggctgagctctgtgtcctgcgtccccctccctttgccacatccccctccccacgtccagccgtgccagtggaaggctggggatgtccgggaggagccacccagaggcacagcaggtgcttctgccgccgggcagggccagtcctgtggagccacccctgggcccagcagagggtgcccggcatggtgctagacacagcctgagaaagagacccgccgccttcttcccagaaagtctgttgagctctagctggcgtgagagcaagtgggcgccactcccattccatgcgcgctgtgtccgagcctgccaggctgctggagtccgggagcaaccttgggagaggacatgaaagagtctttatagcatgttgttgttctgggtggccgttgacaatgaacacagagaggagggaggccactcggatgctgacgccaacatctccccatgacagtgcctttcactggctgcatttctgcaccccataagcttgggatgcagggccttgtgcctggccctggggctcgcggtgaggtctgtgctccagggcctcacggtgggcacttttgtcaagtgatagggtcccccttcgggtctagggttcaccaggaagaccgttgagaagatggagctaaccagaagggctttctcttgggaagtcaaagtaagggaggccggcgaagtgtctgagggcccgccccgcagccctcccagcaaaccctgccccacagccctcccagcaagccaggctctcagctcctcagattccatctgggatggtcattctctgtgttcggtgcccactctggtcctaaaaagctaggaaattggcaccatggcacactttacagaacgccgttcctggcttcactgggggctgagcatgggcacgtgcccccgaggaagggtccttggtgcctgccaccctggcctcccggcctcaccacacatttcccacgccaagtctggccggggtccctctgccaagctcaggcccagcccctggagaagcctgtgtgaggcccgtggtgggggcgtgccgacagaaggcagcgggaaggtggtttactcatccttaccctgcacctgctacacccccagcctgtcgagcctggagggcacagctgttgccctgtgggcctgtgtgctaataggtcctagtagccaccagcatacttgggggtggtggctatagtgccagccccctgatctcagccactcccagagggggacgcagcgctctctggcctttgctgccctccttgccctgggagccgggtgagtcgcactctcgcttccaagaagctgctcacgtgtgtgccataggaaaggagtctggagcctccgggagttaatttgagatgacgtgtgctgtttccatcaaagatcgtcaggcttgggtgtagtgcttgtgaggccctcgccatgccccctgccaggacccaggggcctcagcagaggcgtcttctagggtctgaggaccttgtctccaccctgtgtgtccgttggcccgtgtatgtttgatgagcactgacgttcgggggtgccgcctgtgtccaccccaacgggatgccagaggactccagaggtgaggcttccttggcactttccgtggcctccccaggacgaagcaggttttaaagacaggacttgcacgttggggccgcctgtgaagcgattggctggttgtcctcctttcccactccacggcaatgtctaagatctgcaccagcgtccataatgtgagttaccaaggaatggctaaccccacgggaccagtaatgcttctccaggtggatatccagaggactggggcgtttgtcagaacttagcgtttgaattatctctgcctgtttgcagtgacctaatagtaaacctggaactttgcgtgctggtttgtcagtaggctccatagttttctgaactgtaacggaattaccccctcgattctgagcagtggtccggaccctcaggcacgttcagggcaggagcggtgggagcctcttagtgaattctcctttcacagcgaaagcattacgttggtgtagtggcgcggcatccgggagcacagatttatattcacgttcaccatgactagaagaattatttgtagcatagaaaatgtttatcccctggagtcagttctgttttctagagtcattcaaaaactgaagccgtaatgatttcctattaactcgttttaaggaaaacccatgtaaagtactcgggccttttgttgtgaaccatattttagaaatccttttctacttcctcctttcatccctgctgctagagagtggctacgtggaacttctgtgtataacccttctttatttctagacatgtttctggttaaaatttaaccaaaaactacaggataataaagaaggatgggacttggcaagtttcttcctgccgtgcctttggtcagttttcccagtgagagccactcgcagggtccacatcgttcacccccagcattcaccacccaagggtcaggcttctctgacgtcacagtgatttcctggaggaggaggagagaaaccctaagagttcacctacaaagaaaggggaaggccagggacagtgcctcacacctgccttccaagcactgtgggaggctgaggcaggaggatcattgagcccaggaattcaagaccagcctgggcaacatagggagtccccgtctctacagaaaataagaaagtaaaattagccaggcattgtggggcacgcctgtagtcccagatactcaggaggttgaggcgggaggattgcttgagcccggaggtcgaggctgcagtgagccagccatgatcacatcactgcactccatcctggccaacagaggaggaccctgtctcaaaaacctaaaaatagagataaataaaaaaagggacaccgcctgtcttgggttgacagcatgagatgggctggccagatctccgcagcctaacagtgggcagctccgtgtctgtgggtcacaagtggttggtctcagtctggttcctgctggacaaacactgcaggttcacaccacgggaacttctcggcatctgtgccaggaaagttagagcttcctcatccttggaaccccagcctgcattgcacccagaagaggatacccccgaatgaagctggaggctgctgtccactccacagaaccctggccctcgtcacacccagaagaggatgccccagaatgaaggtggaggctgctgtccactctgcagaaccccggccctcgtcacacccagaacaggataccccggaatgaaggtggacgttggtatccgcgtccgcttgcttttctcaatagccaatgtaaactgaggtggacgtcagtatctgtgtccgcttgctttactcaatagccgacgtaaactgaggtggacgtcagtgtccgcgtccgcttgctttactcaatagccgacgtaaactgaggtggacgttggcgtccgcgtctgcttgctttactccatagctgatataaactgcagctggctgcagcacccacgaatggcttctttccgagatgtggccgtcctctgcagaaaggatgcatacttacagagaaggcgctcactcctgagggagagcaaaggccaggtcagagctgtgtgggacaggaggtgtcctcacgagtctcctggagaggagcctgctcccagaggccaatcagcaccgggtcctacagccctgaggggcggttgctctgtgaacttactaccagatagagctcatgcgccatgagccacgctgcatcagatagggccgaggagagatggcgaagtgctcctcataggagcctgttctgttcctgatggatgaatccaggtgagtcccgtgtgaacacagagctcagagtcccaccccaagaacacactctgtgttccccttgatgcagccccgacctgggccagcacgcgcagccccgccctgcaggaggaagccttcgcacagtggcaccagctctcagaggcgacaccacgccttgtcctgagcagagaggggcgctcccagctttgtcctgagcagagagggtgcccaccgcctgtggaagtcagccccaggtctgagcgagagggccacccccagcttcactcgctggccgttggtctcaggtcctgcctgccatccccaggtggaaggcggttgtatctagtccggcgcccagtcaggctgtgtccagccagagcttcccctgcggggttttgctgttttagtcattgctgttcttcagggaagtcttggagacgggcacagctttccataaattacagccccgtgaaacaaaaagtgcctcccgatgagttcggaccgtgagggacacccagctccgatgcttccttcccggggtctggaatccctggtgaaccggggcccttggtagtcaagaaacctgtcattgaaattcatgatgccggtttggttctctttgccgagatttatcattgacaggcatcctgcgtcctttggccctttatttaaccgctgaaggcattgtttttaagaccatttcttttagaagagtttcttttcagatgttcctacgaacatctgtttgtggctgaaattcgacccagccggcctgcgcctgccccgcgccccctttgtccccggccattgtttctgatttcatgctatcagaggtctgcgtgtttttctgcatgaagttgtcagcaggataaaagctcaggagcagggtcacgttgagaggggagggcatgaaaaattggtaaaatgtgtcttcaaggccacccaccagtgctgcactcagccccagcagggactgggcccgggagtgagggcagcccacccaccagcgctgcactcagccccagcagggaccgggcccgggagtgagggcagcccacccaccagcgctgcactcagccccagcagggaccgggcccgggagtgagggcagcccacccaccagcgctgcactcagccccagcagggaccgggcccgggagtgagggcgagcccacccaccagcgctgcactcagccccagcagggaccaggcctgggagtgagggcgagccccttgcgtgaaccctggagggccggaccctaaccctggggctgtgggctctgcccctccctccattcattcatttgtcccgtgggtatcaattggatgtctgcaaagtgccagaggcagtttgcttccgaatcagcactttcttcaagactggactcactcctcgtcacgtgtggggaggaaacttctgaatcactgaagtcagtggctgagttcacaccaccccagccagcccacagcggtcacaccctagctaagcttgctgacgggcagcctcactggagcgcagacgttaccctcccaggaaacctgtgatgaggactggggtgcacacgtgtgctgaggacaccctccaaggccggccccggggctcagacaggcaggctggggccacatctgagcctcctggttttagtgcattcactctggcgcagacagaccatggctgagcgtgtggtcccgaattccatccttggaacagaggaagtttttgttatgagaaagaactccagccacagcggatttgcacctgcaggtctgtgtcttgcgacacttaagggccaggctggacgggcccccacagaggtggaggagtggccggctctggccaagctgccagacaccaccagggaaacaggtgcacccacagagcttctgtgcctgctgaggggctgggagtcgtagcctcaaggagcaggctcattttgttgctttctgctttaaggtggtttttcttctggttggatgagaaaagttagttgagccccccacggattgactcagcagctgagtatgtagaaactggcctggtcctggggccagcatgtgagccatcccccaccacccacaggcctcccaggaggccctgctcccgcagcagagcggccgctgtcaccgaggcaatggccagatcaggaattccaggacccccgggagggtgggacactgcggctccaccggtccctgtgtctatggaatcggtgtcagcggacatcccgttcatggtgggatatgcccgtaggtgtcgggcagatgggggagtttcaataccggctcctttagggggtctcagtttggaggaaaaaagccttatttccttgatgatggtttcattccttaagaacgcactagaatctgccccttagtagctgcctgtggtgtttctagattcgggggcaacgttggctttgtggttcgtttttattttatttaactgtgaacgcccttttactccctgcattgaggtgagacagaggacacggctctcaaggagaggaagaagttgttgggattcccaggcttcatgaggccgggctgtccctgagcctgaggcgacctgcagggctgactgatttctatccactgaggaaggttaggattcaacctcagcctcactttgtgcagccgccatgttagacatgccgccacagaccacggcaccgttgtccctcccgaaagtgctgtcctgggcccggcggtgcagcccctggcagcttgcgaggcccgggctgcccgcctctcccgtggcacaggcttggggacagggtgtgcccgagccagtggctggctcaggaggccacagaggtgcatttgcctctgctccaggcgagcttgggcggttctgggagggcctggggacacagggtgacgtggtgggagggcgctatggcctgtcagcctttgatcttggggcaggtggttctgcctgcctgccacagaggacggggtcctccatcccctcgcgagctcctggaggccacgatgctcctggggacacctcccctttgggaaggtgagggctggggctgtccctgttgccaggctctggccctaggaaggaggtttgtggccccagtgactaacggattcccttgtctgcctgggagtgtgttgaccaccagggagtaaccagggaactggactctccgtgtggcaggaggggcatctcccagccttcgagcctgattgcttttccagtgcctgagctgcacccctgggatcccagctttcccttcccgagtccgggcagcatctgtgctgggccctgctgggaccttcctcctcatgtgaggcatgtcacggctggcactggccccagcccgggcctcgggtgtggtgggcccacagtgtgtcagaccctgggtgtggtgggcctcgggcgtggtggcctcgggtgtggtggccctgggcatggtgggcttcaggcatggtggcctcgggtgtggtgggcccaggcgtggtgggcttcgggcgtggtgggcctcagctgtggtggccttgggtatggtgggcccgggcatggtgggcttctggcgtggtggcctcgggtgtggtggccctgggtatggtgggcctgggcatggtgggcccggccatggtggcctcgggtgtggtgggcccgggtgtggtggcccccgaggaggagtgtgtcctggagaacaggcgggtgcgtgagagctcccagctcagccacaagagcaacacatgctgcccacccagcctcgcctaccctgcctaccctgagacgccttggcaggacctagaagccaagcctggggtagggcctcggcgttgcctgcacgtgtgcccagatggcttcttcggagccctgagtgggcccccgaggctgtgtgtccacttggcccaggcagggcgctctggacacctggtgattccaggtagagagtggagcccaggcgcctgctggctgtgcgtgcggtgcctggaggctacagccagcgaggattcatttcagagagtacagaacaactttttgtttttataaaccagctcttgaaggttgcatttaaaaacttgggctgacagggtctgagaggatgtgtttgcctttagtagagttttggattttgtggcagagtgtccgggacagttgagggggtgatgggacagattcagctcccaacgtgagaccaactgcacaggtgcacattggggcgactctgcctgccatgcagctccgtgcacatccgaatgactgcgttatttccttgcacagaaaacagcctttctcctgggctgacacctgtgccctgggcctgtggacgccctgtccaggcagcatgcctccttggttatccaaacagtaagaagaaatgcaggaacttcgtgatccacacgcgtgtggatgaccctggcacacagcgttcccgttaaattctaagtgtggataagacggcacaccggaccactctttccagagcctctccttgcggctgctaataatgaaatacatcttagatggctttttaaacatagcatttagggtatttgtttctcctttcaaaagagaagaatcccttcccaaagtaggcgagccggaaaggcccagcctggccgctttccgcatgagtggccacgactttgctggattgaaaggcaaagggaacaggccagctttggccccttcagcctggcctgatcactcctttacagcctgtgaatgaggcagctctggggaggggtttggggtggccggccccttcctgggctctggggtccatcagatgtttgtcctttgggagcctgcctgaagtgctgagataaagcagtttttaaacagtttcccgcagatgccttttgggagacagagccatgaatttcctgagccgcgtcctgggatggctacaatggccgtctgcctgccaagccttctcccattcagggaaagcagcttaagccacttaagcccattagcatctggatggggccggacctccttgggacacaggggtgggcagggtggccccgctgtgtggctgtttgggtgcttgttctaatcctcacgctgtttgaaggctccagactgatttgtgacacatgagtccaaaagccactttggggggcttgaccccatcagccggtctgtgctcggaatgtcaatggcctgccctggagtgtgctttggggatagcgggtggccgcctcctggcccaggctgagacactgcacaccagccaccaggaggtagacgctgcatcttggcaagaggcgggtcgggctgccgaagggctccagagttcctctcagttcctgctgagcgcatgcccggaacctgcacaggaaggccgggcaccggcccaggggtgtcctcctgagccctgtctccgagccccggccagcgcccggggcaccgaggtgctcctcagcagcaccagctcccaagggccctttcagggagaaatttttaaagccaaagttacttttggtgcagtcatcattttataaaacaaaaatcatatattattttcttaaaaaaacagatttataggccaggtgcagctgctcacacatgtaatcctagcactttgggaggctgaaatgggacaatcgcttgagcccagaggttcacggccaacctgggcaacatcatgagaccctgtctctacaaaaatttagaaaattagctgggcatggtggtgcattacctacagtcccagctactcgaggggctgaggtgggagaatcacttgagcccaggaggtcaaggttaaaacgagccttgatcacgccactgcgctctggcctggatgacagatcaagaccctatctgcaaaaaaattttttttattaaaaacaagctggattgaggtataatttacacacaagctataatccaattctagactctctctccatataatccagttctagactatccctccagcccccgccccagtcagttccctcccggcccccgcagtctccttgctgcctctgtctctccgacttcgccatgtctgggtattttgtgtaaatggaatctacagtctgtggccttttgtgtaaggcagcagctgtgccctcctccacccacaccagcgatgcagaaacgccggtgcctctgcccgccatgagcacgggccctcgctgtccacacagagctttgatttctctcagatgtgggtctcacacttcccttgttcggtgaggttctaggcattcttgttttcatgacttctgccaagctcggagagctcagtgcccacaaggcccctgtgtcggggccaggggctccccatggccagtccacccaggtaggggtctccagctctcttacctttagggactgaccctcagtgaccattccctgcattgtactgaggttaagacgagaagaattttcaaaacaggcctcaatgtaatccttcgcggtgatctgtgccggctgtccgccagccaggaccgtgcctcctggagcagctcagccatgcagtgtgggagagagatcggcactcactcagcctccctctcctctgctgcccagatgactgccccttcccgtagctggtcaggccagtgagcatccacaggcaccagaggccgcaaccctgaccctgcagcactgctgccccagcccctctccttggtcctcctggtcggtgtgatcgctgggaccctggcgggagcctgagttgttcttgggtcctgtccacctgcctctgggcccctgcccaccccagcctgcgccccagggactggtttgagcctgttaacaccacaaagcaggcgtgtgacctcagccatccctcccacgtcagcttcacccagatgagcctgttgagacggttcccggtcaagccgcctgcagcccttgcccgttgtcacagtcgaacagctctcgagggagttcagggacgggagagagcgagcgggaggaggccggccatgtgcccccgcaggcaccctctttgctgttctcagtgctgctgtgccttccgagcctgctggtgtcgcactggcttttgccccaaagcagctctgtgggcggcagcagctccggggtgtcctcacggttgcagccacgctttgttggggagcagccagcctcaggcccttcgcacgtgtgagggtcggctgttgcgggagtggcccctgaccccaggtgcggaaatctgggtgtgacaccagctgctgtctggaaccagccatcctatcccactgactcggggtgtcgggtgacgctgccatgggcaggtgggcccccctgggacttatctccgttgctgtctttctgcagacgctctgcacaaaagccaccatgcagacggtccgggccgccgacaccaatgaagtggtgaagctcatatttcgtgagtcggacaacgaccggaaggtgagtggggcctgtgactgggcaggtgacgcacggggcctgcgcaggactctgcagcttccttcagagccgccctgcctgcccggttcggtgggggctaggggacacgcacaaggctgggggagctcaggtgctcatgggccactctgacttcacaggttatgctccagttagaaaagaaactcttcgactacttcaaccaggaggttttccgagacaacaacggcaccgcggtgagtttgtggtccagtgtggcagctcccccgtcctgggacatccacgcccccaggccttcccattacctctgcttacctgggaccaccctgccttgtccctgccacctccaggactcagttctgagccagtgcaagtcagactgctggggacacatattgggtgcgtccggcaccccgggccaggttgggtggaggctccgtatcactgtcctgtccacgggcagcatgacactcgacccatcagcttcagagatccccccgtgtgcgaggggagacgctggtgctgtggggtggggaggaaagccccttgtctcagagtgaaccggccgggcctcgggcctcactctgaagtgggagactgaagggagcaggttcctcacactcctgtcgctagacttgctgtgtgtgggtctgtgtgtgagcacgtgtgtgtgctctagtgcatgcgtgtgcacatgtgcacgtgagtgcgtatctgcctctgtggggtgggtgtgccgctgtatgtccatgagcacgtgtgtaaacaagtgcgtgtcaatgggaatgtgcggctcaggtcggtccacggagaggtggcccctgccagtgagagacagccccggctgctggacctgctgttggttttgaaatcgtgagtcttcccttcaagggatcagtgtaggcgagcgctgaggggcggcctacacactctctttacaatttttattttttattgtggtctacttttgtcccatttttaatgtatttacaaatgtttatcagcgcaaagaaccaggaaccacgcagcagctggctgggccccatatgcggcctcggccgatttctgtaaacacgcccactgtggcgattccaagccacacgtgatgccgtgtgcaacgagccagcatccaagatctggaaacctcggcatcagttcctagggcgctcccgagccagctatggttcccttggcgctgcgtcagggcaggtggcccctgtcctcaggaagctgtctggggagtggccgggggagaggtgagggagcacaggcgggtagacccaggacactgcagccgcgttcacatcctagcatcctgggccagccaggtgtctgtgtgtcagtttcccctcgtggggtttgggggcttatgggtgagtgcatgcaaagtgcttaggaagagctggggtctctcagtgccagacagaggggcacgcccagcccagcggacgctgccagccccgagtcccaggcccagaacctccactccaggatggcattcgctgcctccccaacggcccccagaccccacgctcctgtcttcttgggaagtcacttctgcctcctgcccctcatcaacccagagcccgaggctcccgtgacgcccacacctccgtggtgcctgggcctcctgtgcccgtccctgtcacctgctgcaggagcccatggtcctttcccccactggggtcgggtcaggccttggtgtcctgtccccacatggccccatcagcctgggcaagcctaaggtttcctccgcttctctccatccaggcaggctgggtttcctcctgcgccatgtgtgggaggcaccctcccctctccttctcaagcctccagggcctggtggggccgcctgtctgtggctcccgctgcccctctctggctctgcctgcgggactctgggctccaggatgcttccagctacaggacactcccgggtggcgcatcccggcctcgtcagtggggagcagggagagcctggggagcacagatgtctgggtggaggcaggtgcccaggaggtgtcttcgtggaggcaggtgcccaggaggtgtcttcatggaggcgagtgcccaggaggtgtctgggtggaggcaggtgcccaggaggtgtctgggtgcaggcaggtgcccaggaggtgtcttcgtggaggcgagtgcccaggaggtgtctggatggaggcaggtgcccaggaggtgtctgggtggaggcaggtgcccaggaagtgccttcgtggaggcgggtgcccaggaggtctctggatggaggcgggtgcccaggaggtgtctgggtggaggcgggtgcccaggaggcgtctgcgtgaaagggggtgcacaggacgtgtctgggtagaggcgggtgcccaggaggcgtctgggtagaggcaggtgcccaggaagcgtctgcgtgaaggggggtgcccaggaggcgtctgggtggaggcgggtgcccaggaggtgtctgggtggaggcgggtgcccaggaggtgtctgggtggaggcgggtgcccaggaggcgtctgggtggaggcaggtgcccaggagggagacagggctgccgtcgtttggaggaggtgctttcagggtccctagcagagctggctcctcagtgccaggggagcaaagtctccggggaccttgcacagggcatgaaaaagtggagggtcccttggaggaggatgccagggaagcccagggagatggaatgttttggaaggagctaggagacagggaagagggaggctccctcagccacaggtagggtggtggcaggggacagttcccagccggggctgcgtggagtggggtgcggcatggaggggcgtgtgatgtggagggggctgtggcgtggaggggggtgtggcatggagaggggtgcagagtggaaggggtgcagtgtggaggggcgtggcgtggaggaggtgtggcgtggaggggcgtggcgaggaggtgtggcgtggaggggagtggtgaggaggtgtggcatggaggggtgtggcatggagtggggtgtggcatggagtggggtgtggcatggagggacacggggcgtggaggggcacggggcgtggagggggtgcggcatggagggggtgcggcgtggaggcggtgcggcatggaggggtgtgtctagagcatctgggagcaattgtctttcatgtggatccaaagtcctccttttctctcagcattttgacacagagcacgcccctgctgtcggtagccaccataccgtacagtgtttcctacctttagaggaaaattaatctgaatatttgagagaacttttggatttggttctgaatgaaaacacgctgtggggttgaagccacgtgaggcacccggtgtgattgcggaggcctggtgcactgtgtcgatacgtcgggagtcccatgtggaaaggcggcctgagctcaggaggcgccttctgaggctgtttctcatgagaagagccgatgcctcggcgttcctgtcctgctactcagatcctctctgtttggggcctgggacgacggcaccttcgggaacgccccatgggttcctgctgacccgggtgccctcgcacttgcccgaggtgccggcatgccgagtcagttgtgcccagaaattggcagttgtccccatcgacggagggtcaaggtggtcggacggggagcctggggagataatcccatctccacggtccggttaaacacacagcaccgcagccatggagagcaaactctccgtccgcaggatggatgtgcctgcgccggtcgcagccccaagtccattgcatccttcatcaaccgccggtcttgtacccgtctgacagaaatttaattcaggctggctcctgaaaataattattgtattttaagagtagtaatcattggccgggacatgattgaatgtgtccatgcctattgactttttctatgatttatagctttgtttagtcgatattcccatcgaaattgtataattaattataagtgtagctgtcagggctgcaggatggagtgccctggtgaggatttggagagattaaattttcctcggctgtcccagggccgggcttgggagtttccgcagcaccggcctcttggagggaggtgttttctgtgtgtttagcaaccgctgtagccccaggtgcattgattttctgggcctctttcctttatcagcgccagtgtctctgcaggagtggcgtgagcggcggccgggacagctcctgacagatgggcaggatcagccgctgccttgtcattgtccacacggccctgcctgccttcactttgtaatcaagaagaatgtgggagaccatgcgaaattggtgatcatgtttgtgaaaaatctcagagagatacaaattatcaattcaacagcaacgtgcgcagtttctaatcagaaacctctcctgtctggtattttgttccagccgcagcaggggccctcacccacatcattccgggggcaacagcccccatgccagccatgcagggtgaggctccctccgacttctcagaaccagtggctgagcagggacatgccaggaccctcccgccacacaggatccccccgccacctggccgccatggtccctgcgcagccttgcgtttgtatcatggtcgtgtgtacctctgcctgccctgtaggtgggaagacccgtggggtaaagaccgcgtgtttggagtgtctggcacagtgccgacgtgggagcagcacggtgagcccgtgtccaatgaggatggaggcaggcccaggccaggacacctctgtcaggagacagcctcacgagtgagcgatggggattcccagccggactgccctggggttttctctcaggcaccaggctcagggctggtcagtgtgtgggggcgagcacctatgggcctggggcatcacagtggacagaggacagcctggggccctcacccctccacccctggctccagtaccgtttaagcagcttgaaggttcaagttcacttcaaaccacacacgaatttccttttatttttactttgcactgccaaaactgggggccttctaactcagaagacagggtgggaaagtggccttggtccactgagcagtcctgaaacaccaccacccaggcaggatgccggccgaggaatcccattcagtccccatgggaaggagggggcccccagccaccgaaaaccttgggcagccccagcctgctccttcttcctggagttttccagcttccccacaacttgccttggggttgttcctattggagtgtgtgtcagcgtgtgtgcgtggatatgtgtgtgagcaggcatatgcatgtgagcctgtaggagtatgcatgagtgtgcgtgcatatgcatgtgaatgggcaagtgtgtgtataagcaggcatgtgtgcggacgtgtgtgagcaggcatatgcatgtgagcctgtgtgagtatgcgtgtgtgtgatcgtatgcatgtgtgtgatcatatgcgtgtgtgtgatcatatgtgcatatgcatgtgagcaggcaagtgtgtgagctggcgtgtgagcaggtgtgtcagcatgtgtgagcaagcatatgcatatgagcgtgtgtgagcatgtgtgagagcaggcatatgcacatgagcgggtgtgtgcatgtgtgagcaggcgtgtacatgcatgagcaggtgtgagcaggtgtgtgcatgtgagccttcatgagcgtgtgtgtgagcgtgtatgcatatgcatttgagtgggcgagtgtgtgagctgtgtgagcgtgtgtgtgagcagacatgcatatgagtgggagtgtgcgtgagagcaggtgtgagcgagtgtgtgtgagcaggcatatgcatatgagtgggtgtgtgcatgagagcaggtgtgagcgagtgtgtgtgagcaggcatacgcatatgagtgggtgtgtgcatgagagcaggtgtgagcgagtgtgtgagcaggcatatgcatatgagtgggtgtgtgcatgagagcaggtgtgagcgagtgtgtgtgagcaggcatatgcatatgagtgagtgggtgtgtgtgtgtgtgtgagcaggcgtgtgcatgcatgagcgtgagcaggtgtgtgcatgtgagtgggtgtgtgtggggggtggtttgctttttagttagaaagtttaggcagaccctagcggcagccgctgaggcctgagggaggtcctggccacccaggagcaggtgctgaccccagaggaggctccaggggcctgacacggctctgcaggtctctcttggagactgaggaagactggggagtgttcagtggtgacagtgaagccatcccctgcagtccagccatacacgtatccagacacaaacgtttggcacatgtacctggcacacacagccctcagacatatgtccaggcacacctgtgcacacaccaaacagtgtggagtcgcctctgcctgggccccagggaggcatccccagagctgctcatagggaccccatcattgggtggtcagatttgcagctcagaagtaaagatggcaacacactcagaatccgcctggcctggaattcctcggcccggtcaggaattgaagagaaaagcaagtgtggggggggagtgtgtgtgtgtacacatatgtgtgtgcgtgtacatgtgtgcactttgtgtggtgtatgtatgcgtgtacatgtgtgcactcacgtgtgtggtgtgtacgcatgcgtgtgcatgtgcactagtgtgtgtggtgtatgtgtgtatgcatgtgtgcactcgtgtgtggtgtatgcatgtgtgtgtacacgtgtgcactcgtgtgtgtgtatgtgtgcgtgtacttgtatgcacctgtgtgtgtgcgtgtgtgtatacagtcacgtcacataatgtcgtttcagtcaacagactacatatgtgactaaggtttgataatctgacgataggactgaaagcttcctctcgctgtgtgatgtaactgttgtgacatcacagcgtggcggcactggtgtgaaggagccgctgcgccgcctgctgtgggagagtctggcacactcagggatgcgcagcgtgtcgtacttcagagcaacaacaaacaactgtgttactggtgtctgcgtttcttctcccacacttcttaccattactgtaatgcactccttctacttaataaaaaaaggtacctgtaaacagcctcaggcaggtccttcaggcaggtccacggagaagaaggcgccgttatcacaggagatgaggctgcatgcgggtggttgcccctgagggcctttccgtgggacgcagaggcggcagagaggaacgtcgatgatcctgaccctgtgcgggcctaggctcatgtctgtgtcgttgtcttcattgttatcaaaaaatgttttaagattttgaaatattaaatataaagaataggcaaaaagtttatagaatatataaacaatattttatacagctatacaatgtgttttaagccaagtactatttgacaaaagagtgaaaaagttgaaaaatgttaaagtttgtaaagtaaaaaagttacaataagttaaggttaacttattacgagaaaatacatttcagtacattatgttactcttagcgtctcagcgttccgtatttataaagtctgacattctgttactctcagcgctgggcatttctaaagtctgcagtgcacagttgatcccaggccttcccgctcacccccgcccgctcaccagctcaccccgagcccgtcccagccctgccagctcccttcgcgagcggggctccgcagaggcgcacgctttttcttctttagaccttgtttttactgttccctctctacgtttaggtatgttcagatgcgcaggtacttacagtgtgttacgccacctgcggtggtcggtggcctgctgtgcgggtctgcagccctggagccacgggcctcccaccgtacagcccaggcgtggagcgtacacgcgctgtgatgtcccacagcgaaatcgcctaagggtgcgtttctcagaccgtatccccgtcgttccgtgacacgtgactgtgtgtgtgcagaacccttgccaaacagcctggaaggatgacttggtggctattgagggctggaccacagcggagcagagaggctggaaagccgagccccacagcccggcaccatggcgtgggtccccggccgaccccacaggccagtgcgatgtcgtgggtccctggctgaccccacaacacagcgccatggtgtgggtccccggccgaccccacaggccagtgcgatgtcgtgggtccctggctgaccccacagcccagcaccatggcgtgggtccccggccgaccccacaggccagtgcgatgttgtgggtccctggctgaccccacacccatagcccggcaccatggcgtgggtccccggccgaccccacaggccagtgcaatgttgtgggtccctggctgaccccacaacacagtgccgtggtgtgggtccttggctgaccccacaggccagtgcgatgtcgtgggtccttggctgaccccacagcccagcaccatggcgtgggtgcccggccgaccccacagcccagtgccatgacctgagtccccagctgaccctatgggccagtgcaatgtcgttgggtccccagctgaccccatgggccagtgcgatgatgtgggtccccagctgacccgacagcacagcaccatggaatgggtccccagctgaccccagctcggctgttttcctattgtcatggactgtcttatctatgggcaggtgctgaggaaggacccccagagctgctgaaaagccttagaccgtcctttgtctcctctcatgaggagcacaaggctgggagctgccatctgtggatgtggcccacgtggggtctcctgtggctgtgggactctcccacggtgtccggcggccctgtctcctgagcgtcgggtttcgtcagttggattcagacccgcgttcctcctgaaaaggatcggaaagctgggtttttaatttttctgccatcacgtttccctgtcaatgcaaatcattggttcagccaacagtgatattgaactctgtttacatttagggcgaggagttgcagagacttttctccccgaaggcggagttctgatttccagagcactgtgcatggtatgcttctgactgaggccctgagtgtgcagcaggtcagcgtggcccaggcctcagtgaggccatgcccgtccacacgctcagagcccccagggaccaacagtgtccttagggggacaggaagtccccaggcccctcagtgccagcttggatgcaccagggaagacccccggggtagtgaggggtcctcagaatcctgatctgggcaaaggtctctccacccacgagtgtacagaggagggtcggggatcttatcccctgaggcgcctcatgccagacagaagctgtggccacactccgtggcttctgcctcaggaacttgcaaagggtgcacaggcctggaatggttcagaaacacctcagcctgggatttccggcttccagaacctgcaccaacaggcgttaggggctgcctggggcttcgctcgctgctgtgctgtggtagccggaggggcccagcatcggaagttccagtaggtggggctccacgtcagggtgtgtccccaggcacccccattcctgctaacatcgaagctctcgggaagggaggtggtggggggctctcgggggtccggctacagtgaacagtctgtgttctatggcccggcgccctcctcaccctgcaggagccccggccgtaagcatcagtgaccccctcaccctgcaggagccccggccccatgcccacgccagcccatggaggtagccctggcgtcctcagagccccccggccctgttcagagtcccctgggcctgttctccctcttcttgttcacgtgccccttgatgcgcagtcccgtgctcactgtgcccggtgcattcaccaggctggggacactcactcagggctgcggcctcacgacttcggtgctcagccacgcagcaccgtgctcacagaccccacgccgtggaccctggcggccagaggcagggatgacccaccctgggcgatagccacaccgtgcaggaagcccggtgctctgctctctgaagctaaacgaattcatgtcggccaagagctccagctactcgttccctctgctcacatgcccagcctctctgcagcacctgctgcttctaggaggtggagcagccccagcagccccaggccctcaaaggcctacgtggtaaggcacagcccgggcctggctgcagcccagacaggcacagggccagcaccgaggactgggggtgctgaggacttgaggggtgctggtggttgctggaggcagagccagggtcgaacgctgtgccgcacgcctgcgaggggcgatggtccttctgggctccagagctccctgagtgctccatgagagctgtgggcccgctgtgagcagagccctcattgcaagaggccatctgtgcccctgcactttggtgctgtccaggactgcgtcccccacagctgtgaaagctctggggtcactgcagaaggttggaggaatgctgatccgggacaacttcattaaggacgtggcatcggagggccccacacagcagagctgtcattctggctcacctgagcgggagctttgctgaggactctcctttcctctgtgcccatctctggtacggggtgactgtggcgcagcgtgtgcttcctcatgacgcccgggcccctctctcccatggcccaggtcaaggcaggaggacgctcggtttcccatctgcacagctgggcctgtccttcctgggcggtcctttgtccactgtcttcctgaggggagtttgaggagaagccccaggtctaactctgtggcagacaggcccaccgccctgcatctcgggacacagcaggcagtgtttccactgtaaacgcggggagagggacccactttcagagaaagaatttggcatctggtgagagcatctcgtttccagggggaatttcagaaagagtttgcatccgcataatataaatacacacttggcaaaagcaaaacacaaagccaggctctttggattcttagactaaaaatgtgctgggaccgccaggcttcgtgccacgtctggttcgacctcgactccctggtgtgctctgcagaggtcatggcgtcttcgggtgccacatgcccgtctctgggtggcacgggcccctgagacttctatgaacttgcatctccagcttttcaagttttactggagtgtcattgaggcagtaacttgatgtgagaaagaaagcaaatgcctagattgtctggagaccacacgctgggaacaggaaaggcactgcagtgcactgtgggggcatgtgttcatttgacagcactctgggtgcctgctctgagccaggccctgctctgggttaacaagacagacagacacatccctgccatggagctctgggggtggcaggggacagcatggtggggaggagcctgggaatagtgtgctcagcaggtgagcagcacctgtgggggaggagcctgggggtgccacgaggaagcttgctgaggatggcatggctggtgggggacagcacggtggggcggagcctgggggtgccatgcggaggcttgctgagaagagccataaacagtcaccctgggtgactccaagctgtgggaggccagtgcggtgcagggacccagtcggtcactttggagggcaggtccacattcattgtcacaactaaaaaaattcccaaaaatcaagacccaccaaagacgatcttacagttgcaaactgtgaaccacgtaaggacacattccacagatagcaagagtccagaaatacaacaaaggcaggacagaccgtcaataatgccaaatcatcgaataattgatacaaattataatattgtaaattattaaaagcatgacagaattagaaacataagtaccacactatgaaaaaaatcccaacagataaaaaaaagtaggactcatagaagtattatcattaaaattaaaagctccagggatgaattaagtgccggagtagacacagctggagaagggattgaggaatgggatggcaggcctggggaatggcccagaatgcagcacagaaacgtggcaggatgggacaggagggtcggggctgggagaggagggaagagcccagcgcttgcgcagtgagggtccacgaggggcacactggagagtcaatggctgggcgttttccagaattatccaagacataaacctcaggaagcatggtgagtcctgagcaggaggaatggaagtaaatccacacacagacatgtcagagtgaaacagcggaacatcaaagacgaagagaatatttttgaagcattgtgggaaaaatgtcctattacataagaatgcaagtggcggcgggtttccagaacaaccacaaaaatacacaccaggagaagtggaggcgttcagtcaaagagctggtggaaaaccccacccacacacttagagttctctcagcagccaagtcagccttcagaacactggccaccataaagacagtacctggcgatggagagacacagccccaccagcaggtcccacagagaaccaggagtagctgagcttctggagcagggtgggatgaagaaggaagaagaacatttgtgtaaagcttaaaaacatgtaggctgaggcgagctgctttttgtggactcatgcatggcggtaatatagaaacatacttggggctgggcacggtagaacacttggggaggccgaggcaggaggattgcttgaggccagtagtctcagacaagccagggcaatgtggcaagaccccgtctctacaaaaaataaagacttagcaggagtggtggcacacgcctgtaattccatctgctcgggaggctgaggcaggagaatcacttgagcccaggaggcagaggttgcagtgagccgagatcacatcactgcactccagcctgggtgacagagggagactctgtttcaataaataaataaataacttaaaaaccatacttgggattcttgaaaggtctgagttacattgggaggaatgagagggtttggtggtgcaggggagatctgatcccctcctgccagtgccttcctgaaatctcgaaacatgttgtatcatagagattcagggaacctgccatcagcattttggtgaaagccacaggatggcagtggctcctttctgagtctcagcagatctcatagatgctcctgggcaggccttagggaaatctgggctcctagtctcatagctggtgcctgcagagccaagaaccgcatggcacctagcgctggcagcctccctgctgcctcctcacctccacacctgagaagccagcagggcccacgctggactggggaccctgctgcatctctgatgtggggaagcctcaaactcaagctccagaatgacctagagatgatgcgtgtttataggcctgtgtgtgaatgtatctgagtaaatgcctgcatgcaaagacacacatgcctgcatacacataaacacgtgcctgcatgcacacacacataaacatgtgcctgcatgcaaacacacacatgcctgtgcacacataaacatgcctgcatgcaaacacacacatgcctgtgcacacataaacatgcctgcatgcacacacacatgcctgtgcacacataaacacgtgcctgcatgcaaacacacacatgcctgtgtatgcataaacatgtgcctgcatgcacacacatgcctgcatacaaacacacatgccgttgcacacataaacacatgcctgcatgcaaacacacatgcctgtacacgcataaacacatctgcatgcaaacacacacatgcctgtgcatgcataaacgtgcctgcatgcaaacacatgcctgtgtacacataaacacgcatgtgcagaattgctccagagcccatgcccctactctgcctttgaggaggggcatccgtctcccgaggcctccgctgcatccccaccccatttaggagctgacttggggcccttcccagaggctgtgggtgctggagggagggagttgctccctggaaggggaactggagctgtaccctcttaggaggcaggaggcagtggggctgtgaacgcctgtgctccaggcaggaggcctgggccggtggctcaggtagcagcctggcacagggtaatgactgtgtgcatgaggctgctgattgcccatttcagggataatggacgaggtcacaggaagagctgggatatggtgtggttttgagggagctctagctcaatgccatgccctgcacagctgtggggccatgactaatgaatagcaccagagagggtgtgcatggtgaccgcacaggaacatggccgggccagtcctgcagggttgagagggtgtgtgtggtgacactcaggaacacggtcgggtcagtcctgctgcggtgggagggtgtgcgtggtgacactcagaaacacggtcgggtcagtcctgcaggggtgggagggtgtgtgtggtgacactcaggaacacggtcgggccagtcctgcaggggtgggagggtgtgcatggtgacaggaacacggccgggccagtcctgcaggggtgggagggtgtgcgtggttacactcaggaacacgggccagtcctgcaggggtgggagggtgtgcgtggtgacactcagaaacacggccgggtcagtcctgctgtggtgggagggtgtgtgtggtgacactcaggaacacggtcgggccagtcctgctgcggtgggagggtgtgcgtggtgacactcagaaacacggtcgggccagtcctgcagggttgagagggtgtgtgtggtgacactcagaaacacggccgggtcagtcctgctgtggtgggagggtgtgcgtggtgacactcaggaacacggtcgggccagtcctgcaggggtgggagggtgtgcgtggtgacactcaggaacacggtcgggtcagtcctgctgcggtgggagggtgtgcgtggtgacactcaggaacacggccgggccagtcctgcaggggtgggagggtgtgcgtggtgacactcagaaacacgaccgggtcagtcctgctgcggtgggagggtgtgcgtggtgacactcaggaacatggtcgggccagtcctgcaggggtgggagggtgtgtgtggtgaccgctcagaaacacggtgggccagtcctgcaggtgtgggaggtgatgcccgcctggggcttgttttggaagagtctcagggggcaaggccatttgctgcctcccgtgcatgtgagaatgaacattttgcccccgaactgctgccagaatctcaccagtgtgcaccttggggccattttccctgacctgttctcacaaagctgacattgctcactctgcaggttacttgacactctgggcaggacaggagctgtgttccctctgctgggggagccagcactagggaggagaggccgagaggggctgctactggggctgccacggcagtgcccgaggccatgagtgcttctctggcgtcaccaacagagaaagctttatgggtgggcagagcacatctataacgggcagggcaggtcccactgtctgcagcagaggcaggcgaacaccagagcctgctggcaccacagagctttctggtgacagatgtggcggctctgggaagagcagatgtcacaccgagcatttgagcgtcccagctgcacacagacacacgtgcccccagcgaggaaaaccaatgtgactttattttctgctctttcttttctttagctcttggagtttgacaaggagttgtctgtctttaaggacagactgtatgaactggacatctcgttccctcccaggtatggaacatgctgtttgctggatgaacccggccgggaaggtggcgtctccaccctcccagtctctggtgcatctgcgtgtctgtgtgtgccagtttgtgctgggcatgagtgtgtgcattctgtgtgcatccagagtgtgtgtaccatacctgtgtgtacacgtgtgtgttgtgcatctgtgtgcacaggtgcgtctgtgtgtgaacgtatgcgtctgtgtgtgtgcacatgtgcacgagtgtgtgtgcacgagtgcatctgtgtgtgcacctgtgcatctgtgtgtgcacgtgtgcatctgtgtgtgcacgtgtgtgttcttgtgtgcatagtgtttttgtgtgtgcacatgtatctgtgtgtcctgcacttgtgtgcaaactgcaccttctcctgcccttttcatgacatgaaaaaagcagctgagagtaataagtaattctgttatctttttccaaaaaaggttttttccaatatgcaaaatactttcttatcagacttgctcacgagggacctacggggactgtgtgttatggatctttctggcaatatcggggcctccaaatgcagtgtgtctatgtgggtgtggatgtgtttaaggcatgcgtgtgtgtgcctgggtttgaatgtgcagatgttgcgtgggtgtccgtgtgtgtgcagacctggtgcagatgtgcgtggggcgtgcgtcacacagttgtggatgtgtgtgcataaggtgtgctcgcgtacatggttgcatatgtgagcatgagtgagagcatgagtgagaacatgtgtgacgtgtgtagggctcatgcatgtggctgtgctccacggatgtgtgtgcacatgtgtgtgtgttcacgcgtggagatgtgtgcctgggtgtggatgtttgtgtgcatttttatgcagatttgccagcacagagcagttctcactgttggaagccgcaggggacttccactggcagatgtggactttgcctgtcagctgggagcaagattgggagccggaggtgcggcctcagggagcctgggtgggagctggaggatgcggcctcagggagcttgggtgggcttgggtgggagccggaggtgcggcctcagggagcttgggtgggagttggaggatgtggcctcggagcttgggtgggagctggaggatgcggcctcggagcttgggtgggagctggaggatgcggccttggagcttgggtgggagacagaggatgcggcctcagggagcttgggtgggagctggaggatgcggcctcggagcttgggtgggagctggaggatgcggcctcagggagcttgggtgggagccggaggatgcggcttcagggagcttgggtgggagctggaggatgcggcctcggagcttgggtgggagctggaggatgcggcctcagggagcttgggtgggagccggaggatgcggcttcagggagcttgggtgggagctggaggatgcggcctcggagcttgggtgggagctggaggatgcggcctcagggagcttggggacacaggctttcctgaagccagaggcagtgctgaggtctgagccttgaaagtgacggagcactttggtgtccaggggaagtttttggacaggttggaggagcctccagaaggcagtggtggcccaggcctctcgtcctcctcacgagcttcttcctgttctgcaaagacaccgaggctccctgccaggcatgccagccttatcctgtgggaggtgcaggaagcctcaggggatctcgggctcacacccctcttcctggagggctcccccatcccgcttggatctgaagtctgactgctagacacacgggcccccagagagcccctcgcgcccagtggcattccagaaagatccatggaccccgaccctcagcgttcccagggtgcccatgcgcccagtggcattccagaaagatccgtggaccccgaccctctgcattcccagggtgcccacgcgcccagtggcattccagaaagatctgtggaccccgaccctcaacgttcccagggtgcccacgctggcccagtggcattccagaaagatccgtggaccccaaccctcagcattcccagggtgcccacgcacccaatggcattccagaaagatccatggaccccaaccctcggcattcccagggtgcccacgcgcccagtggcattccagaaagatccatggatccctgaccctcagtgttcccagggtgcccacgtgcccagtggcattccagaaagatccgtggaccctgaccctcagcgttcccagggtgcccacgcacccaatggcattccagaaagatccatggaccccgaccctcggcattcccagggtgcccacgtgcccattggcattccagaaagatccatggatccctgaccctcagcgttcccagggtgcccatgtgcccagtggcattccagaaagatctgtggaccccgaccctcagcgttcccagggtgcccacgcgcccagtggcattccagaaagatccgtggaccccgaccctcagcgttcccagggtgcccacgcgcccagttgcattccagaaagatccatggaccccgaccctcagcgttcccaggtgctcacgcgcccagtggcattccagaaagatccatggaccccgaccctcagtgttcccaggtgctcacacaggcctggcttcctcttcggcatttggctgggtgagatcagcttccgctttcccgctgcgtctgccctggcggggggtcccgagtgcctctgcgtgccaggctcgtccacctgccgcctcacactcttccccgtgcagctctgcccctgtcaggacacgttggccttcctgtgctttcctgaaggctgccagggctctgaggccgtgggaaggcgtccttgccacggcctggcccctgaggcctgtgtctgacccagctcctcagaagctgggagccgagccgccatctgtacctgctggtctggcagcgtctccttcctgcggtgactcccggttttcagaatcgtttcatggtttttgctgttgttgtttgagtgaacgcattgcaaaccggccgagcagccaagtacatcttcccatcactgccacagtccccgccctggttttgggcagaggtgagctcaccaccttggagtggttcaaggcaccttatcagcattggtgggcaggaccctcccgcgggcagtagaccctccatggggagagcccgcacctgctgaccctgagaggagacggcattcctagcgcagagctccggatacagccgcacccggggcgttggtgcgtacactggcagagtgacgccaggaaatgtgtcattggcggatggttctgaagaccagcggggtcttctcctgcaaaggtgtttgccactgatcccatggatgaatagaactctgctctgaatgaattgtaactgaatgctgtctgtcattttgccagaaaaggtgctaatatttcagacatttatacaaccctcaatttttgtccttaactaaaagcacggttcttcctagcgccttctttagggacagccacaaaagtgacctgtttgaggcggtcaggagcaggagagtgagcaggcgggaaggaggctggccagaccttgggctgcctctgcctctgcataaggaactctcccgggcgggaccctgagctgtaagatggtgccttcaggccaggacagcacccaggatacagcctcccgaaggcctttcatgccatgtgctatttccatcgggtgtgacgtgttaaagctctacacgtgtgcttagagttactgggggatgagggacccatggtggcagggatgagtcttgcccactctggtctctggaaaccaggcggctatgagtggatgcggggtcaggtggcgtcagcccttagtggtgagcagaggcggcgatgggctttcttcacccagcattggtctgcccggctccccagacgccaaggccctcagggcaggattgtggtgtgcgcctcaacagcagccctgcagcccccaccccgtagctccccccaccccgaagttcctgatacgtgtggctcccggtacagcccaggctcaggtggcggcgatttggacaccccagtggtagcatggagctgctgcctttttgcgcatcctagctagaagtgaatttctaatttttagtttaactttgagaattaaccgccattaactctaagataaagagatttaagatggctcctcggtggccgctccactggtgtgacagcccgacatttctaggcgttagcatttctcacgaaaccccatgtagaacagggctggcgagggcggcgcctctggaaccagagtcccacctctgccctgacactgcagagttgggcacattgctcacccctcgtggcctcagcgtccccctcaggatgctatcgtctcctctgggcaggctgagccttcaggcccaggcctgcccgacggtacccacccccaggtcagcctctccgcagccagagagccgaacgctcccaagtcaccgcagtgtcgccggccatcgggtggctcctgttgcagcttccggaatgtggggggcactgcgtttcctcgcggaggccgtggtgctgtgcatagtcagccggggtttggctctccctctttgtctgtgtggacgctgagcgtatggaggatgggaactgtcacgtccattgcctgggggctccctgtgtctgtggactccttacatagtgaagagactgcatcattcatttattaagaagaaagccacatgccaccatcgaaatggccccgcagagcctcgctggccgccccggtggcctggccacttccctcttccagctactgaggaccctggagcttttgtctatgtgggttccatctgttggtcatggccatcagtttttaaatatttattagtccgttttaaaaataacacaattacatgtttacataagtaagtaacatttttgtgaaaaaagtacccatgcacggggaggtctccttccgccagggcgtgatctgggagccgcacacacaggtcccgggaaatcccagccacccagggtgtgggagtctcgacgcggcacgtctggcacccagtgcgagcagcaccttcctcagaatatggcagagctcaagggaggggtctctgtggtggggacgccgccagcctctgggaggaatacgttttccaacaccctcgggtctccttgaaagcttaaattttgtcattggcaacaaatagcatccgctgctgctggaagaggcaggctcgtccgcccttctggagaaaatgcctgttagccactgaggtctaagttaccacagtctgtctgtcaatctttctggcaaaatatggtgtccgtgaaaacgagcagctgctttagctgacgactcagatgcaggcacgctcccctgagagatgagggccatgtcatccctctgggcagaggactccctggaggcctcatctcatcccacccagcccaagaccccatctcccaggcctggggttcaacacaaggaatcatttctcctgcttccctcgtaagtgaaggtagctttttgtttagtgctgagggattgaccctgggagagaccctgcccagcacggcccggcctctgcctggttcccacgccggcgccggcagttttaccaccttgggcagcttttgccacatccgtgcaatgccagctccatgaaatcagtgaatatcaccttagtgtgctcgtcaatgtagatctcccctctcagactgccgcaggggtcccagggacccacagggggccacacgccaactccagaactgcccaaaacttggaagtatccccagtgcccatgaagagtgggacggacactcagcactgacacggaggccccggcagccgccccgcgaagagtgggacagacactcagcactgacacagaggccacggcagccaccccatgaagagtgggacagacactcagcactgacacagaggccacagcagccaccccatgaagagtgggacggacactcagcactgacacggaggcccaggcagccgccccgtgaagagtggggcactcagcactgacacggaggccacagcagccaccccgcgaagagtgggacagacactcagcactgacacagaggccacagcagccacccgatgaagagtgggacggacactcagcactgacacagaggccacggcagccaccccacgaggagtgggacagacactcagcactgacacagaggccacagcagccacccgatgaagagtgggacggacactcagcactgacacagaggccacagcagccacccgatgaagagtgggacggcactcagcactgacacagaggccacggcagccaccccgcgaggagtgggacagacactcagcactgacacagaggccacggcagccaccccatgaagagtgggacagacactcagcactgacacagaggccacagcagccacccgatgaagagtgggacggacactcagcactgacacagaggccacggcagccaccccacgaggagtgggacagacactcagcactgacacagaggccacagcagccaccccatgaagagtgggacggacactcagcactgacacggaggccacggcagccaccccacgaggagtgggacagacactcagcactgacacagaggccacggcagccaccccatgaagagtgggacagacactcagcactgacacagaggccacagcagccacccgatgaagagtgggacggacactcagcactgacacagaggccacggcagccaccccacgaagagtgggacagacactcagcactgacacagaggccacagcagccaccccatgaagagtgggacggacactcagcactgacacagaggccacggcagccgccccatgaagagtgggacggacactcagcactgacacggaggccacggcagccaccccatgaagagtgggacggacactcagcactgacacggaggccacggcagccgccccacgaagagtgggacggacactcagcactgacacggaggccacggcagccgccccacgaagagtgggacggacactcagcactgacacggaggccacggcagccgccccgtgaagagtgggacggacactcagcactgacacggaggccacggcagccacctgcagcgagccgccgctgcgcacagctccacaagtgagtttaaagccgggttgcacaggtggagaggacgccctgggactccacagggtgctgttactgcaggcggggaatcacctcccaccgccctccccggtggaggcctctgggctgtgggccggcgcagggtgcggtgggctggtgaacacccatgtcccgtgtgcactcagccttgtgtgtgcctcactgtgaagtgaaatttactaaaataaatggaaaagtttagaagttctattgctacccgtcaaaacgtttcaaagtttttatcatacgcagagcaggtccagtgggaaaaaatcactccttcccaaagaaagactgactctcagaggtgggagagggatgttttcattgaacaattactgagcaagatcgagttttagcttctgaaaaacacaaaaatatacgcaacacaggaatgaactgcgcagacaagtccaaccagaggtcgtctctctttaatggacacatatatttttaaattagggattaggaggcccctttcaaactttccgtgggccataatttatgttctcctgtctttagatgtgtatttatagtgtaataattatctagcaaaatgaactctactgcctgcgagctgggtgctcaggagggagcgaggccgcccgtccgcctggtggtcaggaaccctgggtgcctgtggctcatacagactgtgggacctgtgccgagggggaggacagtgagggaacccgtcccacagaagaggcctgccaagggttctggtcacccggagagcttttgtccctggagatacgggcgaggggagcacccaggacagcctcctgctctgttgcccgggctggagtgcagtggtgatctcgcctcactgcagccccatcttctgggctcaagcgattttcccccctcagcctcccaagtagctgggactacaggtgtgcaccaccacacctggctaacttttttattttgtatagagacaggggtcttactatgttgtccaggctggtcttaaactcctgggctcaagtgatcctcccgcctcagcttctcaaaatgctgggatgacaggcgtgagcccccatgcccagccccccagaccctcttggaagtctgtgccgcttccttctcccgctcggtagcttcagcattgccacagctgtaatcgtttagttctttctctttggttttagggccttctccttttcaggaattccagtggcagctggtgtgtttggaagcgggtgtctgaagccagcattgccggtggtgcctgcaggctgcacgggaaggcagagctttgatgaggtcctgcttgtgacgggggtgtgtcagaaccgttttctctgtagtgtgctgcaccctcctgctccgtgtacacaagagcggcgtggtaattggttaatattttaaccaggcgggagtcagaggaggggctttcaccctgacgcccacctggagaagtgaggctgcgctcctgccgcttcctctgagcacagctcggggagttggcgtgaactgtcgccgttcacttgtggttcagggcggctgagcactgtggcgaagccgtgggcccccacccagcctgccttctggggtcctcccaggcccgttggtctctcctgtgccgtcagccctgccccaagacctcgacatagccgggcttttaagcttgttgtctgcttctcgggcccgtggcgaccctacctacccagcccagcctgctcaggttctaaagctgggccttgtcagcagggccagtcagcctggccacagcaaacaatctgccgtgcagcctacacaggggctgctgcccgcatcctacagggaggagagaggggcagggaggagagaggggcacggaggagagaggggtagggagagacgggcagggagagaggggcagggaggagagaggggcagggaggagagaggggcagggaggaggggcagggaggagagaggggtagggagagacgggcagggaggaggggcagggaggagagagggacagggaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgttcgccctatcacagccgctcccacgctgtaggcgcaggtgcgcccctgtcctgtgtgcctccccccccacccagcaggtatgctttcagataagcccacatgcctggcactcccacgtcagtcactgctgggcagcgtccaggccccgcgtcctgctgctctgcagcgtggccccgccagcacctcccacctgtgggtacagcggttgtgtgcagtccacactggccttccccagacccagctggaaccagcccctcctgcatttctccctgggtgttgggggccacagggagcacccctggctgtggattaagggtgttgcccccaacagcctggccaggacacctctctcacccaggcttcttcctcctgttgagtcgtctgtgaacactcccagggaagcccttcctggagcagatgggctgaggaagccgctgccactctggcatccctgttctctcttgctcatccccagagcccagtctgtctgagcagcaatgcccatcagaccctgtcccatggacagagggcggctgtgcttcctgccacgccctggcttctctccgtgcccccaggggacgccaggtggcacgggctctccaagctccatggggtgcatgaggagggagaactggttcggttccagcttcctatttagaagtcacctattgtgtgctgtgtgcatgtgtgtccggggggcagtggacgtgtgtgcggatgcaatggacatgtgtccaggggcagtggacgtgtgtcaggggctgggcaggcccctgcctgcatccagtttccactcgtgtccgcggttgggatcagctgagaagctcctgaacaaagtggcccagcctctcaaacgtgtgaaatggggcaggccaccaggttgctggctctcctgaaagcatgtgcagctgttctctgctctgtgctcttcagagacatgcatgacacgcaggccctgcgtagctacgtttttaaccaagcagtgactgcccaaggccgggtggcagccgtggctcctgtgagtgtggctcccgctggagcgcgcggaggatgggagctcctgcgtcagggcagagcaagttcccagtccccggctgtttccaggtggttgggcacagggcccacaggcgcccctgtgggcagggtccggggggcatgggaggggctgcagaatccgcagctgaggtgccgggatggacccgaaacccaatcacagccaacagggaaatttcacagagaatcagatcccagtcgcgacaggtgctgtatgatattttggaattaactgaaaaaactcttgagactctggtgaaggccccagagatgttgagagtaagcagagacgctgcacttaggggcaggtggctgagctcagccacaggacccccggggttcgttcactccaagtggaattcgttaccacttcagtgcagtcccaagcaacatgcccatttgggggtgggtttgcagcctgatgggtgggtcgggccccctgagaacctgcaggcccggaagtgggggctgtgcttgcgtgttccagactcggcgggtagtgggggccatggccatgaggctccaggctggtgggggagtgatcagtccgtgtgtgcgtggactgctctgctgtgtgagggcgggggccaatggctcagagacacagcaaggccgcggaggagcccagatgagctgtgccctggccggcggtgggtggtggagacgcaaccagcagaccccaggcagtgtgggatgcgctcactgtgtgggtgaagggctccgccctcagggctactggcaccgccatgtggccagccccattcccagacccgcagagggcgtgggcaggcccaggaagcagtgagtcggggacagtcaccctccactgcagcagtgacccggggccacagcctgagcacctggatgctccccgaggtgggagcggcgttggtcaaagcggagaccacgtgtgccacaccccagagctgcctgcacttacaggcgtttcgagctgatccgggccaggtcaccaggtggaggaacgtcctgggaccagatgacactggctgccattttgtttccatggaggttttcatcatactttagaccatgttcaaaaaaccaacaaaaaccaaagctcaacagacaatttcatgcagtaaaggaaggactgatgtgaagatactgtgctatagctaaaatttagtctcacataaaaacagtttgatatagaacttaaattgtgaatttggttttatattctagaaacttccatgtgtgtattcattccccaggtagtgctggccattctaaggtgtattgggagagaatcggcacagccgtccctttggggctgaggacggcccgagccggccggctgaccctctgccttcatgtctccccagctacccgtacagtgaggacgcccgccagggtgagcagtacatgaacacccggtgcccagcctggtgtgaccgcatcctcatgtccccgtctgccaaggagctggtgctgcgggtgagtgtgtgctgccccagccctgggcacagagggatgtggagcgctgggtctggtctggcccagccctggtgacagggccccaggggtgggggcacccagcctggggaatgctgccaggttgggccctgacctcgtgctgccatgagctgcaccccagcattgggtcacctctgagccagcacctgggctggggcagcagcagatggagccgagttcctgggccatgggcagccagcgtcatcctgagtttgaaacataacacaggcggttagcaggaagtgttttcaaatcgtggttcattgtatccttggaagtcaacgtgctcttgtgcgttccagcgctcatgggctgggccgtgaagcgcagtagaaatgtctgaggttgttttcctaagttgtaaattagagccagattcatttgagcctcgataagttaaaaataaataggcgacattttcagatggcctgggccttgggaaattttcagatttcctgtgattttttttttttaataataattttttttttttttttttttttttttttttacaaaagaggtgataggggcttgcttgctacattggccaggctggtctcaaattcctgggctccagcattccacccacctcggcctcccaaagtacccagactacaggcaggagccactgcacccggtcaatcctgtgatttttcaattcccacattttaacatacaaggagtgttttcagaagaatcaatatctgaattggttttgtcaaccccgtgaatgaaaattaaatgcagatagtaatgaaagcttgcgggtgtgcgtgggaactgcagctgtgcccaacacccagagccggggcctctgaacataacgtgggtgtgcaatcggaaggaggctggagactctggtggttccactgccagcctggtgggctctgccccctctccactgtcccaggcccagagcagggacaggagccccctactaaccccgacttcaacaccagctgtgtgaggctccagttgtccctcactgcccatctgtgtctgtgccagacggcaccagaccccaggcacagcaaacacctgggtgcaggtgtgccctcagcagggcggggacctctgcagccctggtccctgagatgcaccctgctggcctctgccatgtggctctgtctgccgggccgggttccttactgttccttcctacatcctggagcaccctgggtgcagcctgccctccgtccctggctgtgctgtgaggagcctgcctggtgggggcctgggctggaggcggggccccttggccagaagtccctggggtctgcagccagcctggctcctccgcagccccacctctggcctgtgggcagggcctgtgcccatcattgaggaaagtgtgctggccacaagcccaaaagcccaggagtgggctcggcctggagcctggctgtggacctgccactgcccctctggctgggctcactggtaggcacgccagtccctcggtgccacatggtgggtgctcccatctgccagtgctgagagcgggtcaggcatgtggagcccagggctgccaccagcggggcaggagcctcccggggactcgggcacagatgccatcccctgggaaaacgtcggaggtcacgcgagtgcagattggtgagcagcgcccaagggcagaaggctggcagggctgtggcctccccacattgtgctgccgctgccagggctccaccagctcagagcagggcagcgttgcagcccgttttccattcactcacagcctctcgggttctctggatccgggacttgacactttatgctcagggtgggggacagagcctcacaacacacacctggcggcctttgacagcccctgccttctggggctggagtttggacaggctctccccatggggccacccagtgggcagcgggtgtgcaggacaagcagacgggcgccgggcgcgctccgcagcctcatccatcatgacacgcgccgtcacctcgtcaccaagctccgttctgcctccggagccctaaaacaccaaaaggggctcgggacgcgggcggtgctgcttggggagcctcggtgacaagtgttcagtgaggtgtgccgcacgctgcctgtgcccgccgtaatttgtttatctgtccaaagattatgcagttgaaaatccacaattttatgctgcctttgtaaattaccacgctgcgtttgatgaatgtttctccacttctgcggaggcgccgcttcacccgcgagaggcgggaaggtgctcatgcatgcggtgccgaagcttgttttctcattctttctggcaggcgcccatgctggaaagtaaatctgaccttgagcttcccactgcattaaagataactcagttttacctggatagtctcagatgctccagctgtggatataaaattccagcccaaccagagccgagtgctgaccagcagcaaaccccttccggaggcgcccggaatacaggcacctgctgggaagtgcgcacacagccgtgaattactgtgcacagattgctttgtgtagtggtgtggaattcggtgtctgttctcgtttgaacactgagttctaggttaatagaacagtcaaaaacaaatcaaagtgggaagattggaactagatgggctgccgcactcagaggagcacacctgcacagaaagctggggcgcacacactcctgtgaacagggtcccctgcaactcccctgagagcccaggagcatgtccgggagaggggagcttgggagccgggccagcacccgcggctccccacgcgacccctcctagaggcagatacctgttgtccaaaagggccagggtcaaggtgctgaggcgctgccacatcaccagagcctttggtccatgagctggcctctctctcaggggccaggcagggcgggtggcagaggctggggaggtactggcaggggccgacatccccatctctctgcccccacaaaaccctgatgttcctgccagtcagctcccaactggacccagggtgccccacctccccacactcacctgtctgtttcccctttccagtcggagagcgaggagaaggttgtcacctatgaccacattgggcccaacgtctgcatgggagaccacaaggtgacatagactgaggtccaggggccaggctgggggaccaaggggaagctagggggccggggggctggggccagtgggtgggcgggtgctggggctggcaggcaggtgggcgggggttggccagtctctcctctcctgttctcctgtcttcttagtctgactacagagtaggccaagttggtctgtttttatttaattttaataaaatatcataagctaggtgggtaagtaggaagaaggcagaaatgacgttacaatagaataaaatacataatttaatatttgtaaaaaaatgtccacagctgattgtttctgaaggctgttttgcaaatatgcagcttcagtgttttaatggccttcttggggcaggctcactgtcagccgaggagccggggtgagggcgctccccaccgtgtgccaaggggcagcactggcacagatcgtttattcaggcaactgcacctcgagagtgtgcacaggagacagatcaaatctcattttcagccaataaatgagttagcttcttccacgttggaggcccagagctgtgagccccaaacacacccggataagacgctggacctgccaggtgcggcagagccgaggacgggagagccttccttccccgcttcatttggggcctatttagccattcttttacatcagtttttccattaatttttttacctggaaataacaccttccttgcaaaacctctcatggccggcctggctccagttccacattcacggggcccccaacccctgcgctgccgtggctgtgcacaagggccgagctgcctctgctggccatcagctcctcccagcccggttcatggctgccctggtgagacgcagggtctgggggtgcaacgggaggcggcggcatgtgctgtgctgtcccgcgtgcgccgtgctgacaccgtcctctcttcctgctgcagcccgtgttcctggccttccgaatcatgcccggggcaggtaaacctcatgcccatgtgcacaagtgttgtgtcgtgcagtgacgtggtggtaaatatgactcctccctccagttcagcttttacgcagcttttcctggtgcgtttgttcctttaacaaattacgaattccgtgacagggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggtttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaatagtcccgtgttgctttttcttcctttcccttctcctgccacctttgaaatgctaactcaggggagcggcctcctgtatagcctgttatttgagatcaagctcattagaaatcctggaatttcactgtatcacacgctgtcacaaaacactaagccgttcattgagaggagaaaaacagccttttggactttctactgtaataaaggatttatccctcaacattttaagacgggattatatcaacgctttgccttcctcaaaactttaagaagcccctctgctctgagctgagctgagaggggctccccacagaaaagcgttgcttctgcccttcgagttgcttccttgtaaagaaggctgctaagagcctaaaacaaaacgcgccgagtttaagccctttctatttccctttaacgcttccgcaaatgccaagagaaatcgtaccaccgcagtgatatcattatttacatttaatttttaaaaattaaaactcaacagccacgcccattaagatgcagcgatgggcagccccggccacagaggctgcgggaggctggaggggttttgtcagccgcagtcacagccccgcggagctggcggcatttcagggcaggagacgggtcccccgagcccccggctgggcgctgcgggccttgcccagggggcctccggctccctgaccccgcgtgacccacgggaggccccgccgctccgcgggcggaattatttcggatttctctttgcggtcctagttcggaagaaactgctttccaccgcgggaagatctggcgggatggtgaccgaagggcctccgtgcagcggatcagacccggttccaccggctgagcccagggcgggcctatgggatccgctgatgcgcagagggactttggaaataatcagagcgaagccctcggccgagcgggaacgggtgcccggtggcaacgagtacgtggccccaaagcgggaaaacggaagaagaaaaacctcccgcggggactcgaggcgggtacgcggctcacccgccctttcgggaacccccaagcgcgtccgaatccgccccgaggcgaggcgggccgggccgtacctgctgctccgtccccggctccgtcccgggctcctggcggctgtcgctgcggttccttcccgcgggccgggccccttccctgcgccttcgccgcctcctcgcgcctgcccggggcccgcagcctccgcaccgggaacccggaggacccgaggcgggcgcaggggcgaagccggggccggggaggggccgcctcgctccgggttcgagacggaagaaacacgcggcgcaggctccggagcgacggctccgacggggacccgttaaataatttattgatgatacaaagcgactcgcgcccacccggggccgcccccggattctgcaaaaatagattcgcccccaccccgcgggtcctcacaaggcgtcccccgcgccgccgccgcacgggctgaccagcgccaagttcgagggtttgtgcttcttgagcagccgcgtgatcttctcgtcgtccgagttggggtccaggggccggttgtattcgtcgtcgtcctccgcgtccgagccgcccaccttcagcttctcggcgtccgagtcctgcttcttcttggccgacgccatctccaccgcgtgccgcttgcgccacttggtccggcggttctggaaccagacctgggagtggacggggcggtcaggcggccgcggggcccggggctggcgctggggccgttcgcaggacgcgggcccccggctctgctctcccgagccccgccgcgctcaccttcacctggctctcggtcatgcccagcgagtaggcgagacgcgcgcgctccgggcccgccaggtacttggtctgctcgaaggttttctccagcgcgaagatctgctggcccgagaaggtcgggcgcgagtgcttcttcttcccgtccttgtccaggacgccgccggccggggctgcaagggaggggaagggagggaggtcagcggccggcggggtccccctccgcgcccacccgccccgcaccccccgcgcgggccactcacccgggccagccagacgcgggtccctccagggcgcgccctgcaccacgccgggccagaagatgggcgggcgccc

SEQ ID NO: 17491 - DNA, 7173 bp, Human
tatccccctttcaccatacataatattttttacacagcaaaatgtaataacttgataaatgtaagtatccaagcattgatgaggtaatgataaaccttatttgtggcttatgcttaagttcttttttttttcttttgagatgaattcttgctcttgttgcccaggctggagtacaatggtgtgatctcggctcaccgcaacctctacctcccgggttcaagtgattctcctgcctcagcctcacgagtacctgggattacaggcatatggcaccatgcccagctaattctgtatttttagtggagacggggtttctccatgttggtcaggctggtcttgaactcccgacctcaggtgatccgcccacctcggcctcccaaattgctgggattacaggcgtgagccactgcgcccagctgtgtttgagttctgtagtaaactgtccggtaggtttaatttgctcaagcgatgaggaaaagacttgcactttgtgcctcctgggaaagagactaacgtcttcaacataccttatggcagatatttaatttcagagtagagaccccactctgatgcctggtaaggttattggaagtgaaatatcacaagatcttacagtttgttgtgagataaggtaggatttggtgaggagtaacaaatactagcagatttcggcccaaacttcaattatagctaaacattactggaaaaaaccccacaacctactttatgtaacatataactactcacacacatacacaaaaataatacacacacaatttcagcaaacacaaataataatttaaagaaacaaattcaaaattagagccaggtatggtggcacatgcctgaaatcccagctacttgggaggatccctgaagacgagaagttccaggctgtaatgcgctatgatggctcctgtgacttgccactgcactccagtctggcaacatagccagagtccatctcgttcaaaaacaaaaacaaacaaacaaaaaacggcgaaatgaaggctcagccctcatcaggtttaggtgacagagctagaccctgtctaagaaaaaaaataaaattaaatgaaaattcgttatcagacagtaaagcatgaacccacagtgctggtcaagtcactgcagatctgagtgtgtatcaaggtttaactccataagatgaaaagcaggcaatgaatctttggcctgggtgttgacagtctaggctcaagcctcagctttcccactcattagcttgctgaccttggacaagtcacttatattctctgaacttactcatgaaacggagatacatttcatctgcctctcgcaagaaaaagtcctggtaaatacacattagcatttccgttttacacagaacactgacagatactttcctaagatcatggagttaataaccaccagaacctagactcaatacttatggaacttcaaatctcatgcttttctcattgcacttatgattactccattatgtaggagcaagggagagttgagagcatttgaagaggttatgcaaaggaccagctctgaggagtaggcttagcaaagtaacatgagggaaggtaacaccgttcatctgtgtagcggagtgggagccaagagacaaggagaaagtttcatgttcgtcatgtgtctcggatattccggtttctgcagggacgagaacgcgcagtttcgcctccatcccttgacctccaacacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctggtaaggaggaggtaaggggagggaaaaggaggtcactggaggacaggatcgttcccggcctcggggctgggggagatcttatccatggacagcgcaggagggggtgccctattttctgggttttgacttttgtcccttcccccaactccgctacagccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaagagtttgtggtagcagaagagtgctctccatgctctaatttccgggctgtgagtatctatttctctaccctttttttttttaaacatctaagcaaacacttaagcaacatcttaacatccaagtcttattaagctgcctttgcatcatctttttttctttcttcttgcagtctcagtgtatgtccaaatctgtacttgtctttcccctgaaaatgtgcccctttctttccaagctaatggcagtattcaactgataactatggtttttttgtttgtttttgagacggagtctcactctgttgcccaggctggagtgcagtggcgagatctcggctcaccacaacctccgcctcccgggttcaagcgattctcctgcctcagcctcctgagtagctgtgactaaaggcgcgttgcaccatgcctggctaatttttgtatttttagtagactcgggtttcactgtgttggccaggctagtctctaactccttacctcgtgatctgcccgcctcggcctcccaaagtgctgggattataggcgtgagccgccacacccggcctcaaataactatgttttattcacttttagtatagtaggctctggaatggaatgtatctttgccactcctagactgttgcccctgaagtgttctaacatacattcgtaatcatgcaaccaccacctccaccatccgcatcagaactctttcattagctctctgttgcctaccactccaaaccatagcagttgggcacctgcaccttctgaatggcagcctttttgtttatcctgttgccccttcctaacatgtactttgctccttttctcctggcagaaaactacccctgagtgtggtcccacaggatatgtagagaaaatcacatgcagctcatctaagagaaatgagttcaaaaggtgagtgctgtttctcttctctgagatcacctcctttgctcctatgactttagatggatggtcccaccttttcccctggtctgggggtagcatggaatatctgaaagaagagggggccgggctcacacctataatcccagtacttagggaggctgaggctaacagatcacctgaggtcaggagttcgagatcagcctggccaacgtggtgaaaccccatctctactaaaaatacaaaaattagctggtgtggtgggtgcccataatcccagctacttgggaggctgaggcagggagaatcacttgaacccaggaggcagaggttagagtgagccaagatcatgccactgcactccagcctgggcaatggagcgagactgtgtgtcaaaaaaaaaaaaaaaaaaaagaggctgggaggggtggctcacgcctgtaatcccagcactttgggaggccgaggcgggtggatcacgaggttaggagttcaagaccagcctggccaagatggtgaaacctcatctctcttaaagatacaaaaattagctgggcatgatggcgggcacctgtaatcccagctacttgggaggctgaagcagaaaactgcttaaacccgggaggtggaggttgcagtgagccaaggtcacgccactgcactccagtctgggtgacagagcgagacaccatctcaaaaataataagaaagaagacgggatttggagccaaattacttgaacccaagtcccagctctactcctcagcactatgttattggccatattttctcatcagtaaaattggttaatactagctctgcttatccagagaataaattaaatgatctatttgagagggatttatgtactatacacacaatagaagcctggctctgatttcctcttgagtgtatcctggctaggctgaagtagaagggaaattagagggagaagctgtctggccttccttgggaataactattccttcctgccctcagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcatgcagcacggaccggatgcgcccactgggtcttggcttccctcccatcttctcaagcagtgtccttgttgagccatttgcatccttggctccaggtggctccctcagtctggactctaccacttgggtctccagattttctgttacgtccttgtgggtcaggatatttctggaagtcactgtgaggtgaaggcaagagggcagtagtagagtgctcccctgggtgggagaccctagacaggacaggacctccctcttgcttcttgacgaccttggagaacagagtccccctcccttgctcagccaggggttgctccctgcccttgcctctcacctccgtgaggctggtaatcctcagacccagcttctggtcgactctggaatggactgaagctgggcaggatgatgagagccagggaaaaaagaagaatctgggaggaagcaagaggaacagatgaagggagcagggggtagagtgaacggaggccagctggggttatcggatgtgggaagtagatctggccgggtagtcggggtataaggatagaagtgtggggggagatgggagtagatagactaatggtaccaaaacacaagtgctggtctgggcagctttgttggaagtttgagcaattagcgtctgcagctggcggagctgagctaccaaggagctgggaaaggaggaatgaagagttagtatcatctgggtaccaggggccaagaatggcacccctgtgtgctgtacctgccttcaaaacacacatacacacacaatgctttcactcacatgttgtgcctctccagctcctggacttttttctgtaattcttggttctgtgcagaacaggctgccaccctagaatgtagggaggtaggacaaggctcagcaacctgagtcccttaccttgcctcccatggtgaggaaggggcccagacatggcccacaagaagccagaaataacccaggcgtacctgctctccagcccatcaatgtactccttcttccgccgccgactgtcctgagctgactgcttgttacggattttcctcctgaccttcttgaggaccctctcctctgccttggaggcccaggatgtgtgagtcctgggtccttcacctgcccccaactccccaatgcttctcctgggatattggcccctcagaggtcatggtgaggcccctgggttgggatacccttaggggaagcatgttaccttggtgaggggcaggtgagagggcagggaaaccccttcctgccccagcagacgcttctcctcatcggtcaggaacagggtttgacagggcagctgggggtaggggcaggagaagatgcaataggagtgaggagggggtcatcccatttgcagcacccaggctactccccccacatgccttctggagagtgtttcctcactgggagacaactttaatctagaggtgaggtgaggggcagagactttaattcagacaggctctagatcaagccaaagggacatcctgaggccaagaagggagagaggagggtattgtcatatcctt

SEQ ID NO: 17492 - DNA, 10302 bp, Human
  misc_feature (1)...(10302): n = A,T,C or G
nnnnnnnntccctaacagcccagctctgcactgtgcaagcctcaagccgctccgctacccccaacccctgcaccgctttctcattccccgcaccccttcccaggttctgggcttctagtcggtgtttctatcagggctgggtgccttgggctggggctgtctctgggaaaggggattgcatagtgccccctcccccatccagacacactcacacactcgctggatttttcaagtctgatttgtttaatcctcagtaactttgcacagtggctgtcgctggctcaaaccctccctgcttaagaaagcctgtctctccctggtccccagcctcagcgtacagctgggtgcaggctggggctgggcgctctcgttccccgggccgctgaggctgttaagcaggtttcttcccggctgccatgcccccggtgtcctctcaggatctccagctcctccccacttctgtcctgaacccctaccctgaggttttcttttctgagtgacccaagtcctggcatctttcaaatccctgaggtttctcagtcaccaactcaggccagccagtctatcacccagggcgcctggatgagcgctggaggctctgtcttgaagtcgcagaaatcaaacaaggttgtaaaaggggaggggggggggtgcccggtgcggagcaaggccacgtgaccctgctcagaccgcaaaatgtgccggacagatttaaacagtgccatcttaaggcttgttatgtaactgaaaaacagatcagaaggaaggacctcaggagggagggagagggaaggagcggagattggggaatgaaaaacacccggagaaaggccaggggctgggcccctccctatcccccactgcaggcctcaatgggttggggtagccgctggggtgctgcactgagggggcctgccctgctctgctccctgccagttggtttagaggagggggtggttgctgaccgggcaggatgtcttctagaaataatttttggcctggggaactggtttctttctgggcttcctggcaggaccacggctgctcacccagggattgaccaaggggtgtgtgttcctgggctctgggcctgctactgtgcccattgctggccaggaatgttttgcctggagtcagtcacaccatacccagggtgccacagtatatagatgggctatgggggttggcgcttacgggagaagtggccggtggggagggagaaggtgggccttgtggaaagggaggccaccaggcctggaacctgagctgtgaggacacttactcacctgagagtgtggcggcatcctagagcagtcaccttggggagccctggcgcccagagtactcccagctccttgctgccctgccctctcagcagagctccaggcagagtccctgctccaaggaagggccttggaggtggggagctgcccagcctcacacccaagaggcattggtgggtcagaggcacatctggcctggagggaagtgtgtgggcaccagggcctggctgtcgggtggggagaggcaggagcagagcctgggattgagcgaggagaggctctgagccccgccccatcctggaatcaggtcggttactctcagggtagctagcctcgttcctcctctgcagccacccctgctccttgggttgacttggcttggcggctgtccccattcccttctcatgcccaccacgcagcccagtgttgatgcagcagcccaccaggcactgccccccacccccatctccccgaggatgccagcacatgggcgtgacagcaggccagacctggagcatgaagagcttgggtcagctctttacagactggccctgtgccttggggcaaagtacttgacctgggaagctacccgctctgcgtctccagaatggagaccggagcctgccctggccacgcatcacagagcttggtggggaccgaactcaactcagacaccgataagcacttcacgcaggtgcagatgtcaggactgtgtcttccgcaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtagagcagcccccgggctcacagggcggcagggcgaggccccagggccccagctcatgttgcatgctgagacagggctatggtggcctcagatgttgatggggccccaaggaaagtgtttgccaggtgggactgagggaggaggagggtgaagaccaggagaagtggtaggagccccctcacctgtactgggagagcagggagagctggaccttcccggatgcctcctggggtgggtacgggagatggcggagaacgagccatggggcctggccctgcccgatgatgtgatctggactcctccaccagctggccttggaactggctttgcccctccatagcagggacccagagatgctctagcggggtgaggggtccttagagatttttcctgagtccaagtctatcccactcagccccctaactctcgggaggaggacaggtctgtgtgatcccttggaacaggacagcacaggcagcctttccctctagtgaacattctccatcctcccctgttagctatggaactagctgccagctttcaaactgtctcaagtccaggccagcagtggtagtcaatggctaaaacctgggctgggaagtggattccacgcccttgttcctgttgctcttccccacaaagggctgtgccattctgggccccctttccccaagcggaaagggtgtgaagtttctttcctcactgtctgctggaccatcatcctcccgacctggaatggcagtgggagagtgaaattccaggttggaggctggtctgagctttaaaaggcatcgtgctccatgacatctctcagatcctcggcaaaagcttgccgtgttgtagagtgagagggtgtaacagctagagatgggacatcggaagagagaggagaggccagcaaggaggctgcacagatgtcgcacggagccttgagaggcagcagtgaactcagacaccagggacggctctccctggtgtagactagggcttgttgtgtagactagcaaagagggaggagggtgagtaggagtgaagagactgcacacccacatggcccttgggggttccctcggtagagccttacatttcctgtgtgattctgtgccccacgcccaggcggggctgacagacgctgaagtctggggcagtaggtgctgtgagaattcagtaatagttattgacatttactttgcaagtagagataggaacaactgaggcagtgaagattatggcttctgggctgtacccctgtactcaccagctggcgtctgtcattctccttcccaggtggccaagctgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggtactgtgctggatgtggtggggaaggggagagagcttcagaaccagaggctgggaaggggaagaggagcaaggagggagggaggtagccggagaagtggttcccctgagaagcagcccggggagcaggctgggcaaggcctgtgccctgggtggacatgcacttgaacttcctgcaggagtgagctctggtttcaacgctctcagagctgcagcaacactttctttggcatgggaaggccagttctgcttttagtgatgcataatctagttcccgtgaagtggtttgtctcctgttgggcacctgggaggaagacgaagggatggagaatcggggacatctgtccctgttgggcagctttaggtggcatggagtgatgtctgggcaggggccccaggcccagctgctgtggttgtccatggctgagggaccagctgcaggaggggcagagtccaggtccccccaggagaagctccagggcagaggtggtcggtgccatcccttttcttgggctcccccagaggagggatggatgtagggctggagagtcagggacagggagacgaaacggcacctaggagtggccgtgagagtccgtgatcgggcaggcacagaggcactcagatccccggcctagggatgggcccccagaccacctggcgacccctccactctcatcctctgtttttctctgaaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggcggggccaccaagtggaccttcgaggcctgtcgccagatcaactgagcacggcaggccaggctgagcccgcccgccctcgccccctgcttgtgcggcgatgatctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaagggtgaaggcaggccgtcctgggatggtaccctgtgctctcccgtggaggagaggggatggctgaggacactggcccttaccccagggccagacagcatccatccctgctgtttgcatctgagagcagcatggggcctgggaggtcggcctgtgtgcccagctcagctagctctgccccaggacggccctgccctcgaccttcccacctcctcagatcctgcaaggctggggtctgcccctcccttctcacctctggagctgtgctgcactgcttcagcccagagggccctgagagaggagcgtgccacccacagcccgggaagccgggccccagcacccctctcctttggcctccggcagtgcagaccagaggggaccttttaaggaaagaagccgtgtttcgatgaagacctggccacatggggccactgggacttcaacccagcccatcggtgggaaggtcctttttgggggcctttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcacgccctgagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagtgggagccagcaagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgccagcacctccggccagccccgcccctgccgatctactggaccgcagaccaccttctgcccccgtgggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaaagcccaatacttagagtcccaattttgtctcatttgccaaaaaaaaaaaaaaaaaaaaaagcaaaccccctatggttgatattgttataatgtatatactgtataatatgaaagagaatcgatgtatctcactttttcattatttgctaaccaaagctgtacatttttcatatgatctgcagccttttgggtatcaaatgggtcaaaaccatgggacctgccacctcccatcagcaattctggaaatgcactatttctactggtattcttgcttttttttttttttcattttcttgctgaaatgacatgaattgttgagtttatttttacacagtaaagagtggagaaagactgtggtctcctcaggatgtctcttcttttccgaggcttgccaatgccacctccccctgcagccacccctcttccccagccaggtgcaggtgaccctcacctgcagggggtgtgtgcctcgcttgtgcattgccctgtgccctttgacaaccccacaccgtctggtgatgctggatgttgggtggaggggtctccatttcccaggggcagctgacgcagaggcagagagtggcccagtgtttccccaactcagtgaggccactcggcctgggatgtggggtcactccgcattccccttcccctcctgggtggactcgcggtccacagctgggtccgggttcgaggtggcccgggcttgtcgtgcccaagcaactctggcagttctctgcctcagcctctgctagcggggccttagccacgtgtggttgccttcccgctttcagagtcccaggccccttccctgcacttgtctgagagtgtctgagagtgtccctacaaagggataaatagccatgggaacgctgggccttgggctgagcttacttccctgtccccccttgtggacctggcttgactctggatgtgtttggagcttgcgagctgttccttccaagggacagagtaaccaggacccaagtgccctggggtgagtgattctagcacacttacaacctgaagtcaggggacatggagccaaaatcacctgcccggtggtttggttggtgccccccacctcacacacacagatgcacacacacacacacacacaccctgggttggcggaagggactggtcactctggcttcctgttggcatcgcccggggattctctgcccggtgctctggtgttcccaggactcaggagcgggggtttagtgggtgtgagtgagccacctgtcacctgggatggtgtggagggagaaggtttggcctcagcaaagcaggcagggaaccccctgtgtccctgcaggaagagccttggtcgggagacagaggccctgccaggcgggaggcccctggcctgtgttcccagagccattctcgctgggtggtgttcaccccagggtgcacgctcacggtcgggcccagggttatgcccgattccagtggctccaatggacacaccgcctcacacctcccactcaagaaagtgcagagttacgtctgtgataacgtcacgcatacatttctaatctctatgtgagagctcattcaaacacttgggttcttaactatcattagatgcaaagtactttctgcacttctcacgcctgattttggctcatccatgaatgccttcagggggccgtggagctaagaacagctgcttggaaagaagccacgggccttgcagctcggtggagtgaggtgggagtctgggcagcgggacacgggcgcaagaagtcaaagccagagggtgtcttggaagtcattaacttcagcagcctctcaggtgcctgaaactgttctcggcttgcacacttctggtgatgtggagctcattaccccagagaggtagtctgtcctattttcagacggctctgactatcggcaagttttcttttgcgctcccgtctcttctttttctgtcatttcatgcttggttccttgcattgagctacagctcctgcccatctgtcccaacacaggaagacgggggtccctcagtcttcaccagctctgcccccatgcagc

SEQ ID NO: 17493 - DNA, 17271 bp, Human
acacctcttcccagcagcagtggtcacatttggtaggcaggcaggggcccagccctgactgagaacactgttgcaaagactgagaaaccggaaaacactgtggcaatctgccctgccctgaggtactctgaagaatcagtggcccacccctaaactttccagctgtgtgtttgaggtgagagccccatttcagaacctagagtgatcttagaatctagagtgatgggaaaactgttagaacatgcaagcatgccctgctattttttttttttttttttgagacagggtctcactatgctgcccaggctagtctcgaactcctggcctcaagcagtcctcccacctcaaccacattggtgctgggattacaggcatgagtcactgcacctggccccttgtgctattttggagctgaggttagagttttccgtcaaaaccaagaaactcagttatggatctatctcaaagctgcactgggctgctgctgtaggttcagggagtaagtaaagccatccacccctttgggctgaaagttccagccctctaattccctaatcatttggtctttcccatgactggctccttcctgaggctatctaagactcctcattcattaacattaagtcagggaaaaaggctctttataaataacaaaagacattcctatcagaaaattcaggaaattttggcatactcaagggcttaccaaatatatttcataatataccccacagtggggaagtattggtacaaattaaagaagagatggaggagggcgggctaggcaatggaatcagcaagaatacaggcccagaggtaagtatgataagaaaacaaaaaattgagctgggcacggtggctcacgcctgtaatcccagctctttgtgaggccgaggcggcagatcacttgaggccaggagtttgagatcagcctgaccaacatggtgaaaccccgtctctactaaaaattacaaaaattagccgggcgtggtggcgcctggctgtaatcccatcttctcaggaggctgaggcaggagattcgcttgaacccgggaggcggaggttgcagtgagccgagatcagcccactgcactccagcctgggcgacagagcgactccgtttcaaaaaaaaaaaaattaataattaaaaaaaaaatcgcagggcaagtgggcgcgcttgtagtcccagtcacttcggggagccgaggtgggaggatcgcttgagccagaaggtcgaggctgcaggaagccatgatcacgccactgccctccagcctgggtgacagagtgagaccctgtctcgaaaaataccaaaaaacaaataaacaaacaaaaaaccaaaaccaaaaaaacaagccactgacagttcttgggtatggttgagactcgagatgagatgccagtggggtgggcagtagaaagtgcagaataaaatgtacatttgaactgagtcaccctgcaaggcctgagaggccaaggcttcactgtgagtgggagctggtaggcttagcagcagagggaaaagcagcgtcgagttttggaggtcactcgacttaggtaagaacagactgactaactgctaggcattttcttcctttcgttcaacaaatatttgtggagtgcctattacgtgccagaagctgttctggacactgagaaacagggatgaagaagaaacagatccaagccttcctgagagtaacctccccaggtttcatggatgaggaaactgaaggtcgtcctgactcaggctcatggctccgaccccggcttctgtggttggagggcagcaccttacttagactcccagcgcacgtggagcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggtggccgcacccaagcaggggtcgaaagcccgggtggatgcggaacaaggatatgataggccttaagggtgggggatacctctgggctcgaaatcggcgggcggtgcaaaactcgaggtccagttctcggagcccatagagccaaaaaagcctcagcttgtccggggcgggttcttgaaagccggaaagcggctgagtaccacgcggcttgcatttttctcttgggacgctcgagaggtgggctccgtgagggcagctgctgcctgcagattatagggagccctttgcgcatttattaagaagctactggtgtatctcgggctgcgctaggcacggcgcatgcaaagatgaagcaggcagcatcccagcccttccgcacctcagacggtcagttgagtaggatccgccggtaccaactcctccttttaacaaatggggagaccgaaagctaggagacagtcagggatctctaagttcccagtgagtaggaggcagaggtgaggtgtagaactcgtttttgcatgtctctcgcctctagacgcacccttccctcatcccatgccctcccacctccgcccctacattaaaggtagcattggatcccggggccgttcagtgaagctagcaggtgtccgcaggaactcccttccccctgccaggctagaaaccttacaaggctgtctagaaatagcagtgatttgtaaggagagacccggctccagcttggtgactctgggctgactgcctgcctagaggtcctctcggatttttgccctttggagtggtgtcaaaactagacgtgatactttggggatgcagcctgtgatatttcctccagcgaatgcagtgcagggttggattaacaaggtggaaagaattcgagggttccaccaagtagctattaactctagggctgcaggcctcaggccttctgcagctatttctacactccctgtactgaaactatttcttcatactgggcctgacaggcctttgcaacaaggatcacggccgaagccacaccgtgcgcctccctcccggttggttaacaggccctggtttctagtattgcgatttaaagtctggcgctggctgcgcgccagacctgggaggctgccagctaggcttcacgttgctggcgtctgcttcggggcattcattaggtctgaagtctgaatcccagctccctccctctcacccactgagctgcatagctccagattgcctctgcttacgggcggggcttctcagccttctgccttctggcccgatgcccgcttcccaacggccggaggccgctagactaatcggcttcgccctgcgcgctgtaatgcgcatgcgcacgcgcacaagttcctgggcccgcccatcttccggacttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaaggtatgggccttcactcttcacagaccctgtcattaggcctttcaactctcttttggcaaccattaggttttttcccctccctttttagtcatctctagtgatttatagtggcaaatacccccaaaggaagtaaaatagcttaaaaaaatctcttggttaataaacattaaagaagctgtagtgacactaaatgtttttcctcctatagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggtaagtgagagtctaccacactggaagcccataccttgaccccatcctctacccccactcctacccctagaactgtattattacatttcatgtaacagtatttagatttatgcactcattcggataactttctgtgaaacaaacttttgaaatatgataatacaccaaaagtgtatctgaaattaaaaagaatcaaaggttgtcaggctggagacccagttcctaaaattcattattctgtattaacatgcatggattgactaccaatgaaaaggaagggtccatgattttaaatgagccaaaattcttttaaagtgatttttgaattgaaaatgacaattcaaaaattgtcatttattggtaaaattatatgggaaatcataagttctcccactcaaatctcattgcccctgtgccttggatagcaattttgttatcaattatggagctaaaatttaattagaaaaaagaaattgtgagtaaagcactccttattacactattgaaagctgatttatatttaaaagaaattgaggcagcttacaacattaaaatgtctgaggcggggcacagtggctcatgcttgtaatgccagcactttaggaggctgaggtgggtggatcacgaggtcaggagatggagaccatcctggctaacacgatgaaaccccatctttactagaaatacaaaaaattagccgggcgtggtggcatacgcctatagtcccagctacttgggaggctgaggcaggagaattgcttgaacccaggaggtggaggtggcagtgacccgagatagcaccactccactccagcctgggcgacagtgagactccatctcaaaaaaaaaaatctgaagttaagatgtggagtgtctaataaaagtaaaatgatgaattctgggttctaaatagaaatggattcaagtgagaagggactaaagacagaaatgagctatgaaaaggcctcgtaacaacacaggtgactctacatatgttcttaggaaaggccacataatacaccaacttttattccttacccactagatgagaaattgatgctgttttccccacacctacaaaccgcctatgttttttctctgtgatggcctctggctcaggtgtgggtaagaagagtaactgacactcattatattgtggatgatttagggatagatctgcagcttgaataacttttggtaacgatagaccacatccagttgtattaaagctgttattggtgctcctggcctgaaatggacctatgaactttgagttgcaactataaggatattttttgccagtattatacactgcacaaacctatttatccataactgttagtattggttcatatatggaatcaaccagggaatagttcagattccatctctgaaagatgggcggaaatcagactttttaactttttaagtttttttttttgagacggaatctcgctttgttgccctggctggagtgcagtggcacgatcttggctcacttgacctcctgggttcaagtgattctcctgcctcagcctcccgagtagctgggactacaggcacccaccgccacgcctggctgatttttgtatttttagtagagacaggccttcaccatattggccaggctggtcttttttttttttttttttttttttttctgagaaggagtctcgccgtgtcgcccaggctagagtgcagtggcgtgaactccgctcactgctagctctgcctcccgggttcataccattctcctgtctcagcctcccaagtagctgggactacaggcacccaccaccacgcctggctaaatgtttgtattttttagtagagacggggtttcaccatgttagccaggatggtctcgatctcctgacctcgtgatccgcctaccttggcctcccaaagtgctgggattacaagcgtgagccaccgtgcctggcctggccaggctgtcttgaactcctgacctcaagtgatgtgcccgcctcggcctcccaaagtgttgggattacagatgtgagtcactatgcccggccagaacatttcttactaatttcaagtcttgatgctggtcaatatcacctagttaaatgaataacaacctaaaattggtgtgtaggatggaatttgagagagtagacagagcagttttatataattggaagttattctagcaactgccagtccagtgttctgcttccacatctgcagtggtggaactcctatagagctcgcttcagtggggagacagggctggagagagggtcagtgctatctatgtagggtgtaatctgtaagtcagcttttgaaatggggtgccctctactttgaatatctcgatactgtactaataaagtaacagaactctcctatgccagaaatatagaaatttttcatgctcttctaaaaatctagaagtggcaattttccatttaactaaagatttgatgtcttttaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaaatgttttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgtttgttaagtgtaaagctgtctctgcttaaaaacaagtccccctaccaccaccaccacacacacacacacacacacacacacacacacacacacagaaattgcctgttcctgggctgataggacaccagttaagtagaaacaggagtatggaagagtgtgaacgttgagcttggggatcaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccaggtgaggcttttgactgcataaaaattgacaagctatagtaaaactgatagtatatgatatatatattatatatattttaaatattttgaaatattttaaaaaatacatttttaaaaatattttcgaatattattttaaaatatatatatatattttgaggcggagttttgctcttgtcgcccaggttggagtgcagtggcgcaatctgggctcactgcaacctctgcctcatgggttcaagcgattcttttgcctcagcctctcaagtagctgggattataagcgcctgccaccacacatggctaattttttatatttttagtagagacagggtttcaccatgttggccaggctggttttgaactcctggcctcaagcagtccatctgcctcccaaagtgctaggattacaggcgtgagccaccgtgcccagccacgcatatttattgattcatttatttttcttttttttttttttttttttttgagacggagtcttgctctgtcaccctggctggagtacagtggcttgatcttggctcactgcaagctccgcctcccgggttcatgccattctcctgcctcagcctcccgagtagctgggactacaggtgcccaccacgacgcctggctaattttttgtatttttagtagagacggggtttcatcaggttagccaggatggtctcgatctcctgacctcgtgatctgcccgccttggcctcccaaagtgctgggattacaggcgtgagccaccgtgcctggtgattcatttatttttcatgtttcatttcccttctaaggagatttgtgtgtgtgtgttttttgttttttaataattttaaaacattaaagggaatacaatgcctttaaatgtagttggagcttaaaattacctgcccaagatcttggataagggataagtttgtgaataattgttattctctttttttttttttttttttttgagacagtctcactttgtagctcaggctggagtgcagtggttcgatcttggctcactgcaacctctgcctcctgggttcaagcaattctcctgcctcagcctcccaagagctgggattacaggcacgtgccaccatgctcggctaatttttgaagttttagtagaaaggggtttcaccatgttgcccaggctggtctcaaattcctgagctcaggtgatccatctgcctcagcctcccaaagtattaggattacaggcgtgagccaccgtgcccgggcccataattgtctcttagttgataaacagtttattttcataaaactgttactatactttttttttgagagcatgtctcactctgtcgcccaagctggagggcaatgggatgatcatggcagctttgacctactaggctcaggtgatccttcttcctcagcctcttaagtagctaggactacaggcgtgcaccaatatgcctggctagtttgttaaaagtttttttgtagagatggggttttgctatgttgcccaggctggtcttgaactgctggcctcaggcagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtggtaagcataagttattttctttttgtttttgaaaagattatataaaaagtcgatgggcattatattattcaattagagcctaatcaaatatccattcagtaggatggaatggtttcccgaaatctagcattttgtataattatatgttaagaattgttaagattgttgccattttatatggcattttatggcgagggggacgggaaatgaaatttctcttcttaccatggatatcttaagactgtagttcttaggatgtcttcagtcatttaatatcacagctgtttatacctgacttgtactgcctggccctgaaaagatgagcaaatccaaatgcacaaaagttatattatcacagttgaaaaatgttatgattaggttctgtatgctaagaaaaccccccttatgttctcatactatctttatatttcaaatatacatgggttaaacatttcaattggctagagaaacaggttagaatacagttaaaattcttagttttacataatgtaagtaaatgaaaatctaatctaaaagtgagtaatgactacattagtagtcttgaccatctaccaaaattgagtattcttcctccgaagataagagaattaggaaaatgaatcacaattactaatctgttggtacatgaaaataaatgtagtctgtactatttcttttagtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaaaaaaagaatgtgcctcaccttgcaaggcccaggccctaggatcacttgagctcaggagttcaaggccagcctgggcaacagggcaaaaccctgtctctacaataaatacacaaattagccaggcatggtggtgagcacctgtggtcctagctacttgagaggctgaggcaggaggatcgcatgagcctgggaggtcaaggctgcagtgaagcgagatcctgccactgcactccagagcctgctagcctgggtgacagagtaagagcctgtctcaaaggaaaaaaaaaattattgaaatagggaagctttcaacttggtggcattatttacctttgtggtcctgtgtggacctcaggtctatagaattaaaaaatgaatcatagccgggcatggtggctcatgcctgtaatcccagcactttgggaggccgaggcaggcagatcacgaggtcaggagatggagaccatcctggctaacacggtgaaaccccgtctctactaaaaatacaaaaaattagccgggcgtggtggcaggcgcctgtagtcccagctactcgggaggctgaggcaggagaatggcatgaacccggtagttggagcttgcagtgagccgagatcgcgccactgcactccagcctgggcgacagagcgagactccgtctcaaaaaaaaaagaatcataatctttagttcataacatattcttgtgattggtcaagcaaggccctcttgtttgtatttgtttaattaaataaaacctgtgaacccaccacccagctcaagaaagaaacacaatatctgtcaaataacattgttgaatcagaatttagtattctgctggtgtttggaaataagtggattctgtgctctttcccccagctatccctctgtccccctcacgctcccacttgagataatcctgagttaaggatgctatgttatcttggatttctttttaaaattcaatattatatttttaagaattatccaattttttttacaagtagctatagtttattttttgatagctgtgtaatattccattgtatcagtataccatgatttatccattcttctgttggaggacattggaaagattgtcatgtttttgctgttactaacagtactgttaatgaatatccctgtacataatatcctagcatacatgtgtgcaagggttattcttggtataatgcaacattgtggcattatttactgtaaaatgtgtattaatgaaaactttgtttttctttctttctcccaccctgctttttctgcctttacctatggtttcctatcatacagtgcttatgaggtgatcaaactcaaaggctacacatcctgggctattggactctctgtagcagatttggcagagagtataatgaagaatcttaggcgggtgcacccagtttccaccatgattaaggtaggtctatgtagtgatacgctgcatttgaatgctttttgctggctttttaaaaaagattcttctgagaaagattaatacaagtcttccattactgacttaagtgaaataaattaatgtacccacagcttaccttttttgaaagaaatggttgagctttaggattaatgtccattaggcctgttcaacacatagatacttgataatttgactacaaaaaagtcttgttcaattatgctgaggtaggtggaagactataaaagaaataaactatttctccattggggaaaatagaaattatattcaagttagcattatgttactatttttaatgactttcttttatactattaattaaatcataactgaacacctggaaaggaatttctacttatcaaagttttttatttttttgagacagtctccctctgtcacccaggctgcagtgcagtggccgatctcggctcaccgcaacctctgcctcccaggtttaagcgattcttctgcctcagcctcctaagtagctgggactacaggtgcgtgccaccacgcccggctactttttgtatttttagtagagatggagtttcaccatattggctaggctggtctcgaactcctgaccttgtgatccacccgcctcggcctccccgaatgctgggattgcaggtgtgagccaccgcacctggcctcaagttgtattttaaaatcttcataattaggccacacacagtgactgacagctgtaatgccagcactttggaaggccaagggcaggagaattgcttgagcccaggtgtttgagaccaccctaggcagtatagtgagatcttgcctctgttaaaaaaaaaaaaaaaaaaaaaaggccatgtgcgggcagctgatgcctgtaatcccagcactttgggaggccaaggggtggatcacctgaggtcagtagttcaagaccagcctgaccaacatggtgaaaccctgtctctactaaaaatacagaattagccaggtgtggtggcaggcgcctgtaatcccagctacttgggagactgaggcagaagaatcacttgaacccaggaggtggaggttgcagtgagctgagatcgcaccattgcactccagcctgggcaacaagagtgaaactccatctcaaaagaaaaaaaaaagcggctgggctctgtggctcatgcttgtaaccccagcactttgggaggccaagaggtggatcacctgaggtcaagaatttgagaccaacctggccaacatggtgaaaccccatctgtactaaacatacaaaaattagccaagtgtggtggcgcacgcctgtagtcccagaaggctgaagcaggagaattacttgaaccctggaggtggaggttgcggtgagctgagatcgtgccactgcactccagcctgggcgacagagcgagactctgcctcaaaaaaaaattaaaaaaaaaaagctttataattatagagactgtaagtcttgggaaacctgggaatgcatagacaaaatgtgagattttttttttttttcatttcatcttcagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgcacatttttctgaaaatacaactgtgacccttatccaggcctgaaaaccatacttgtaaaggttaactgaacaacattattgtcattcccaactccaggatctttttccaaagattctttcctgagagctagttaagggaaggaattatcttaaagcctggttgtccaatcttttgctttccctgagccacattggaagaagaattgtcttgggccacacattaaatacactaacatgtgccagctgtggtggctgacacctataatcccagcacttggggaggctgaggcgggtggatcaggagttcaagactagcatggccaacatggtgaaaccccatctgtactaaaaatcgaaagatttgccaggtatggtggcctatgcttgtaatcccagctacttgggaagctgaggcacaagaggctgaggtgagaggatcgcttgaaccggggaggcagagattgaagtgagccaagatggcaccactgcactcgagcctgggcaacacagcgagactgtctcaataaaaattaaagaaattaacactaatgatagctgatgagctacaaaaaagttcatgatctggatacctgctgccacctaaagagtcctcacattcaaagggttggacacagctataaagcgtatcgttctgtggatttttagtgtattcacatagttggcaaccatcaccagtatctaatcttagaatataggctgggtgcagtggcttcaaattcccagcactttaggaggccaaggtgggtagattgcttgagcccaggagttccagaccagtctgggcaacatggcaaaagcctgtctctacaaaaaagaaattagctaggcgtggtggcaggtgcctgtagtcctagctgcacaggaggctcaggtgggaggatcccttgaacccgggagataaaggttgcagtgagccaagatcccaccactgtactccagcctgggtgacagagtgagaccctgtttcaaaaaaaaaaaaaagaatattttaattagcacaaaaagaggcctgtacttaatcctgtagccttttgtaaactttgagtcaccttcagtctttaaaatttttaaatttacattaattttatattatttgatacaataaattagtcaataccaacatgactgaaaaataatatttaagtgaaatagactgattctattaatctttcatgaattttcaaatgcaatcttgtaaagtttccttacttatgggcaaaataaatgttccaggttcagtttgtaccttcctgccccaggcaaggaataggccaactctgcaaagaaacttgattttttttttccatagtaaccttgggaactaaattaagcaggccttatccccatctcacagaagttgccagttagtgtagaagcaaatgtgatgctcagaacatggttctacttcctttttttcccccactaaagcccat

SEQ ID NO: 17494 - DNA, 9406 bp, Human
gtatctgtagaaggtggagtcaccttttgtttgagtaaccgtttcacccaccctggctgagggtggccaggaactccccaagttgtgcattaatggaggtgggtcacacagatcctacatttttttgtttttgttttttttttttgagacgcagtgattacaggtgtgagccaccggatcctacatttcaaatgcataaaaatctagatatgggctgggcgcagtagctcatgcctgtaatcccagcactttgggaggctgaggcaggcagatcatgaggtcaggagatcgagtccatcctggctaacatggtgaaaccccgtctctactaaaaatacagaaagccgggcatggcagcgggcgcctgtaatcccagctactcggaaagctgaggcaggagaatcgcttgaacccaggagtcagaggttgcagtgagcagagatcacgccactgcactccaacctgggcgacagagcgagactccacctcaaaacaaaataaacaaaatactagatctggaagagatcttagggattattaaattcagacaacctcattttttatagatggggaaacaagcacagactccaagggtctcatccaagatcacacagttgcagatgctggctacaagtctcctgcctcaaccacctgtattaccccattcagggtctcaagaagggtctataagacactatccattgtgtttcgggctgagtccatagagacaaccacagacatgggggactctgcccacagggaaggcaagggctctggccatggagctggatgggaagactctgaagcccgaagacattgaatcctgtgcagggaaagagcgagggttttgtgtacaacacacctgcatacctggatgtgaatctcagctccaccccttcaccaactctgtgtggcctgggcaagccattctaagggaaccctccacactgcaactttcatgtctataaaatgggaataaccatgcattccttacaggacttttttggtgtgaggattaaatgagagaatatgttgaaaagtgcttggtaaatatattaatactatgcattccctcttctttgaatgacgtgacccaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagagggtgtccgcagagttgctgatcttcctgcccctgggggctactcttgcccagggttgggcaaagcagagtagctgggagtgtaaggagaggaccctcgtcccctcaccaacctcatcctctctccccctacccacaggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacaggtgggtctcagcggggtgggatggggcacggagtgggagacagatccatctaagggcctgttagacaaatgggggaataggcagggaggagggtctctaggcaaattccagggctagaggctgagacttagtgactgaggtgctgggggttgtggggctgtgacaggcagagggaggtgtcagataccaggacaagggtgttgtgaatgctacctcctgcccctactcttgggatggctccaagggctgaggtgtgaatccccagtgtgctccaggaatggggctgtgtgggctgggagtggtggctcacgcctgtaatcccagcactttgggaggctgagctgagcggatcacctgaggtcaagagttcgagaccagcctagccaacatggtgaaaccccgtctctactaaaaatacaaaaaaaaatttatcccagcgtggtggtgggcacctataatcccagctactggggaggctgacgcaggagtatcgcttgaacctgggaggtggaggttgctgtgagccgagattgtgccattgcaccccagcctaggtgacaggagtgagactccatctcaaaaaaaaaaaaaaaaatggggctgtaaggtctgctgggtggcctgagctgagcctgtttccctgcctggcccttgcagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagctgagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttggtgagaacccgttttctccttccttccccagcctgtcttgtcccatccctgcccctccacagagtgctagagatgaccccctccccagacttcttcctccctcaattagaaaaattgcagcaggtcatcagacccatgggcagcatcacctgtcctggtctggtcccctgagccctctctgagttctcacctcctcttcccagaccagggcagcccctttgcccaggagctgctggacgacggtcagcaagccagcccctaccaccccggcagctgtggcgcaggagccccctcccctggcagctctgacgtctccaccgcaggtgagagctctctctgggccacaacctcccttccccgaagtgtcccttgttccctctggctcccagcaccataactcaggccttctggcaggaacaggaacaggctgggaagtgtgtcctgagagccagcagcgtggttgagcagagggtgggccggcaggggacttactctgaccccgccccccagggactggtgcttctcggagctcccactcctcagactccggtggaagtgacgtggacctggatcccactgatggcaagctcttccccagcggtgagtcgagggaggtccccaagagggcgtcccatttagcaatgcacagggggcccggctcttcctgcagccttttcctgtagaggggctactctccctaactcccctcttgcccctccttgaccttccaccaccgtccccacagatggttttcgtgactgcaagaagggggatcccaagcacgggaagcggaaacgaggccggccccgaaagctgagcaaagagtactgggactgtctcgagggcaagaagagcaagcacggtgagctccgggggcacgtgggtcctccctgcgccgggctgagcggcttcctggggcactgcgggttgttgcaggtatcccttctcccgttttctctggcctccgcatggcctttggtaaggctgtgcacaagctgggggctctatggtatcggtcaccacctaattgcagagcctggcttggtggtcctggagaggaggaggaaataaggctcccagtgggaggctcatggtaccagagtcctgtccactgactccagtgtcctgtccactgactccagttctctctgcacttggccactgtcctgccctctgggacaccctcaatgtgaggaggcagctggtgggtcttaggtgggctgaggagaaaagcagtcactgcagtacccgcacagagggcactgcggggtctctggagaggcttgctgcatgctgtggccaagtcagcagtgcactggggcgggcagggctggctggccttgggtgagaggggacacctggatggcaaactgatggaggctggccttgcagcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtgagctggcggccaggaccctcacgatacagccggacatggggacaggcgctcacactcccaccgccctctttctggctgccacttggcttcttgcaacagggctgagtccttagagtgaggacaacatctgggttggtctacttcatggattaaatgacaacatggagaaagtattagcctggcagacagcagacacagtgcacttgagctagcagcaacatttcttgtatcgcctgtgaggcttgtcctcaggaaggcacctggagagtgggaaagggggcaggagccgtgcccacccagggcctggctttctcctcgttgaagcacttaggttgtttttctctgggcctcagtttcctcctgtgtccaggagtacactagatcatcttaagatcccgtccagccctaaaatcatgtacttactttttttttctttttcttttttaaatagaggcaagggtctctacgttggccaggccggtctcaaactcctggcctcaaatgactctcctgcctcggcctctcaaagtgctgggattacaggtgtgagccagtatgcttggccttttcttttttcttcttcttctttttatttttcgagacagggtctcgctctgtcacccaggctagagtgcagtggcacaatcttggctcgctacaacctctgcctgccgggttcaagtgattcttgtgcctcagcctccaagtagctgggattacaggcacctgccaccatgcccagctaatttttgtatttttagtagagacgggggtttcaccatgttggctaggctggtctcgaactcctgacctcaagtgatccgcccgcctcagcctcccaaagtgctggaattacaggtgtgagccaccgtgcccagctccctggccttaaaagtcatgtaatttaatgatcagaccccagtcacagccataggatacaaagaagcaaaggcaaagagccctgtgtcctgggcacggttacaggccagtgtagggaaagagcttctgcttgccagtgtgaagaacagaggagtttaggaagtgtgagtcaggctcagcttagtcaggcagagaccagtgggcatgggttacctgggggtaacgcgggccaggtgggcgggctggcagcctggggcccatttcctgccaaagcacctctgaccatccttctcttcacccaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtatagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaagcttgtgtgtggatttctggaaatgcagcttgctctggagaagcaaggaatggtggaaaaggagagtggggaagttgattggagaggaaagtgaggtcatgcgagaacccagaatcctggagccatttggaaaaaggcttttacttacatttcccttctgaagtgtgagccagttagacaaaggggatgcgggccagggcgtaggtctagcctcagaagctggggaagctttcacagctacttagtctaaaaatgaccccatttcttggaaattatgcattagactctggtctagtttccctagccacaatatctcggggtccttgcacccttaaaagaggtgacccagctgggcgcggtagttcacgcctgtaatcctcgtactttgggaagccaaggcgggaggatcacgaggtcagaagatcgaggccatcatggccaacacggtgaaaccccgtctctactaaacatacaaaaattagctgggcatgctggcacgcgcctgtagtccgagctactcaggaggctgaggcaggagaatcacttgaacccaggaggcggaggttgcagtgagctaagatcatgccactgcactccagcctggtgacacagcgagactctgtctcaaaaaaaagaagagaggtgacccagtgtggcctgaagtcacctagccaagaagtgggggaggggcctctggagcccgggacatgcttgttcagcctcccttgactcccagcctcttcagcttctaaaggagatcctagcagggaggagggctgggaatatggcgctcagccccttcaccctcttctggagggc

SEQ ID NO: 17495 - DNA, 40877 bp, Human
gaataaagtttgcttctaagagaagttactatttattcctaattaaatggggaggaaagtctttgaagaggaacctctactttactttttataccgtcatggctggaaactaagtttttaagatttttctggggttcccttggccgaggtggggagtgggagggctgtccagtggtagggacttaggatttttagtttacagtagtaggggaaacactctgtaatctaatacataagtaaatgatgtattagaatatggtaaatataggcaagtagacccccactgggattagcagtggtggaaatgtgagagagggcaaacaggtgggtctagatgaggtgtgagcagactcgaggggcacaggagttagtcaagccagtatctgggggatagtgcaggaatagtgaacagctagacaaaaagtcctagggccagagaaagcaaaagcataagagatggaggccagagaggtaatctgggtggaaggctgcagcctctcaggatccctataggtgctttggcttttgttggagagacactgaacagctttgggcagtgaacgtacctgacaggtttcctgtttgtttttgagatgaagtctcgctcttgtcccccaggctggagtgcaatagcgcgatctcagctcactgcaacctctgcctcctgtgttcaagcgattctcctgcctcagcctcccaggtagctgggattataggcgcctgccaccatgcctggctaatttttgtatttttagtagagacgcagtttcagcatgttggccaggctggtcttgaactccagacctcaggtgatccgcccgccttggcctcccaaagtgctgggattacaggcgtgagccaccgcgctcggctagacctgacaggttttaaaaggattactggttgctgtgttaaaacagactgcaggatggcttaggtagccagtaggtttttttttttttttggagacgtagtcttgctctgttggcctggctggagtgcagcggtgtcatcttggctcactgcaaactccgcttcccgggttcaagtgattctcctgcctcagcctccggagtagttgggactacaggcgcccaccaccacactcggcttttttgtatttttagtagagacgggtttcaccatgttggccaggatggtctcgatctcttgacctcgtgatccacccgccttggcctcccaaagtgttgcgattacaggcgtgagccaccacgcctggacgggtagccagtagtttctagggctggagagatctaggatgagagaagtttccacattcctgttacaggctctctaaggcttcagctcctttttctaggactaagctggatctcaagtaaacactagagagggggcagctgaagctccaggagtgtgtggggctccctggggctggatggcggtggcgggcaggcgagctgggctgtgctcgggtgtgttacagtaaagacgcccagcttggcgctggcccggccttttcacggttttaggctctacagagagcggctgcagagctcacccggctggcaggagccaccgaggccggacacgtgggcgacttattgaccaagtggggaggaagcagccccgcactgctctcccgactgcggaccaccgttgggctcctgcgcatcctaagccccaccgcctcacctccagtccccacagcgttcgcgctcccagccggggtaagcggaagaaaacaaaggcccggctccatcagggcaccaatcccgctcgtcggcctctttctcggcctccaatgagcttctagggtgttatcacgccagtctccttccgcgactgattggccggggtcttcctagtgtgagcggccctggccaatcagcgcccgtcagcccaccccacgaggccgcagctagccccgctggcggccgaggccggttgaagtgggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggtgggccgagcctccctgcttgcccggggcggggaaggagctcgctgggccggcctcagggcctgagcggccgggcccggatctggggcaaggggcgcggcgagcagggccgacgcctgggtgttcccgtccccctttcctcgagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatttctggtttttgtccccagtagactacaccctcatttggtgttatttttcacgtgctatctttaatacaggtacatccttcagtctatttgtagaacattcagttttcttcatcttttctttgccggtgctacattatttgaattattttgctacagaataacttctattatttgatatggcagatgtcactttttatatttagatatagcattcatttatttaacaaatatttgacgaccagttgtatatcagatagtgttctaggtgctggaggtacaacagtgaacaagctaggtgaagaccttgattttataaaacttactttttagtggaagagagacaatttaaaaaagcgaatgtacagtttttcacgtggagaaaagcactgcagaggaagatactagcagggcaagggatctgagtgcagtcagacctcatttgggtccagacttcattcctctatgtctctttcctttctacagaaagactgttagagaaaatggtagcattggtttcctgttgggagggaaagtgggtggtcatggtaagtgggtagagaaagacttcacagtatactgtttttgtacattttgagtttttttaaaagcgagacttgagctattctagctctgataatatggtgcagtatttgttatgttagttgtagtctttctgggcagtttttacatccccatgagccgttaaaaaaatacctgaacctttaattaggggaaataaattggaaaaatacatttcccttcacttaacattatcttagtttctctttttttttttttttttttttgagatggagtcttgctctgttacccaggctggagtgcagtggtggcgggacctcagctagatgcagcctccgcctcctgggttcaagcaattctcctgcctcagcctgctgagtagctgggattacaggcacctgccactacgcccggctgattttttggtatttttagtagagacggggtttcaccatgttggtgaggctggttttgaactcttgacctcaagtgatctgctcgccttggtctcccaaagtgctaggattacaggcgtgagccactgcacccggcctttttttttttttttttgaggggggggtctcactccatcgtccaggctagaatgctgtggcctgaacatgactcactccagttttgacttccttggctgaagccatcctcccacctcggcttcctgatcccgagtagctgggactccaggcacgtgtcaccaatgcatggctaatttttaaatttttttgtagacacaatgtctcgctgcattgcccaggctggtcttgaactcctgagctcaagcgattttcccacctcagccttcaaagtgctgggattacaggtgtgagccactgcacccaaccagtttctctctgcaaactagggaaaaaatttacgcttagcagatattgagggctgattatttctatcacagaagcatttggctatagaatttcagggtttagtaaacttgatttacactgaatttttaggtgcatatcagtaaatctacgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaaccacagttacttcatctgtaaaatagggatgtatgtatggtaacgattttttaaccacaacttcccaactctaagatggtctgaaaagaattttttgagtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctgtgagaccttaaagggttgattgagtaaggatcacaggtgatgtccgcattgtgcttggcatggagttaagtgcttgataaatggtggttatcaatctgattatgtaaatttatgtaaattcagttctcaagtttgtggtttttttcccctcctggagaaatctattctattttaaagtgaggaaggctccgtggagggctggtagctggtagctgttcacttgtggaactttcagcctgaggctggagccccttcctgggagtctggtcttgtcgtcttcctgaccacccccacacccttcctctaaattccctccatccctgtttttctcccgcttgcgagcttttgggagtgtgctgaatctcagactgcaatagataaacccaagagggacaggcaccagtagcctgagcttgctttctcccctggctcatgggaatcaagcagtagaaatttttagtgagtgttgttttccatagtatgcttactagttgtgtcttcctgttttgttcttggtgatttgaagaaacctgtttacaaggtaagggactgaaacaaataggtgacaggaaaaagagcagcaggggtacgagctggaggagtaagtggcttggcttgctctctttcagaatggagggctgtatggaaaggaggggtagtgttcttgaagagtgttggggtttaaatctagggggaccgtgtcttggcattgattgaaactcctggcttaacatcaccccgaaactgttagttggactgaacatgacatttggcagtgcagttaaaaacacttcctgctgtagcctggtaatggtcaggctatgtgaagagctgctctggagctcagtccagagcgggtattctgtttctttcactctgaaatcctgcctctcgatattttgagaaggaaggagttggtgaattgttttaaaatcctcgatgaatgtcttcatttattcatgacaccacttctgaatatatttatgtgccagacgctgaagtttactaatattatggtgcccagtaaatacttgtttttactaatattttttatggcaataaaatgactttttcaggattatgtgatttaaaagattgacccttttggcaaaatacgtattcatgataggaaatatatacaacatagttcacttaaacctcccaccagagcccagggttcactgttaccattctgaagtgactggaatttcctagaagtggatatgccatatttttttaaccactcctattggatatttgttttttatttttttgagatggggtcccactctgcagtgtacaatatcatagttcactgtaacgtgtatctcctgggctcaagcgatcctcccacctcagcctcctgagtagctagtcttcagtagctagactataggtgggcgccaccacagctggctttttaaaaaattttttatgaacacgaggtctcactatgttgcccaggctgccctcaaattcctgggctcaagtgattctcccaccttggccttccgaagtgcagggattataggcgtgcgccactgcacccggccctgttggataaatgattccagtctctcccaaaaagaactgttgtaagactgtggggtgaggggagggaagggacaaataggaacccgccgtattttccactccctgtgggcctaaaactgctctaaaaaatagtccatgaaaaaatacatagtacaaacagcaactctttctgatatgcttgcatttaaaatcaggctttttctcccttttggaaaaacacagtccttgtttgctttagggaagagtaaaggtcagtgcgctgcattgcattaatttcgaagggaaagatgagaagacatcttgaaaggaatggctggctttctagagaatagtagaggcttaataggtgtcatagaaaaaccagggttggacagtggtagtaaaacggcaaaacagattttattcagaaaaactactgcagtaagaggagagagacctcggtacagaactgctccactgcgaatacaaagaaaagtaggaattgatggcgggggagccggatgtcagtggatggaaaattattacgaggaaacacaggggtgtgcattcttgctgaaggcaggccagagttatcagacatcacctgagggatggagggggatgtggaacctaatcggctgtctagggtgatcagatactgaagttgggggattctggtcaaatcaatttagcaggattcttggtaaaactgggcgatgcaaagacagatgcgttgagtacaaagtccaggccttattgggaagaggatttcagcggagcccgagtagagtttggtctagggagactctgtcactgggaggacgagcgagccgctcggaagtgcgctgggttctcttagcggccagtgggttctggtgagaagggcaacagcgggaggaggcgccggtgcggagcgggaggccgggggcggggctgcggggctgcggggcgggcccgttgtgggtcggcccagcgcgtattcgagtagagggcgagcccgtcccgcctctcgtcgggcgcttcccagatctgcttgagtctatggaggaaaaactccgcggggtccgcgattcccatggccgcagccgcctgcggcaccaaggccatggccctcttcaagcgcaccttggtgctgagtcccgccgcggcgcccaggggcccgggcgcaggcaccgccccgcggggctgctgcttgcctcctgccgcctggccctgcaaggactggcctcggggagagggcggcaggctgtggagccgcctgccccagtcccactcccactcccactcccactcccactcctgctcctcgacgtctcccaccgccgtgtgtgttgtctgcccgcaggactcgctcagcagcagcctgaaaacttgctacaagtatctcaatcagaccagtcgcagtttcgcagctgttatccaggcgctggatggggaaatgcggtgagtgatggaggcagcgcctctggcttggaggaaagcttgtccgggacttttgagtgtgttggaagctaccttttgatatagcgctcagcgttgcagcctcgttgctgtggcttatccagaacatagcccggccctacgtgtttactttagaaagcccttccaggctctttgccatctagtagagtccctgcgggcccagcctttcagagaagaggggggagggggtgatgtttattaactttttttagtcttggcagctgaacctgcctgtgagcaggtcgtgtatttctcggcttcccttatccaactttgcatttctatttctagcatattgggttgattcttttgaagctgcctctgtgcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggatatccttatagttctttagagttaagggtgagatgggtttagaaagtggccaggcacaagttattttaaaataaaaaatctttggctgtttgttccaatatattaatagttttcccttttttacagcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacggtgagtggggttacgcatcttgtctacggactgttgtgttcataattgctaacgtggttgtccggtagcctccatacatgtggagaaaggttaaataagcattctgagggcagcataatgtgagggttaaaaactccggtagccaagactctgaagccaggctgcctgggttggaatctcaaatctcccacttactaaactgttggttacttacaaagactctctgtgcctcagtttcttcatctgtaaaataggggtaataataacacctacctcatggtattctgaggattcaaagaattaacgtaggtaatgctcttagaatgttagctactgctgttattatcagtattggaagtccagtgtttcttcctgtgggaagacgcagtcaaattttagtgttgtgaaagattctcaggctagctcacaaaagcctgccgactgtatgatgcagcctacctgtaacactgctggcctcttgactacccggagcctggtagcatgggactgctgctcacgatgggcagcagcctggcatgggggcggtgtctgttggcagctagggcgagcctctgccacttcacctgtgatcctgggcaagttccttatctgctttgtgtctccgtctcctcgtttgtaaagttagagctgagaggattaatttcgcacatataaagtacttagtgcctggtacagggtaagtattctgtaagtattagctatttggtctattttgttggagtaaagtgggttatagttaaaatcctaagatttttaaagtccctcaagttcatgtggacatctgcctaggtcctactatcctagaattcgcatgtcttatcacacaaataactgattcttccatatcttataaataaaggtttgatttagcaaagtcacatgttgtgtaatagctcgaagaagccctttttgtccacagttgccagagcttttggagaacagtccttatgttattgaaacaaacctaatctgtagctgagttgggagggagctaagtggacagagagtcctccacccaaacaaaagaatctttgattcttgggcataatgggagcaatatttaaaaaaaaaaaaaaaaaaaaaaaaaggaatgtttggggaagactcttgcggtgcaaaggctgtttcagattgctgagatcagaccttaagtaccaaagcccaaatatagtacaacataatacaaatgagaagaaaatagctgaagaataattcgagtttatacagtacaattcaagagaagaaagaaaatttatgacgactagctgggtgagaattagaactgtaaccctgggaaggtcctggtgatttgactctcacaggacacctgatgaccagaggatgggtttcctttgatgggaaatctgtggcgattcattgatgggcctctgaattctgctgaagcagaggaagtagtaataccccatttataatggaagtgcattctcacttaaaaacaactaatattattctagctggacctagcctctagaaacagccaaattacatttgacttgagtggattcataataattaaaaaatttctggggcatgggataaatgtgttaggtattgctaagtcaaggcagccctatcccctcagcagaagtgagggaatatgaaagtgtgtgaatgctaacataattttggggaatatcgccgtcagatttccagatgatattccaacatgtttgtgaaacttcagtgtcttcctgtgttcatacagtgttccagtggaaaaataatgcttagttctggaaggtttcagatgtgaacactgaactcatcgttttcttttttgggtagtagagttagagattccatcctcttgaaagcacagttgccccgggaagagtaaaagggagcagaaggcgtaagccaggcacggctgttttcactgttgttcaccttttgtatccttacgaatatgaagatgtactaagttgtgtgttttgcgtgcatatataattttaagctacttgagttgtaggtccctccagtctgtgattcagtttgagatgggactgtatgggaattaacagtgccttgtcttcttaagcagtgatttgtgtatgtgctgatatagctcagtatgtctttgaaaccagttgtctggggctaggcctgcaatcagcttttggctaagaggtcccaggatggaacaagtagtgtgaaagaggactgataccttggcctcacacacagtactgctcttagactggggcaagtgaaactcctcacttcagagtgccccattctaggccccctcactcccaaaggggtgagggatcactggggccatgggaatgtgcttgttcagctctcgtgggctctccttctgtaccacgttctggacatctggagttccttgccccaaatccctgagcccacgtctgcgtccgcacagtctatttcctaaggtcagtccatctcctccaggtgggaacgtgccaccattgactgtgcccttgggcctgagtgatggccaagggctgtgttggggagtgttgtggatggatcctggcaccgagggctgggatatcctctcaaatgaatgtgaggtgcctcccagtgctggagagagcgggattcaggaagcagtggaagggaagagcctgggatatggggatcagctgtctgtgccctgctgcattctggaataaaactctgagggactaagaattctaaattcaaacctgaatcaaccaggttgttacaaagataagtttgtcagtgcaggaggatacaatatattttacttaagttactagctcgattgatcatttttaaatttttagctacatatagtatgtgggcctccatttgtcctcttatcccaggccttgcagaatttaggaataagcctcaatacagtgttctaacccagtgacttccgcctcgatgtacagtagattgaacctgatcctttatactttagtgatcattagttgataccagttcaagtcaggctttctagaaatctcattgtatgttaggggttcgattagagtacagtcatgcatcacttaatgaatggccacaggatacattctgagaaacgcattgatagatgatttcatcattctgtgaacatcatagagtgtacttacacataccaagatggcatagctactacagacgtaggctctgtggtacaggccattgctccaaggctgcacatctctacaggatggtactgtactgaatactgtaggcaattggagcacagtggtaagtatttgtgtatttaaacatagaaaaggtatagtaaaaacagggtgttacagtcttaagggcccaccattgtatttccagtctccgttgactgaaacatcattatacagtacatgagcacgtatctttctcacctggtactagtggaaagctagaaggcttagaagtctacctgtaaacatagcttaagtaataatacagccttatttttaaatgataatagcaataatagtgttcacttattgagcattttactatgagttacttactaaatatatttcatcgttaatttactctttgtgttatttgatctataacatcgtttaacagggaaattacctagtacataatgtactgttatctacattttatctagatgaggaaactgaggcacagagaaattaagtactttgcctaggattacccgtgaagttaagtgacagaatcaatgaatctggaaggtctggcttcagatctcttgtgctgagtcactcgcatactttactacctctaaggtttctaatcagaggaatttgtatctgtattccctgctactcttaccctctatgtgggatttggcctttctccattatccctgtgaactcgctctgggaccttccttcttgtacttggaaccatcagaaagtgatctgagaacatagaaatctactgtgttgtgaaacagaattacctggaagcggaaaaagccctcctggctcaattcacatgtcacggcttatggtcgtatccggggaacatatgaaactgggcactgagtgcggagtcaggaaagccctgtccatcctctgggtttctggggaaaacgtggaccccttcattgtcactttctcctgtatatttttgtttttacttttagaactgtacaattacgtaataaataataaaaagtcgttggaaggataggtgaagttcagaagtgaaagtgttttggaggagtctaagctccttcccaccctcattgacctttcctctctaataaatagaactggtctaaccaaggatctgtggaatgagcagagtccaacggagattcagggattctaataacctcttgtagaatcactggtttgtttcagccacaagaaggaattaccttttgacattggcttgaacagctgttgtgcaaagaaaaactttttggaaagttctggaagtaccagattgattttataggtttttttttttttttttggagggacatgggggtattgacagttgatgttaatcagaaatcctaaattatgtgtattcctggtatgttgcaatcagccggccacctggttttcctctgggctcttaattttaggtgtattccgaggaagtttttctaacttttctgtaaacacagaccaggtatattgcatactttcaatgtttaaccaaatctcttcactgtttgcagtattatctgtaggctctcatgttttaagacttcccatggtgtttttgtattgtattttgctaacctataaacaattctttgaacttaaaacaagatatttgggcagtaacaataaattttaaaaacatcaattcaacttttttacattagggcttggactatggaaaaagtattgggcagcatgcctcatactgagttgtttaatgaatttaaaagtatagccttaatagtgagagaaactctatagcttcataatataaattgggtaactaatgagataaaatggttggcagatctgctcactagaatctaagctcttcaagggtctgagtttttttttttctttttcttttattatactttaagttctagggtacatgtgcacaacgtgcaggtttgttacataggtatacatgtgccatgttggtttgctacacccatcaactcgtcatttacattaggtatttctcgtaatgctatccctcccttggccccccaccccacaacaggccccggtatgtgatgttcccctccttgtgtccatgtgttctcattgttcaactcccacttaggagtgagaacatgtagtgtttggttttctgtcgttgtgatactttgctcagaatgatgatttccagcttcatccatgtccctgcaaaggacatgaactcatcctttttttatggctgtgtagtattccatggtgtatatgtgccacattttctttattcagtctattattgatggacatttgggttggttccaggtctttgctattgtgaatagtgccacagtaaacatacatgtgcttgtgtcttcatagttggacgagttataatcctttgggtatatgcccagtaatgggattgctgggtcaaatggtatttctagttctagatccttggggaatcaccatactgtcttccacaatggttgaactaatttacactcccaccaacagtgtaaatttagtcctgtttctccacatcctctccagcatctgttgtttcctgactttttaaatgatcgccattgtaactggcttgagatggtatctcattgtggttttgatttgcatttctctgatgaccagtggtgatgagcatttcttcatatgtctgttggctgcataaatgtcttcctttgagaagtgtctgttcatatcctttgcccacttattgatggggttgttgattttcttgtaaattttttttaagttctttgtagattctggatactaccctttgttggatggataaattacaaaaattttctcctattctgtaggttgccttttactctgatgatagtttcttttgctgtgcagaagctctttagttgaattagatcccatttgtctagtttggcttttgttgccattgcttttggtgttttagtcatgaagtctttgcccatgcctatgtcctgaatggtattgactgcattttcttctagggtttttacggttttaggccttatatttaagccttcagtccatcttgagttaatttttgtataagatgtaaggaagggatccagtttcagctttctacatatggcaagccaggtttcccagcagcatttattaaatagggaatcctttctccattgcttgtttttgtcaggtttgtcaaagatcagatggctgtagatgtgtagtgttatttctgaggcctctgttccgttccattggtgtacatatctgttttggtaccagtaccatgctgttttggttactgtagccttgtagtatagtttgaagtcaggtagcgtgatgcctccagctttgttcttttggcttaggattgtcttggctatgcaggctcttttttgcttccatgtgaaatttaaagtagttttttccaattctgtgaagaaagtcattggtagcttgatggggatagcattgaatctgtaaattaccttgggcagtatagccattttcaccatactgattcttcctatccatgagcatggaatgttcttccatttgtttatggcctcttttatttcattgagcagtggtttgtagttctctttgaagaggtccttcatatcccttgtaagttggattcctaggtgttgtattctctttgtagctattgtgaatgggagttcactcatgatttggctccttgtttgtctgttattggtgtataggaatgcttgagattttttgcacattgattttgtatcctgagactttgctgaagttgcttatcagcttaaggagatttagggctgagacgatggggttttctaaatatacaatcatgtcatttgcaaacaggcaattttacttcctcttttcctaattgaataccctttatttctttctcttgcctgattatcctggccagaactaccaatactgtgttgaataggagtggtgagaggacggcatccttgtcttgtgcaggttttcaaagggaatgcttccagtttttgcccattcagtatgatattggctttgggtttgtcataaatagctccttattattttgagatgcgttccatcaatatctagtttactgagagtttttagcatgaaagactgttgaattttgtcaaaggcctttcgtgcatctattgagataatcatgtggtttttgtcataggttctgtttatgtgatggatgatgtttattgatttgtgtatgttgaacagccttgcatcccagggatgaagccgacttgatcgtggtggataagctttttgatgtgctgctggattcaatttgccattattttatagaggattttcgcatcaacgttcatcagggatattggcctaaaattctctttttttattgtttgtctgccaggctttggtatcaggatgatgctggcctcataaaatgagttagggaggattccctctttttctattggaatagtttcagaaggaatggtaccagctcctctttgtacctctggtagaattcggctgtgaatctgtctgttcctggactttctttggttggtaggctattaattattgcctcaatttcagagcctgctattggtcatttcagaggttcaacttcttcctggtttagtcttgggagagtgtatgtgtcgaggaatgtatccatttcttctggattttctagcttatttgcatagaggtgttgatagtattctccagtggtagtttgtatttctgtgggattggtggtgatatcccctttatcattttttattacgtctttttgattcttctgtcttttcttcttgctagcggtctatcaattttgttgatcttttcaaaaaaccagctcctggattcattaattttttttttttgaagggttttttgtgtgtctgtctctttcagttctgctctgatcttagttatttcttgccttttactagcttttcaatttgtttgctcttgcttttctagttcttttaattgtgatgttaaggtgttgtttttagatctttcctgctttctcttgtgagcatttagtgctataaatttccctctacactctgctttaaatgtgtcccagagattctggtatgttgtgtctttgttctcattggtttcaaagaacatctttatttctgctttcatttcgttatgtacccagtagtcattcaggagcaggttgttcagtttccatgtagatgtgtggttttgagtgagtttattaatcctgagttctaatttgatttcactgtggtctgagagaaagtttgttgtaatttctgttcttttacatttgctgagcagtgtttttcttccaattctgtggtcaattttagaataagtgcgatgtggtgctgagaagaatgtatattctgttgatttggggtggagagttctgtagatgtctgttaggtctgcttggtccagagctgagttcaagtcctggatatccttgttaaccttttgtcttgttgatctatctaatattgacagtgggatgttagactcgcacacaataataatgagagactttaagtctttttctaggtctctaaggacttgctttatgaatctgggtgctcctgtattgggtacatatatgtttaagatagttagctcttcttgttgaattgatccctttaccattatgtagtggccttctttgtctcttttgatcttagttggtttaaagtctgttttattagagactaggattgcattccctgcttttttttttcgcttggtagatcttcctccagctgtttattttgagcctatgtgcatctctgcacgtgagacgggtctcctgaatacagcacagtgacgggccttgactgtttatccaatttgccagtctgcgtcttttaactggggcatttagcccacttatatttaaggttaatattgttatgtttgaatttgatctgtcattatgatgtttgctggttattttgcccattaattgatgcagtttcttcctagcctcgatggtctttacaatttggcatgtttttgcagtggctggtaccagttgttcctttccatttttactgcttccttcaggagctcttttagggcaggcctggtggtgacaaaatctctgagcatttgcttgtctgtaaaggattttatttctccttcacttgtgaaacttagtttggctggttatgagattctgggttgaaaattctttaagaatgctgaatattggcccccactctcttctggcttgtagggtttctgctgagagatctgctgttagtctgatgggcttccctttgtgggtaacccgacctttctctctggcagcccttaacattttttccttcatttcaacgttggtgaatctgacaattacgtatcttgggattgcgcttctcgaggaatatctttgtggtgttctctgtatttcctgaatttgaatgttgacctgccttgctaggttggggaagttctcctggataatatactgaagagtgttttgtaacttggttccattctgtctatcactttcaggtacaacaatcatagcattggtcttttcacatagtcgcatatttattgaagcctttgttcatttcttttcattcttttttctctaatcttgtcttcttgctttatttcattaatttgatcttcgatcactgatatcctttcttctgcttgatcgaatcggctattgaagcttgtttatgctttgtgaaattcttgtactttggttttcagctccatcaggtcatttaagctcttctctacactggttattctagttagccatttgtccaaccttttctcaaggttttaagtttccttgcgatgggtcagaacgtgctgctttagcttggagaagtttgttattaccaaccttctgaagcctacttctgtcaactcgttaaactcattgtccatccagttttgttcctttgctggtgaggagttacgttcctttggaggagaagaggcgttctgtttttggaattttcagcctttctgctgtggtttctccccatctttgtggttttatctacctttggtctttgattttggtgacgtacagatgggttttggtgtgggtgtcctttttgttgatattgatcctattcctttgtttgttagttttccttctaacagaggcccgtcagctgcaggtctgttggagttgctggaggtccactctagaccctgtttacctgggtatcaccagtggaggctgcagaacagcaaatatcgcggcctgatccttcctctggaagcttcgtccaagaaggacacccacctatatgaggtgtctgtcggcccctactgggaggtgtctcctcccagtcaggctacatggggctcagggacccacttgaggaggcagtctgtccgttactggagttcaaatgccgagctgggagaaccactgctctcttcagagctgtcaggcagggatgtttaaatctgcagaagccgtctgctgccttttgtttagatatgccctgcccccagagatgcaatctagagaggcagtaggccttgctgagctgcggtgggctccacccagttcaagcttccttgctgctttgtttacactgtgagcatagaagtgcgtactgaagcctcagcaatggcggggaggcgcttcccctcaccaagctccagcatcccagcttgatctcagactgcttggctagcagcaagcaaggttccatgggcatgggaccccccgagccaggcactggaggcaatcacctgctctgccagttgcgaagactgggaaaagcacagtatttgggcagagtatactgttcctccaggtacagtcactcacgcctttccttggctaggaaagggaaatcccctgaccccttgcacttcctggatgaggtgacgtcctgccctgctttggctcaccctccatgggctgcacccactgtccaaccagtgccagtgagatgaaccaggtacctcagttggaaatgcagaaatcacccatcttctgcatcgatcttgctgggagctgtagaccagagctgttcctactgggacatcttggaagcaactctgggtctgagtttctgtttgttgccctgatgtatatccccagtgcctagaatgatacttgttacataggaagtgcttgatccatgtttgcacaaatgaatctttctcataatgaggtttctctaaacaagctgttctcccaaaaacttaaacccagctttatgttgaagcatctcattatacattggaaagatgaaatgtgtagtgagactttgaatcttcttttgaatctagaaacattagcatttttagaccattctattttaatatttatgaaatttatgaaataataagaaacatgaggccgggctcagtggcttatgcctgtaatcccagcagtttgggaggccagggctagtggatcatgaggtcaggaatttgagaccagcttggccaacatggtgaaaccccacttctactaaaaatataaaaattagctgggcgtggtggtgcatgcctgtaatgccagctcctggagaggctgaggcaggagaatcatttgaacctgggaggcggagtttgcagtgagctgagatcgtgccattgcactccagcctgggcaacattgcgagactccatctcaaaaacaaaaacaaaaacaaaaaaaatgtgtgacctaaattaggcttatagatgaaccattgcagtcatgattaattccgccattgtttgccttgtgatctttggtgccatgtctgtacatatttcatgatttctgtgtttttacggtttccatttcagatctcccttgagtttagaaatctggctgagaaataccaaacagtgattgccgacatttgccggagaatgggcattgggatggcagagtttttggataagcatgtgacctctgaacaggagtgggacaaggttagtctcataaaacagtgtctgtgtgtgatgtattagacagagctggcagtcctcatagtgaagctcagaacaagaaaagttgtccagtattttcagcccctctggttttacaattcatctgtttaggttgaatgtctcatcataaacagtttattccagagttaattccaaaccagcagctatgtaggatatcagccaggctaggagtagggtactggagagaagtgcttatctagacaaagggatgtaattgaccatgaagattaaaactacacatcaaaacataaggtagggttaggagtcttgcctatttttcataggaatggtgtttgtgagacttactcatcacttctgtggaagtaaagacattttatttatttattttaaagccagtcagatttagcaggcagagacatttcagacatctaaagtgttgatgtatttcatacctttaactgtgcttaaattaggatctccgaaaagatgctgctacatggtcactacgttagtgtaggtccaaggtcttgggcctcttaatttttcaaacctcaaaacttgacagcagttatctttggaactgctgatttgtgcttcctaagttaacagcatacaatgactgctagaaatcaatttctgcatttaaggtgaagttagccgggtactatggtttacctgtaatctcagcactttgggaggctgaggtgggaggatcatttgagcccaggagttagacacaagcctaagcaacatagcgagaccccgtctttcaaaaaattaaaaaatgagcagggaattggtggcatgtgcctgtggtcccagctactctggaggctgaggtgtgggaggattgcttgagcccaagagttgaaggttgcagtgagccatgattgtgccactgcactccaacgtgggtgacagagcaagacaccatctgaaagaaaataaagttgaagttaaaacttctggccaagaaccagcactggttatgatagtaactcattttctgttgtgcagatttattcaggaaacttaattttaggttgttgaatagaagttttgatcagataaaattgaattaaaaaaaattttttttgagacagggtcttgctgttatccaggctggtgtgtagtggtgtgatcacggctccccgcagcctcaacctcctgggctcaggtgatcctcccacctcagcctaccgagtagctgtaactacagtgcatgacaccataccaggctcatttttgtacattttttgtagagagagggttttgccatgttgcccaggctagtctcaaactcctggcatcaaacagtcctcccactctggcctctcaaatgttgggattacaggcatgaccagccaattatttcaaggagttattttttttcttctactttgggggaagatgaattatataagtctccattttaggagtatttctaccaaaagaactattatcttcaaatatatttttggatagtactatagatatactaatttttttttaaatttctagtaattcttttgaagattttgtatagctgtccaaagccaatttctgtctacctaatttcagcaagatttcactcttttcatgttacttttgtcccagaacaaatttcaagtgctttctcttcacctgtgcattcttccccctgattagtctctggctttgtattactttcagtcagagacgactttttttttttgagacagggtctcactctgtcacccagactggaatgcagtggcacagacaaggcagccttgaccttctgggctcaagcaatcttccttgccctcagcctcctgagtaactgggaccacaggcacgttgccaccatgcctggctaatttattttaatttttattatttttgagacagggtattgctctgtcacccaggctggagtgtagtggcatgatcaaggctcactgcagccttcacctcctgtgctcaagcagtcctctcacctcagcctccccattagctgggactataggtccacaccactacaccaggctaatttttgtaattttttggtagagacagggtttcatcgtgttgcctaggctggtcttgagctcctgggctcaagcgattcacctgccttagcctcccaggtgtgagccactacactcagccttttaaaattttttacagagatgaggtcttgctttgttggccaggctggtctaaaactcttgggctcaagcagtcccctctccacagcctcccaaaattccgggattacaggcgtgaacttcggtcatttcctaacttttacccttcctaatgacactccagagcttaccttctttacttttgcttcttaagttaactaatagacaattattgtatgtggatattgcattaagttgtcttaggatacccttttcagaggaggacagcttttgacaaattgctgtcgcggaaaaaaaaagtatttggcaattaagagttgcatttactgaaatctctgttgagagaggggaagttacgttgtctctaaaagaaaaactaaaaagaaaaggggaagttttagcaaagttgttaaagcctgacacttaagtcatactacctagttttgaactcttagcccctgccacagacacggcagccccttgaaccttcctgggttcaagcgagcctcctacttcagccccctgagtaactgggaccactggcctgtgtcactgtgcctggctaattttttttttttcctcacatgggcaatgttgggcaagttaaatcgacttctttgtgcctcagtttcctcatctgaaatggagatcatactgctatgtacctgatacaatgtttgtgaggattgaatgtgcagagttctttttttctgttgttgttgttttgagacggagtctcactctgtcgcccaggctggagtgcagtggcgcgatctcggctccctgcaagctccacctcctgggttcacgccattctcctgccttagccttctgagtagctgggactacaggcacccgccaccaggccagctaatttttttgtatttttagtagagacggggtttcaccgtgttagccaggatggtcttgatctcctgacctcgtgatccgcccgtctcagcttcccaaagtgctgggattacaggcatgagccatcgtgcccggctgaatgtgcagagttcttaaaacagtgtcaagaacataaaatagttatttgttctttcatataatgatgattttgagggcctgcggatcttgacatgttatcagattggtcaaaaaaagattaaaccatagttggtattgtcctagttcctgttaccagaatattccatctttcatcgttgccttctctcatagttttatgtatcaaaaagtttattgtaaagctaggccgggcacggtgtcttgggctggtaatcccagcactttgggaggccaaggctggcagatcagttgaggtcaggagttcgagaccagcgtggccaacatggtgaaaccccgtctctactaaaaataaaaaattagctggatgtggtggtgggtgctttaattccagctactcaggaagctgaggcaggagaatcacttgaacccaagaggcagaggttgcagtgagttgagattgtgccactgcactccagcccaggggacaaagtgagacttgatctcaaaaaaaaaaaaaaaaaaaagttattgtaaagctagacacggtggtatttgcctacaatcccagctgttcgggaagctgaggcagaaagattgcttgggtccagtagtttgagtctaacgtgggcaaatatatgagactccatctcaaaaaaaaaaataaaaaataaaaataaaaaaatgtttactagtttttttcagtagccttttattatagtagcagtacatgtgtattgtagaaatttggaaaatacaagtgaaaaataaaaacatcaaattcccgtcagccagagactgctgtgaaatgttttgagcacatccttcttgaatgttttttaaatcctggtatgtatatttgtattttaaaatcaaaatgcattcttacccattctcttttgaacctgcttttttgtagctaatgatctctagtgtgtccatttcagtaaaaattccattattaaagtgctttaaaaatcgtctcttacagtactgccactatgttgctgggctggtcggaattggcctttcccgtcttttctcagcctcagagtttgaagaccccttagttggtgaagatacagaacgtgccaactctatgggcctgtttctgcagaaaacaaacatcatccgtgactatctggaagaccagcaaggaggaagagagttctggcctcaagaggtaacagattcagggtattttgggggaaaataactttagacattctctgaaaaatcctttaactcttgtggttgcgggtgacagaaaaacaagtcaggcctcccccaggcagcataaggggatgtggaaaataggatagattgacatgagtttgcttcaggtagactggctgactcccaggattcacaccacgtaatcagtatattcaagccttgctgtccttgatttctttcagacggtctttctccaagtggtggatatggtaacaacccatgtgcactagcttaacaaaaagttcttaggaatggctttgttcggcctggcgcagtggctcatgcctgtaatcccaacagtttgagaggccaaggtgggcggatcacctgaggccaggagttcgagaccagcctggccaacatagtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagttactgttgctacacagctgagttctctggcctcacctggattacgtctacacagtacacacagaatggatttcccccaaagaaagaattctgcggcaggaaggggaaagggatggcaggtagacaaaaactccaggtgtctgtaataagggacagggtcgatctttaattaaaacatggacagggaacagaaagcttttgatactgattttgttcagaaggaaagtagaaaattttatgactgttccctgaatttattccagcatttaccttttgctttccataaaagtgtttcctgcagccaagtactttaaagttttaaaaagacgggtgaggctaagtgtggtgtctcatacttataatcccagtgctgaggccaggagttcaagaccagcctgagcaacacagcaagataccatctctataaaaaattgttagaaaatgattctgctgaaagagcaaaaataaaaattaaagaaagtagaaaaaataaaactaaatttaaaagattaactgggcatgttggcatgcacctgtattcctaggtattcgggaggctaaggcacaaggatcccttgagcgcaggagctcaaggttggattgagttgtaatcacaccactgcactccagcctcggtggcagaatgaaactgtctcaagaaaaaaaaaaagtgacagagggaaacaatatttgcaattcatagagcagatacagggttcatattcctaatattaaaaaaaacttctaaaagttaagaaaaaggccaactgccccacagaaaaatgggcaaggagataagaacaagattgttcacaggaagagacacacagatgattattaaaaatctgaaaagatgctgagtcttactcctaagaaaaattcacatttaaactactctgggggctgggcaaggtggctcacgcctgtaatctcaacactgggagaccaaggcaggaagatcactgaagccagggtatcgagaccagcctggacaacgtagtgagaccttatctcttaaaacaaaacaaaacaaaacaaaacaaaaaaaacagtaaaaattggccgggcacagtgactcctgcctataatcccagcactttgggaagcccaggtgagtggatcacttgaggtcaggtgtttgagaacagcctggccaacatggcaaaactccgtctctactaaaattacaaaaattagccaagtgtggtggcatacgctggtagggccagctacttgggaggctgatgtgagactccatttaaaaaaaaaaaatcaaaaattagctgggtatagtggcacacccctatagttctcgctccttgggaggttgaggcaggaggattgcctgagcccaggagttcaaggctgcagtgaaccatgatcacaccactgcattctagcagcctgggagacagagcaaaacccttgtctcaaaacaaacaaacaacaacaaaaaaacaaaaaacacttccctcagctcagacatggccttttaagtttcctaggtgactcgtgtgcagccagggttgagaaaccactcttgtcttacccctcttttgcagacacagggctcagagaagggaaggggattgtctggggatgtatagtgaggcagtggctgccttggaagtggagtctcagtctcccggctcctaggccagcccctgaccactgttccattgtctcccagacagaacatcagccacgggcatgtgatgcatgagcgtgagccacaccatcttgcacacacaggagcagagccctgctcttctcattcacttactttatctgtaaaatagcatcatttctaccacacggtggtggtgtgaataaaatgagatgaacttctagcatagagtgcttagtaaaggttctggacatttcgtagtagttgaatcatgccaaatgtggtcctaggtgattggcttcttttgctagcatgttttcagggctcctccatgctggggcattgcatcactgctttattcctttttatcgcctagtattattccactgtgtggatagaccacatttatccattcatcagttggaggatatttgggttcttcccattttttttggctatggtgaatagtactgtgtacatttgcatataaggttttgtgtagatgtgtgttttcctttttcttgggtctatgctgagaagtggaattgctggttcatacagcagctcgaaccttgtgaggagctgccagacgcttttccaaggtcgctccaccattttacattcccgtcagcagtgtgagagtcccagtttcaccagcacttgttgttatctctttttaactgtatgtatatatacttaacattttatttataataaatgtacataatagagaatttgccattttaactatttttaagtctattattcagtggcattaagtacattaatgatgttatataaccatcaacactatgtttccagaactttcgctagcttcagagaatcctctaaataatatcattaaaaatcatcaagccgaatcccactgttagaattaaaggttttatttcactttcaagttatcaggatccagggaggtgtaatacacttagaggatagactcagctcatttcccagctatgcctttcagcagcattcttaccagagtaggaatataatgttagtcattatttagaggcctggccatcttgagaaggtttactgtttagtctgcagtacaattataactgtttttgtatattgggttatttttttcagaagtaggccagtagctctaacaggagcctctttagcctgaattcgtccaagtagtgcagtgttgcactagttgtccctcgggacatgctccccaatacgtaactcacttccaggttgcaactggacacttactggtagtcagaaatagctattgcatggagcttaaaatgaacttgatcttcgtgaaagatgagtctgcagctaagagactttactgtatatcatagtgtttttttttgttttgttttgtttttgtttttgtgacggagtctcactctttcacccaggctggagtgcaatggcgagatcttgactcactgcaacctccgccccctaggttcaagcaattcttctgtctcaccctcctgagtagctgggattacaggcgcctgccaccgtacccggctagtttttgtatttttagtagacacagggtttcaccaccttggccaggctggtcttgaactcctgacctcgtgatccaccctcctcggcctcccaaagtgctgggattacaggcgtgagccacggcgcccagcctgtatcatagttcttatgcacaaagaccctttaatattgtttgtaaattctcccctatgcacacgctgacctgttccttaatcttcttatctgtctaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtagggaacggggctcctctgggtggatacggggctaaagggagtggggtaggagtaagggtggattttgctgtgctatattcaaggatatgattccttaaaaagacgatgactccagtttattacgctgggagtttcatagcacccgcctttgcttccagccaccaaactcagctcagccttgaggttaagcctgctccttttcagaaccttctttctggatttactattttctacagctatcctaaactagttaggttcttttcctcacagttaagtcaaggtctttggcttagatttatggggagtgctgggtaaaacctgggtgaagctgttatcattaaaaagtcttcattaagcacctaattactgctgtccttttcctagacccggcataaaaagaacctggtccggtagacctagcctctcagtatgctaggaacttacactttttagttgcctttaccaagtattgcagatactactgcaaataagtgaagaaagtaacagcatttaactgatttgggaacttggtttgatcttgttctaatgacccacttcgaatggtggttgaaagtaaaatctgtatcgccgtcttatgtttccatttacctagaaatactttacctttgagcacaggaaattaatccccttctggttgttctccccctggcattggttttaaatatataatgattatgtttgttgtaggaaaaatagaaaaacaactacaatagaaaattcttcccatatattattttgaaatacatatttccgatccgataatccattgctctagcatggaaaatgttggatttacttgtgtttgctttttccaaataaaatggaacttttgtggctacattatagaattgttttagactgcttaattctgtgtgttgttgagaaagggaggagtggggaaggtaaaaatcttgacatactttcttcgtgggtattttttcttgagcgattccatcttagttgattagcagttagcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatttagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagcaaggctgtaggttggagcccctcagtagaatcatagattttgagctgcaagatgatgcaggaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactaggttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaaaaaaaaaaaaaaaaaaaaaaaagtcttagagaccagaagtctctgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctattacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattaagcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacagttggctgagccctgtttttgtgaataaatgttatcagaacacagccacacccatttgcttctatgtcttctgtggctgcttttgcaatgtgacggccgagttgaggagctgcaacaggcgatgacttgtaaagctgaaaatattttttggcccttgaataagaggttggctgacttctgacttagggcatcagttgttctgttatcccagtaaaactcaaggcattaggggagaaatgttaatattaatacttaagttgatttgatttagggaaatctttgaagatttctaagtcttaagcagtagaacctgttaatggttttagtttcagcagtaaggacattttacaagtaaagttttaaatgaaaacattttgtatgaagccacaagtcgtctggcctcttgctggtgtccagatattaacactgatcctatttctccttgctgaccaagtctgtcctttgtagtaagaaaggaagaaacgttgactctgtccgatctctggacttagtgttgtagcgagcatgcacctggaagggacttgccagaggacctcctcatgcttctccagtgcttagtgggggcttggagtgcagccccaggtcttcacgagcagttggccacactgcagggccctcaccccactctggagcagcctctgcttcaaaccagcctggatgcttgtcagctggggagaagatcaacctgctattttgggatagaaataaatgctcagccaaacggccagaaacccccattcccctctctgccaaagtgaattccttggcagggagaagcttgttcgtgtctctgcacacttcctgtgccctcctgtggttaagtcagagaatcatccggctctttgagccccaggtgcctagctgctcaaggatggtccccagccagcagctgccaggaatcacctgggagcccattaagacatccagcccccacccaaacctatcgaatcagaatctgcctttttttcccaaatgatgtttttgctttaatggaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggaggttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagttcgaaaccagcctgacttatgtgatgaaaccctgtctctactaaaaaaaaaaaaaaaaaaaaaaaaaaaaaatcaaaagttagttgggcatggtggcaggtgcctgtaatcccagctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggccacctctctgctcctcagggccacctttcataaggctccttgaaggtccctcaagatcaagccaactcaacacatccttgataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttgagacttgggggcctaggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgcacatacttgggaggcttgtggaggagtggggagggaggcacagggaggactccagggtggttcatacggctccctgcttctgttcctgtccccctttgtcaagctgtggtctgtactgcgtgttccatcttgtttctaagctgcttttgcccagtctttccagcatttccctttcgtcatgttagtctgtgcctgtctacgtgaactatggtgacgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttatcattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagtacagttcgcttgaaagcctgcctgactgtggaaaagatggagctcaagaatggagttgatggcccagcgtggtggctcatgcctgtaatcccagcactttgggaggctgaggcggtcggatcacgacattaggggatcgagaccatcctggctaacacggtgaaaccccgtctctactaaaaaaaaaaaaaattagccaggcgtggtggcgggtgcctgtagttccagctactcgggaggctgaggcaggagaatggcttaaacccgggaggcggagcttgcagtgagctcagatcgcgccactgcactccagtctgggcaacagagcgagactccatctcaaaaaaaggaaaaaattgtaaaaaaaaaaaaaaaaaaatttcccccagcagtttttgttttctaaagttatcagtttatatattcaggtcttaagaaaggcaaaagctgtcttcaggtgattggcttgggggcagaacagtacttctgctcggggtttcaccttcctctctactccagtgcagcagagcttgtgatgtgctctcactgaggtgctcagtgcagcaaggaggcctgtggaccctcgagttgagaattggtgtactagggcattcggtactttctagaagccattaatgctacaggtactcataaagtctactcttctgcagcccatcgtggatggtggcttaatcattgaatttgagttgtttcgagctgcaacgttggatttgcattgttgtaagcacactttcttgctgtgaccactgacaccaaaattagtttgggcccagggagacttcagttaattggttcatttgaggcttagccctggactcatttgtcaccagccaagataacttgccacatggaatacagccagaccaggggtccccgacccccaggcctaggaccggcactaaaccttctgttacgtggcctgttaggaaccgggcatcacagcaggaggtgagcggcgggtgagtgaacattatcacgtgagctccactcggcgttagattctcataggtgcgattgcgcgtgtgagggatctgggttgcatgctccttgtgagaatctagtccctgatgatctgaggtggcagtttcatcccaaaaccattttcctccctctgtccttgggaaaattgtctttatgaaaccggtccctggtgccaaaaagcttggggaccactgagctagactcgacagtattttccaaggaattaaagcctcaaaacttggtttgagatttcagggtaggttgttaaaaatctgtgtgttgaaatctaagatttaattctgccaaagttcacgttaagacagaacaacctgctggaaagagatttggtctgagtggggcctgcggaaatcttctttcctgacttggtcattacctgtgggaccacttcctgagctgtgtggtttgggtgatctcagattttttctatctataaagctatgtgcttttttctactcactgagttgtagaaaggtattcgctctcattccattctgaagctctttgaaagcttgttttccttctaagtatcttctctactaaggttgccagatataataggggatgctgggcatggcggctcacacctgtggtctcagctactcggagggtgttggggctgaggcaggaggatcccttgagctcaagaggttgaggcagaggttgtggtgagccaagatcacgccattgcactccagcctgggcgacagagtgagactctgtctcaaaaaacaaacaaacttgcataactgaaaattcagaagtagttggccatcttgtatttctgtttggtaactctggcaacactaccctctactccccacttctaatataattttatagcatctctggcatacagtctatttggatccgacctaatggtgcaatattttgttttcctcagaggagcctctgacccatgtgaatctaggaccataaacaattagaatgcttgggagcaagagctttatatctgcatatgggaacttccggatccctgtgggcaagtgcagggagggccccttcttccatctactgagccatttcccaggggctcgggtgtgtataggaggaagagggcgagtcaggcatgttaacaaacattctaggttattcttggcagttttggaaacagttctaaggctgtggttctcagactttatatcagaattgcctgattgctgggaacagagactgatacagtaggtctgatggggtgcccaagaggttgcattcctaaattctcatgcagttttctaatcagggagcagctggaaaggtattgtgagcttgaatgtacctgggaaactacctgggg

SEQ ID NO: 17496 - DNA, 16007 bp, Human
agatcttgactcatgtagggatcagggctagggtcaaggtttagaccagggatcaagtgttgattaggttcagggtttatttaaggttagggctgggtcagggtcagggttgtgatagagactgggaccaggatcagaggttagagccaggggtcagagcctggctcagatgacctgaccccagggttggagtgccgcctgacacagaatgcacaggcactgggcaagaaggcagccaccctgcaggccctggagcagcaggcagctgagctgcttgggcacatgatgtgctttgccaccaataagtatgccacctgctaattactgtctatggaagccattaagaaggactgtgggatcacctgggtaactcaaagtggccctagagtgatccaggaatctcctggccttgggagaccaaagatcctactgagtgcccactgaccctgagtgacccccccatgtggccccacgatgtcccccagtggccctctgaccttgagaaagcagacagatcatgtaactccctgaggccatctagtgtcccagaccttgatacacctttatctctgagtgatctaaaactgtgagactacagtgctggcattctccactcaaaataaatagatggggcctggcactatttactggctcatgcctgtaatcccagcgctttcggaggcagaggcgggaggatcacctgagatcaggagttcaagaccagccaagccaacatggtgaaaccccatgtctactaaaaatagaaacattagctgggcgtggtggtgggcgcctgtaatcctagctacttgggaagctgaggcaggagaatcgcttgaacctgggaggcagaggttgcagtaagcggagatctcgccactgcactccagcctgggtgacagagcgacactctgtctcaaaaaaaaaaaaaaaattaaaattctcagtaatttctagtatccctgatcccccaggttgactacatgatcctcagggtgactggagacctctactccggatatccagaataactcccagcgatgcctaaagtccaacggattgactgacccccacccaaccctcacccaacccccacccccgccgcccccatgctcctttgtgaagtggggtgattcccctgaggaactatcatcagctttcttccctggatggcagctcagggcactccctgccgggactgtggaggcggcaggccagacccagccctaaagaccggaggaccccatgtttcccccagcttcccgttcccagggccctgggtggggcgcgccccatatcccccacccactttcctccttctctccccctccacgccgccgcgcacattccaaccccaggctcctgcgatcccggcaggccaaaaagtctggagcggataaatagccacaagatccggagtcgctcgccgtagctctggtccaccacccagagcctatttccatacagggaaacccgcagcacttctcgtgcctacttaccgtagtgactagtgggggaggcagtgacccccctggagctgtgcttcgggctgggtgtgcactttccccatctctcccccagccccattctgtccagtccctaggactacccgagagccccccacagccctgaataggggcatgtgttgctcctgcttgtgccctccagcctctctgttgatgctggagccctgggatcaaacggctgagttgatggtaatttccacggcgcccatgacgctgaggggaaaaggctacggtctccttggtccagagttggagatcccgaagatctctcatttgctcctgccatgcccccaacttcgtgagccctcttccaaggatagtttaaagcaccaaaccccttaccttcccctggccctcgtataggtgtgggcttgggggcacaataaagatttgtgggtgaagtggtctgtctctggttcctggggcgaaggcagtttccggagggaaggggtagggttggggtgggggcgctctccgcccggtgttgcgctccttcccagaatccgctccggcctttccttcctgccgcgattcccaactttgctcaaagtcgctggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcggtgagagggcctggtgggggctgggggttgtggaatgtgatggtaggtcctggtagttgcccttggggcacatgaggtggagccactggataggaactcagcggaactgactgagctactgtccccagtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggtgtggctggggacagggtgtgacgccgagtcagggtggggctggcactgcctgaggcactgattctaatccccatccaacccaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtgaggccatgggtggggcaaaagtgagcagggctgcccaccagtagctttgagtccttgacttccgattcctgtcccaggtatccctgcggtcaccatccagctggacctggaggctgagtttcatttcacacacctcattatgaccttcaaggtgcctgcatatctgggagcctgcccgaatcaccctgcttggctctccattgcccctggacagagcctcagctccttaacacagcctccttgagcatggatgcaggaggctccttcatcccttcacaccttccatttgcctccaggcctttgcacatgctcttctgcctttccaatcccaggctgggtcaggcgctgtctccctgagccccatgaaccctgagtctccccattagaggtggctacctttgctggtcattatctggcttccaccagtcacccccactctctgtgagctatttgagggcagtcttgggctgagcagggctcttgatggctctgggttgggcttgggtcctggtgcctgctgatcagctatgcccccctacccagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtgagggctggcatctgggctgggggctggaagctggggatgatgggcctgaggcaaggtccagtgtgactatgaactccctgcttctccaggtcatctatcgtgtgctggaccctgccatccctatcccagacccctacagctcacggattcagagtgagtgctccaccctttgagtctggcacagtccgtgtccggctagggactatttggggcctcagtaactattttgggtgcttcctagggcaggtgccaagcccagtttagctcgggtggcagtgtataggaggtctttcaaggtgaccttggcagctgagcccctgggtggacatggggcagcaagggcctgcctggtcagttggccccccttcccccgcctcagacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtaaggggcttcagacggttgggatagggctaggggcaggggcggacatggctgagcagtgctgacaacctacctgccaacctctataggtgcacggagcttgcatctgcaaacacaacacacgtggcctcaactgcgagcagtgtcaggatttctatcgtgacctgccctggcgtccggctgaggacggccatagtcatgcctgtaggagtgagtgagatcttggcctccatagctccagcactctgcagcctggctgtgccctgggtagaacctagagctagttggtcaagcccctaaaacccaggctgtatccaaagagtatgcagaccttgatgccccttgggaccccctcaatcctcctctgcagtctgctctgggtagggaaccagtatgatgctgaggccttgaagtccctgagcccctacccacaaattctggcctgtgatagggatctaaggtggcctacttcttacccttgtgacctggttcctcatgtggcctttgccctgcccttcctcccctgccagagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctgtgaggctgggattgggcacggggagagaaagctgagcctggggcaggaactagagagctggactgctgtctaaattgcaggaaattggggttaggggcttgggatagaacttgaccagggatccagggtgggatcccttaggcttaggagaggactggcagtgagctagttgagatagggtgagtgaccctgtatctctttttgccgtcagcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgtatgtgtctcctgccctaacttctatgctgacctttaacccctgtcctcttactcctgactcagctgaacatgagcactgccacagtttcccaaagtgctgatggttctccttccctgcaggatgtcaatgtaatgcacggggcacagtgcctgggagcactccttgtgaccccaacagtggatcctgttactgcaaacgtctagtgactggacgtggatgtgaccgctgcctggtgcgactggaaggggctggagttctaggggcatgatttgtccttagagcacagggctggggtgtcacatctatgccagtgggtgggtgctgagagcttaggatccagtcctggctgagaagcctcaggtctgggaggccaaggatgtgggccagtggtctggggggcatgttttcactgaggggtgattgaggctaagacgtgtggttgggatttcctgctgggtggtgatggggtctggaggtctgtttctggcccccagcaactcctttcgtgcagcctggccactggggcctgagccacgacctgctcggctgccgcccctgtgactgcgacgtgggtggtgctttggatccccagtaagtgttgtaaagggggcctgggaagggatggggaaagatcctgagcagaagagaaggttcttcttgagtaaccacagagttccctccaggtgtgatgagggcacaggtcaatgccactgccgccagcacatggttgggcgacgctgtgagcaggtgcaacctggctacttccggcccttcctggaccacctaatttgggaggctgaggacacccgagggcaggtgtggggcctccccctaagcagagggctggatgtgggtggacacgtctatgactggagaggtggggttatgggcagtaccttgttgaggggataggggtgatatctagctttggcaggagaaatggggtttggggctggctgtggcagaagaggcaaagcctcacctgagcctccatccctggctgcattatctcccaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggttagaccctgttatctaatctggagctgaacctctgggtgtgggagcatctcctccatcatcccgttttcccaggtccctgagcaatgggcagagttggaactgattgtgcagcgtccagggcctgtgcctgcccacagcctgtgtgggcatttggtgcccaaggatgatcgcatccaagggactctgcaaccacatgccaggtgagggcactggtggtagcactcacaatggcagggggttgtggggccagccctaagctccctgcagggcacctggaagaccccacagctcattcatctgttccttctttcaaatacctccagaatgctggttgccaggccctgttgggcatggctctgttcacagaaaggaagtagacagatcaaggcctgctctctcaggggtctaaggcccagaggccaaggcaggaattaatgggaaatcacctggtgtcactatcaggagggtccacagtggtggtggtagagggtggtagtggtggggttgtggcatcagagcactctgagcagggatgtgcctggtctgattaatgttttattacattttgggtagtatttgtttcatgtttcatgtttcttttttttttcttttcttttccttttttttttttttttttttgagacggagtctcgctctgtcaccaggctggagtgcagtggtgcgatctcgggctcactgtaatctccacctcccgggttcaagcaattctcatgtgtcagcatcccgagtagctgggactacaggtgcacgccaccacgcccagctagttttttgtatttttagtagagatggggtttcaccatgttggccaggatggcctcgatcttctgaccttgtgatctgcccgccttggcctcccaaagtgttgggattacaggtgtgagccaccgtgcccagccctgtttcattgtttcatgttttgtttgtttgtttgtttgtttttgagatggagtcttgctctgtcgcccaggctggagtgcactggcgcgatctcggctcactgcaagctccacctcccaggttcacgccattctcctgcctcagcctcccaagtagctgggaccacaggcacccgccaccatgccttgctaattttttgtatttttagtagagacggggtttcaccatgttagccaggatggtctcgatctcctgaccttgtgatccacctttctcggcctcccaaagtgctgggattacaggcgtgaaccactgcacttgacctattgcttttagtttttgaccatgtaaatattcaaacagaaggaaagagaataacatattgaacctggctgtgcccattatagacattttgccaactgtgacttgtgtttagaaaaaaaattcctctagaccaggcatggtggctcatgcctgtaatcccagcactttgggacactgaggcaggaggatcacttgagcccaggaattcaagaccagcctaggcaacatggcgagaccctgtctctacaaaaaataaaataattagctaagcatggtggtgtgtgcttgtggttccagctgcttgggaggctgaggtgggaggatatcttgaacccaggaggtcaaggctgcagtgagccaaggtcacgcactgtactccatccatcctgggcaacagagaccgcatctcaaataaacaaataaataaataaatcagaaaataaaaagaaaaaagatgagggattgaagaacaatttttgggatgggataaaagaacccaagtatgagtttgcagcacaatgggaaaggaaagccttggagacaaagagagagggggcgacatagtgttgatgaagaggagcagccattgtaggttgtaggtcggggtcagaggaagcgtgaggtggttgttgaggagaattggcaagttcttgggatttccaggctttatgagtatttccagtgagtctgcacaggtggatgtatgattctagagggccacctttatgagactattctgtgcagattctttgttgggctgcccagctgtttgttggcctagcgcagcccaacgcaacccagccatagtctctgctttggccaatggcctggttgctgggagaaggatgggggaggcccagatgatttgtacagggcccctagatgacccactgcacctgtccccactcgcccccaggtacttgatatttcctaatcctgtctgccttgagcctggtatctcctacaagctgcatctgaagctggtacggacagggggaagtgcccagcctgagactccctactctggacctggcctgctcattgactcggtgaataatctcctcttgcccacaccaaccaagatggcagggcccgtggtgtgggacttgagggatagcaggggtctgtggcagaagaggcaggcccatggtggtgccagggtgggcaggcttgtggcagtgctaaggcaagtgctctggcaatgcctacgtggtcccaggtctgaactgcgatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgagtgtctgtgatgtgggttgatggggcagaggtggggacccagcctgacttggcccaaccctcctccccacagcatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgagactggagcagctatgagtgggttggttggtgggcaggcttcccagggatgacacatttcttcttcctcctccctgcaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacgggtgagtggatgggggcaggcgtgggatcagggtgagttggctgggctgagcactcacagcttcctcttaaccgtgggcagggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgaggtatgggaccctcctgcagatccctggttagatggggccaggtgtctgtcttatctccagggcttagcctcttatagaggctctgaccctgccttgttcccaccccagttcacagggcagtgccactgccgtgccggctttggagggcggacttgttctgagtgccaagagctccactggggagaccctgggttgcagtgccatggtgagggagccagcggggccagggtagatggaggacttcccagaatgccccacagtgaccctaactctgtgctctgctctttcttgcagcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcacaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggtgcggaagggcctaagaatacatggtgggatggggcagaggcccagtggaccagggctgaagcctctctaaacacccccctctccatcattgcaggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgagttgttagccaactaggcaggtggaccagggtcagtcttcagctgactgtctgcctctgcccaatttaggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggtctgaccccatccctggcccctatccctgacacctggttttgatacctccaggttctgattcccccttctccccaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtgaggtcttcctaggacatcagtgggacaaggttatgggcatgaaccgtagatctgtgtaacctttggctcacccatggcaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcaggtgggttgaggcagagccagctggagaaggtaggggtggaagatgggcctccactgagctaccacgctaacctaaccctctacatctgcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccactgtgttgtctggactctgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgcggcggcctgttcaaggtcacgggccgtgccagtccctacccctagtgccccgcagcgtgccagcccactgatgccggcagggccgttacgctatgcctgtggccagcctcccacctgggagaggactggcggccagcgagggcaacttcgtgggagaggtggtggcgggctcggggttcagaggctgaagctgggtcgcagctcgaccggggcgctgatctgtggtcagtaaccccgcgctgccatttcaggccggctcgggtctctaaacagccccttacccgcctcgacgtccctggggcatgggggagggacgcgaccttcggctggggcctgggtgcaagaaggaggcgtcggtggcaggtgtcattaaagatccagcccaccagtaccacatctgacctgtagaagggtatcctgccatccctccttcctcctttacacacttaggggaacacagactagtcattatctgtcctgctactggttcaggccaggcttgaggctgccaggagtcctggatctgtggtcctccccagcctcatctcagtatctagtttcaagaccttcattttggaggaggaaacagtccagaatccactggtgggtctgtgggaaactgtagtggtccttgtggctcagagctcatgagtgaaggcatctgggaaggaaggtgataatttctgttccagtctcaaactggatgcccatcctgccttagtactggagcagggttgctgctgaagaggtagcgtgacatctagatacacttttcagtccctttctgcttgggacagcagctggggagaggactttctcttgaaatgaagaaggaccaagcagtacataggagcaggttcttgccaagggtgggagctggcaggaggcaggtggagtgccttagccccaggactttttctgggcaatggtagaacctgggttgagcctgtttacagccacagagcctggttctcctgcggcttgtctcctgtcctgccttcctcctccaccttctatttctccagtggtgactaagcagccagtgagagtgaaggaaaagtgagcaccctgctcggagtgccagccctgtgggctggagccgtggctcctctccagattggtggagtagcctggtcccaggccatgacttccttgacctggtgccccctcagtgaggctttcacctgtgtgggactgttatggtgggtatctatgaggcttggccagaagtggttgctgctacttgcattatttattacctcttcagaatatcctgagagtgtccaggggtacttaagagatgagaagatacagctctgtagcattagtgtcctgtgttgctgagccctgggtgtagctaaagagcaagttgttgggtcttggcagtgatcactggcttctttccattaggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaagg

SEQ ID NO: 17497 - DNA, 8485 bp, Human
  misc_feature (1)...(8485): n = A,T,C or G
tcaggctcagcagaccctgggttccaccattgacaaagctaccgggatcctgttatatggcttggcctcccgactcagggatacccggcgtctctccttccttgtaagctacatagccagtaagaagatccacactgagccccagctaagcggtgagacccctacctgtcctgccagttcgcaccaatgcctcccttcagccaagacccctgtcttccctttttgccaagtcctccagtttctttctagacacctagttctgcacaggcactgaggcatggaaggggtggcctatggtgagactgacacgggaactgtcagggtctgaggggggatccactctcgacacgtgcttctttcttccctgtgttctctagggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtgagtctttccccaggcatcgtctgcctccccagtcctggccatggaaaggagtggctcagtttccctcctcaggaagacccagagtgagggtgtgggttcccagaatatctctaaaggtggctttcctgaaccacatggtttggctttctgcaggtggaggctgctattaacaggcaccggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcagctccttgtgcctatgcttctaggagaggctcgggctgtgctgaagtgggcagatggcaaaatgatcaagaatgaagtggacatgcaggtgagcgtgcttcactaagctgaagctggcaaagactctggcatgaacagagcctggaatccactaagggataaaaggcaggaagagggctgggcatggtggctcacgcttctgatcccagcactttgggaggctgaggcaggaggattacttgagcccaggagttcaagaccagcctgagcaacatattgagaactcctctctacagaaaatttaaaaattagccagacatggtggtgtatacctgtagtcccagcaatttgtggggctgtggtgggaagattgcttgaatctaagagatcaaggctgcagtaagctctgattgcaccactgcactccatcctggagtacagaatgagaccctgtctcaaaatcaacaacaataaaaaaaggtgggagggggctgggcatggtggctcacacctgtaatcccaacactattgggaggctgaggtgggcagatcacctgaggtcaggagtttgagaacagcctggccaacatggtgaaaccccatctctacaaaaagtacaaaaattagctgggtgtggtggcgggcacatgcagtcccaggtactcagaagggctgaggtaggaaaatcgcttgaatccaggaggcggaggttgcagtgagcggagactgtgccattgcattccagcctgggcaacatgagcaagactccagtctgggcaacaagagcaagagcattttaagctagcagacccacatgagaagagatgggatgggctaggtaggttttttcagtcagtgctggtagataggccaggaagccttgggttggtgggtaggattagtcaggggctccttgaaagaggatactcctgcctctgcctgattctggtctctgctcaggtcctccaccttctgggccccaagttggaggctgatctggagaagaagttcaaggtagggatgggcatggccctgagtccctgagggtgaggtgaggtatggtgagacttcaggctggggaaggaagtgtctgaccacagggatcccaagaccctatccaagagaaaatttgatgccattttctgaagcacctggggcttctttcaggtggcaaaagctcggctagaagaaacagaccggaggacggcaaaggatgtggtggagaatggtgagaagcttgagactcctgtcacagcattcagctccctgacttctgaacctcctcagaagagtccttacaggctcctcaggcccttggcttactcagtaccctgacttctgtctcaagactgggattcctggtgtttcttttgttccctttgcccagagactggcatgagaggcctcagatgtctggctctagatatcttgtctctggaattgagggaataggggtctactcagttctgttctggctgtaggatatggtaaatgtatctagaggacaagttttccttgttttgttccccacaggcgagactgctgaccagaccctgtctctgatggagcagctccggggggaggcccttaagttccacaagcctggttagtgggcatgtcaaaaccctggggagggctggatcttggcagcagctcctatagtcaggcccctggggtcagaggctttggctgcagcctggtccttaggcttattctggtcctggcaggtgagaactacaagaccccaggctatgtggtcactccacacaccatgaatctactaaagcagcacctggagattactggtgggcaggtgtgtggggatgtggccatgtgagcttgtgccatcaaacacctgcctgagtgcctgggctgcgtccatactgccccatctcacccatcaccatggccttcctgggagggaacatctgtttctttaaggtcatctgagctcagactttatttctcttttcccatcccccttattttaggtacgtacccggttcccgccagaacccaatggaatcctgcatattggacatgccaaagccatcaatttcaactttggctatgccaaggtaagcatgtgtctagggacctggcaagcaagatgaccacttgctgttcccatgagtggataccatatccctgccttgctgtctgctcccaataatgtacccaggtgggcagaggccatggaaaggaaccacatgtgtgacagatacctaggaatctattgagcttattggaataaatagctccctccctctgaggagtcagtgagttcaaatttgggggagttgccagtgcagtccctaggcttagaaagatgctaggttagatacaggaaggtgagagaagctcttgaagacatttttaattctgacatgagtccgggttgggtggctcacgcctgtaatctcaacacttcgggaggctaaagtgggtggatcacttgaggtcaggagttcgaaaccaatctggccaacatggtgaaaccccatctctactaaaaatacaaaagttagctggccatggtggcacacgcttgtagtttcagctactgggaagctgaggcaggagaaacccaggaggtggaggctgcagtgagccaagatggtgcaagataatcaagactccatctcaaaaaaaaagaaaattctgacatgagagtgctctgtgaatatcctagtttgataaacaggattgtggggctgatggatgatgtgggagttcacagatggtgcaactttcctaggccaacaatggcatctgttttctgcgttttgatgacaccaaccctgagaaggaggaagcaaagttcttcacggccatctgtgacatggtagcctggctaggtatggactaggcaaagcctagaagggctggtggttagtgggcctctccttgggccatggcctgcccactgggtgtttgtggctggctgctcatactttgtttcattttgccccaggctacacaccttacaaagtcacatatgcgtctgactattttgaccagctatatgcgtgggctgtggagctcatccgcaggtaaggccagggccatgacgtagagccaggcagactgactaggtcacagccatgctgggcactcacaccgcttccccacaggggtctggcttatgtgtgccaccagcgaggagaggagctcaaaggccataatactctgccttcaccctggagagaccgtcccatggaggagtcactgctgctctttgaggtggggtcctagaggagcatctgggtttgggtgggccaaggtgctgagaatgagatgctcctgtgcttagagacagcctgagtccttgttcccctcaggcaatgcgcaagggcaagttttcagagggcgaggccacactacggatgaagctggtgatggaggatggcaagatggaccctgtagcctatcgagtcaagtatacaccacaccaccgcacaggggacaaatggtgggtgtagaatggggtggggtggtggggctgccgagcagggcgatgggccatggggtagggcagagtagggctggatggtagggcccactgcctatgccccacaggtgcatctatcccacctacgactacacacactgcctctgtgactccatcgagcacatcactcactcactctgcaccaaggaattccaggcccggtgagggagctgggtccatggggtggtagggccagtggaattccagcagcccttcctgtggtctctgcctggttccagagctggccagtgctaaccctactctcccaccccagacgctcttcctacttctggctttgcaatgcactggacgtctattgccctgtgcagtgggagtatggccgcctcaacctgcactatgctgttgtctctaagaggaagatcctccagcttgtagcaactggtgctgtgcggtaggtgcggctgtttggcttatgaaaggttaatggcatatgctcccaaaggccttctcaccaccttcttatccacagggactgggatgacccacggctctttacactcacggccctgcgacggcggggcttcccacctgaggccatcaacaacttctgtgcccgggtatagcccagcaggttgggtagatacattgggggttgagtgtggcagtttgtgattgtagctgtgactgatgctgaactttcctgccaggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaaggtgggcctgcctcaacatgtgtgtcacatgtgtgtgtgtagctgggggtacacttggctctgggcatgggggtcctaatgctgagtatgactcatacctgtctcctgtctcctgctatagtccttggacatccaggtgcccaacttcccagctgatgagaccaaaggcttccatcaggttccctttgcacccattgtcttcattgagaggactgacttcaaggaggtaaattgtgggggtggagggtcccgtttgctgctgagtctggtactgggaacctttcatctcctcatctctgtcagtccatctacttcctgcttcagatgaaccaatctttgccagacacgggggtagggaagcttccccacttgtttgacccttgcagcctcatgtgtctaccccacttcctatctctaggagccagagccaggatttaagcgcctggcttggggccagcctgtgggcctgaggcatacaggctacgtcattgagctgcagcatgttgtcaaggtgagagccagctgcagccttcctactgcagtgcctgctggggccaagatgtgagtatagcctgcagtcctcgttgtggttcccgggtctaattgctgctcccctccccccacttccagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggtaggttcatgaggtttggggtgagggaggtaggcctccctggttggatggttgcctgagttccctgcctgcaggcatcactacacgtggtggatgcagcattagtggactgctctgtggccctggcaaaacccttcgacaagttccagtttgagcgtcttggatatttctccgtggatccagacagccatcagggaaaggtgcttgactttactcacctgccctcatctgcagcagtgacagtggctgccgttcattgtgccaagtgctctgcatacattcccttagttaatcctcaccacctgagggagttggtattcatattctactagtgaggaaactggcactgaggataactccaggcacaaaattttgtatgaaggctgcctttttttttgagacagtcttgcactgtcgcccggggctggagtgcaatggcaccatctcggctcactgcaacctctgcctcccaggttcaagtgattctcctgcctcagcctcccgagtagctgggattacaggcgcctgccaccacacccggctaattttttgtatttttagtagagatggggtttcaccatgttggccaggatggtctcgaattcctgacttcatgatctgcccgcctcggcctcccaaagtgctgggatcacagtcatgagccactgcacccgacctcttttttttttttaattattattttttgaggcagggcatggtggctcacacttgaatcccagcactttgggaggccaaggcaggctgatcaccagaggcagggctaccaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaagatctgccccacagcagtttgagacggagtctcacatgtcgcccaggctggagtgcagtggcacaatctcggctcactgcaagctctgcctcccgggttcacgccattctcccgcctcagcctcccaaatagctgggactacaggcgcccgccaccactcccagctaattttttctattttttagtagagacggggtttcaccgtgttagccaggatggtctcgatctcctgatctcatgatccgcctgcctcggcctcccagagtgctgggattacaggcgtgagccactgcgcctggcctaatttttgtatttttagtagagacggggttttgccatgttggccaggctggtcttgaactcctgacctcagattatctgcctgtctcagcctcccaaagtgctgagattacaggcgtgagccactgcaccagcccaccctgtctttcttactccttaaagtagggggcaaacatggtggttgttataatccatataaaactataccctggacccccacggtggttgttatggtccatataatactatagcctagagccccattcagtcccttacccaaagtcacaaagttattgaggacccgggcctcctgacccttagtccctcggcttctttggcttaagaaggatgttagggggaggtgtctgtggtgaaacctgcccaggcctccctggccttgttctgggttggtggtcatccttttccctctgccctccagcttgtctttaaccga

SEQ ID NO: 17498 - DNA, 27791 bp, Human
aagtgatttctataatgacactgatggaaaattccatcaaatagccataacgcatgtcaagcactctgctctgcataccttctgtcacactctaaggatgagagaggggagagttatcctggttctggctgtgtcctccccattttggccatcttatgagctccttatagaggtctgaaatgatttggagtccagagtccatggctgtcaggatatgactagggtgagcaggcagttgggaccaccttgacctccagcctcctggtcctcagttcctcgggtatcccactctgctgggggcttagtgaccatgtttgggctccagagattattttttccttccactcctatccttagtttgttactaaccaggcgggagtacaggcatgtctctgaagacaggctcagggctgtgtgacagctgacgaccaggctgcagggaaccaggtcccatgcagtcctactgccttcttttttttttttttttttttttttttgaggcggagtctcgcttttcgcccaggctggagtgcagtggcacgatctcagctcacgggttcacgccattctcctgcctccgcctcccgagtagctgggactacaggcgcccgccaccacgcccggctaattttttgtatttttactagagacggggtttcaccgtgttagccaggataatcttgatctcctgacctcgtgatccgcccgcctcggcctcccaaagtgctgggattacaggcgtgagccactgcacccggctactgccttcttactgtcgccacagcctggataaaatacgattcttctgagccttttttttttttttaatacagagtttcactcttgttgcctaggctggagtgcaatagtgcgatctctggtcaccgcaacctccgcctcccgggttcaagcgattctcctgcttcagtctcccgagtagctgggattactgacacgcgccaccacgcccggctagttttgtatttttagtagagacggggtttctccatgttggtcaggatggtctcgaactcccgacctcaggtgactcaccggcctcggcctcccaaaatgctgggattacaggcgtgagccaccgaacccagcccctctgagcctcttgaatacaactggggtcatgcctgctttgcaggtttgtcttaaggattaaagctgtttggggagtgtctggaggagggtgagtcttgagccaacccctgcatctcccttccagggcctcccggtaataaaccccaagtaaatgtgcactttgtccgtcctctcggagcaggtctccgggtactcctgtgccaaaccgatttccgcccccaaggtccttctcctcttagaaatcctgacgcagctcctaggttccttcgcagtgacagccactcttttctatttgtacgtagctgtagtgttttgtgggtacgttctctgaacaacaaagtggcccttctaaaggctgttctgtggggtccacagcctcgccacccccagcctctgcagcggcttctgaatgaatgaaataagcgacggcgccctctccaccaccccacccccgccaactcggcaggcagggatcccaggcgcgggttctggcggaggcggtcccgcgaggcggggggacttttctaggcggggtgggggccttgggaccacctttaggggctttttccccatcccctggccccaattcgcagcgtttcgccacccagggcccgcagggctccaagcccttcttccccagcccgcgcgctcaggcccccgcccgcccccggcggtggccccggaccccgagcggaagggggcggggggtgtgcggggccgggaagcggggagcgcgggcggcggaaggtggcgggagggggtgggggctgggaagcaccgtgcgcgggcggcgggagggcccgggcggggctgcgcggtggtcacgtggggcggggccgggagggtacttagggccggggctggcccaggctacggcggctgcagggctccggcaaccgctccggcaacgccaaccgctccgctgcgcgcaggctgggctgcaggctctcggctgcagcgctgggtgagtgctggggacccggggccaccgcagcgtaagtgaccttggcggggacggtgctacccggccgccgagacgggttcctctgcgccctcagtcgggcccaggcgcggccccgcggcgtccctgggggccggcggggagccgggaccctcgggactgtccctgacgggcgggctggggtgggagtccgcgcgctccgaagcgtcggcgagaaaagcagaaaacaactccgcccgccagccctctgccctccgctcccctccccgggctgtgcgccggaccccggccctcggagcggggacgcggccaggaccgccgagggaggcgcctgcgaggaagagctcggccgggtccggagactgctgcctgggaccgcgctcccagcgcctgggcctcggtgtctccgggccaaactgccgacataatcgcatctgccggcatctattttcggtttatttccccctcattgcgaaggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggttagtagccctggaggccggggggagttggcctctggggagcagtgggtgctgggtgtggggcgttgcaggcaggctggggtgggcgacccaggtggaagtgaattgcacttggcttcctggtgggcctctgtcacccccttcccaggcgctgagaaagccagcaggctggcaaagaaaaggaccctagcgcaggccccacactcctcctcctaacggacgagagaccccccaaacccactggagaagtgacgctgtggggttcaaatgcagacctggcacctttttgtagcctggaaaaacattcccactgcctgctgccggaggagaggatagctgagatgcactctctttgaatccaaacgttcaggaacgtaaggcgaagaggcctaagagggcgttggctggctctgtctctcaggctggagcacagtggcgcgatctcggctcactacaacttccgcctcccaaattcaagctattctcctgcctcagcctcccgagtagctgggattacaggtgcccgccaccacgcccagctaatttttgtatttttagtagagatggggtttcaccatgttgaccaggcagatcttgacctcctgacctcaggtgatccgcctgtctcggcctcccggtgagtcacggtgcctggccaagaactgtttcttgttggctctggtgctggtgacttagaacccgccagctcctggagaaaggggctgggccgcccaccctgtgtagctttcccaaagacagagtcaaacgtctcctggagaacagaggcttcccttcgtctttggtcatttgtcctctagctgggggtaccccctggtggaaaggcacaggtcccttgctccccaggtggcaacgcaggccagacacggccctggcacagctctcctgggtgttggctcaggacagccctgtttccaactggttaggcggtgaggggtggtggccctttggttccaggttgaaactgcctatgtggtgctgatttagcagactggggaggctctttttgtaggcaggttcttttctttccccagctgctggacctgggagttggaagagaagttgcacccattttaggggtaacagatattttctgttgctcttggttggattgggaagtgaattgaagggaggtcacgtttcaggggtgccttgggatgtctgtcagtgattttcttttctttcttaatttctttttctttcttttttttttttttttgagacacactccctctatcgctcaggctggagtgcagtggtgcgatctcggttcactgccacctccgcctctcatgttgaagcaattctcctgtctcagcctccctcccaagtagctgggattgccagtgcccatcaccacacctggcttttttttttttttttgtatttttagtagagacgggctttcaccatgttagccaggctggttttcgaactcctgatctcaagtgatccgcctcagcctcccaaagtggtaggattacaggcatgagccaccgcgcggtggaggggtaattttcttaaatctggtaatgagttgtggttgtgtagagtaacataccgtcctttcgagatatggactgaaacattgagagggaggagttacaggtatgccgattcttcttttctctctctcctttttttttttgaggtggagtctgactctctcacccaggctggagtgcagtggcaagatctcagctcactgcaacctccgcttcctgtgttcaagccattctcctgcctcagtctctcaactagctgcgattacaggcatgtgcctccacactcagctaatttttttatttttagtagagattttttgtctctcctaaaaaaatccaatgtaaaaaaatcccaatgtgggggttttgccacgttggccaggctggtctcgaactcctgacctcgtgatccgcccacctcggcctcccaaagcgctgggattacaggtatgagccactgcgcccagtctgctgcctcttttcaatggtctggcctaaggaaattattggaaacatgtgcggttgagtgatatttactgggcacttccacatggtccatgtaaagggagatggttggggtgacaggcagttgagtctaggggaggcatgtacagatgtgctgtgcctctgggatatcagggtggcaggcagcagtctctacgtctggtcccaggctgcctgagaaagagcatgtgggaggcaaaccttgcgccctggcatggttgttaatgtttatatttaccctagcttgtgtggggtaggaggtttagggatcaaattccactctgtgtttagacatttttttctttctttttttttttgagacagagtttcactctgtcacccaggctggaatgccgtggcacaatctcagctcactgcaaccttacctcccaggttcaagcaatgttcctgcctcagcctccggagtagctgggattagaggcatgcaccaccatgcctggctaatttttgtatttttagtagagacctcaaatgatctgcccgcctcgcctcccaaagtgttgggattacaggtgtgagtcactgtgcccagccatgtgtttagacttttaactaatctcttttttagtttcaagccttatcgtccgcctctgtagaccactcctgtgcctgtttcctgatccttccaagggccattgtattccctgtctgctgcccctcttttggattcttctgcacatttttttgttcatgcattcattcatttattgtttgattaatgacagggtcttgctttgtctcccaggctggtgtgcagtggtgcgaccacggctcacggcagcctcagccacccagatgtaagcgatctggttcccacctcagcctcccgagtagtaagtagctgggaccacaggcggtgcccaggtttttttttttttttttttttttttcgtttgtagagacagggtctcactgttgccaggactgctctgaaactcctggtttcaagtgatccccttgcctcctcccacttaggccttccaaatgctgggattacaaggcatgagtcacctccaggcctttttgtacttttaaaactctgcatcagtgtataaacaatgttattaaagtttatatgacttcagttacactacatggatcctttttcactcacggttgtgagatttatttctgttgctacatccagttctagtccatttgtgttaagtgcccagtgtgtttatctactgagggacagttatgttatttcgtgttcactattatcccatgctacaataaatatcctgtgtctcccagatacttagaagagtttctgcagggcacatgtgggagagtttgtttctgggtcatgaggtgtgttcatcttccatcttgctagatgctggcaaagggttctccagtgtggttgcatcaatttactcgcccagcagtgtgcagagttcctgttcctcacatttaccaacactagatagtaccagactttgatttttgccaatctgatgggtttgaagtggtacccctgttttaatttcatgaccagaaattcaaatttaatctttgctgtaggacaacagtaacccacttatgcctagtgttccattattagaacgctaagcatgtgggagtttttacatcatactgctcaaggtcatcgccaaggtctgatgtttttactcgtgcaaaaatttaaaaaattgcaacctctggcataaatgggttgagtgacacttttcctgtttttattgttggtcagtgatggcatatttgctggttttttttgttttttttttgaaacggagtctcactgtgtcgccaggctggagtgcagtggtgtaatctcggctcactgtaacctccgcctcccgggttcaagtgattctcctgcctcagccccctgagtagctgggattacaggcgtgtgccaccacgcccagctaatttttgtatttttagtagagacgggatgtcactatgtttgtcgggctggtgttgaactcctgagctcatgatctgcctgtcttggcttccctaagtgctgagattacaggcctgagccaccgctagcctatttattttttattttaaattttaattttctatatagagacgaggtcactatcctgcccaggctggtcttaatctcctgggttcagtcaatcttcccaccttggcctcccgaagtgtcagaattatagatgtgagccactgtgcccagcccagaactgatgttttctaaatgctgggtgctgagaaggatgtgtggctggcagtcttgactgtgttatctgtctttaccaggccagtaacttctttggtctggtcatcaagataatctagcatcaccagcaagcatgcatggagaaggatgggcccaatgtggccaagatggtaacgggaccagtagagagccctgtagaagacatctagatattctgccctaagagcccggagggccgggctgtctcatgaccctctgacgtgctgacctggactctggcagaatgtgcacacacacagtcacacagcttcctggcttgcgcaagtcccaggagggcggtgccagccacaggcttttcccattcgagggttggaagcgtatcatcaaaccacatcagagtgctgggggccacctgccacccattcccaacccactcagccttcctggtgtttgggacatgctttgctttggcagtcaagacagcagaacaaatcaacttttaaggccttgtcactgatagtacaatttccattatttttcatccaaattaggatacttctgaaaatagaaatgatgactctgggatgcaaacgttggctgtcctatgtataaggagatggcttttcacgctcccagtgactgaggaagtttctcccagatggcgctgctctgagcctggtgcagggtaggcactttcaaaagagtgtctccttgtatcttccatcagccttgcgagatgggtatctgttcccagggccccaagggaggaaaacaggacctagctggatccaagagctaggcctttctttttttttttttttttgagatggagtctgactctgtcgcccaggctggagtgcagtggcgtgatctcggctcactgcaaactccgcctcccgggttcacgccattctcctgcctcagcctcccgagtagctgggactacaggcgcctgccaccatgcctggctatttttttgtatttttagtagaaacggggtttcaccgtgttatccaggatggtctcgatctcctgacctcgtgattcgcccgcctcagcctcccaaagtactgggattacaggcgtgagccagcatgcccggcccagagctaggcctttctgtggctggccttcgcgtcagcctcaactaccctggtgtaatctcgcctgcggttgaattagggaaccgccgtgttctgcaagctggagaggcagaacactaatgagcagaacactaatctcattgcaatctcaaaggatctctaaaagcttttataaagcaggcccaaggtcctttggtatccgatgcagacgtggtgaatgcattggctctgtcagcatctgagcaagtcagtaacagaaatggggagtaaaagctttcagaactttccagaatattgactaaattgtcttgtttacaaccaacaacgacaacaaaaaataactgctgagggccttcgtagtgtctgctgtttcaagtgtacagtagtcattttgtctgcaggatgtggggttgctgtggctgaccttgtacaatattccactcataggtgtcttcaggcctatggagagcagcttgcgtgggctgggcctgcagtacctggtttgcatagatgattggcaggtgggcagcacggggaaggacctgtgagtggccaacctggttcaggtgagggaggtggagtggggcttctctgcttcccctggttccctggaagcctccaaggctggtgagcatcactgctgcctctgcacacctgtgtgctgggtgggttttctgacaggttttcagttgcttcggggctacagctgcagggagcctgctccatgggacagatgggcctctggtgcccgttcatcaggggactgatgagaccgaggcctgagagccctttggattttgtttttgtccttaatttaatcataagccaagaatctactaaacacagttccattaggggcaaagacgtaacacatcagaggccacagcaaggctgtgattcatactcagaaaggaaaggtctctgggtcacaacagagcatagttgaggtcagcacactcccacccagtgcagggctgctccagcattgaggtgtgtctggcaggttgaagtaggggaagatgaaactcgccgaagtcttgttttgtggttgcacttaagtggtcaaaacttcaggagcaactgccgttattagcggtgagtgccaagactagtttttatagaagagaaagaaacaaagtactctgggaaggtcttactgagccttcacagtctccccacctttccactgttcccgtgctcttagccgctctgctggcctataaggcacagtcttcatttgtggcttctggcaaaatgtaagcacttgacttttgtttttgttttgttttgttttgtttttttgagacggagtttccctcttgttgcccaaggtggagtgcaatggtgcgatctcagcccactgcagcctccacctcctgggttcaagcaattgtcctgcttcagcctcccgagtagttgggattataggtgcacaaccaccacgcctggctaattttttgtatttttagtagaaatgggatttcaccatgttagccaggctggtctcgaactcctgacctcaggtgatccacctccttggcctcccaaagtgctgggattacaggtgtgtgccactgtgcccggccaactttcaattctttagagctgactatgagaggagccagcagtatagccacagcaccaacgaatgaggaagagcaaaatactgcatgacagctttgctaagaattctttcactttttttgtctatcagccaggagctagcaacttggcttatttggaaattttaagtgtacatatcctgtctccttaaatcctttacagatttaaagtgcagtctacctgagggctctgtgaccatgtaagaaagctttttctttctttttttttctctgagacagagtgttgctctgtcgcccaggctggagtgcagtggtgtgatcttggctcactgcaacctctgcctcctgggttcaagcaattttcctgcctcagcttcctgagtagctgggactacaggcagcaccaccatgcccggctgagttttgtatttttagtagagacagggtttcaccatgttggccaggctggtcttgaactcctgacctcgtgatccgcctgcctcagcctcccaaagtgctgggattacatgcgtgagccattgtgtccggcctttttttttttttttttttttttttgagacagagtctcgctctgttgcccaggctggagtgcagtggtgtgacctcagcttactgcaacctccgcttcctggattcaagtgattctcctgcctcagcctcccaagtaggtgggattacaggcacccaccaccgtgcctggctaatttttgtatttttagtagagacaggagtttcaccttgtttagtagagacaggctggtctcgaactcctgacctcaggtgatccgcctgccttgacctcccaaagcgctgggattacaggcatgagccactgtgcctggccagaaagccttctttattgagcttggtggcagcccaaaactgattctttaagggtgtcaggacttaacacctcctgtgacttagccgcacctcctctcctttgactttcattccacctccttccaggatcgcaaggtccctatttgtcctggaaacggcttcaaggtagtctagggtgccgtttgccgggggaggaaggtgctctggttgatagagtcgcctggccgcacactctttttggcacataacaacgttctacagagccggggtggagcgtgctttctcataagtgctctgcaggtttggagagagaggatatgaggagcacccttttctgttttttttaacccaaagattagcttggaaaaggggcagaggggtgcactggaactcaggtctgcctaagcagcacagcagaccaaggtctagagatgacatctgctcgcagctgttcttccaccagcccgcatcctggaaaggggtcttgtggcacacaagagttcacatccttccctcgtgaaataaggactttgtgttcatcatctcttgtaagaagcagagcagaaagcacagaattaagaaataaaagggaagtgggtgcctatataaagggaagtgaaaatgggttgctgtcccatgcaaagaccctggaaagctgttaacagctcagcttgtcactttcaccatctgcatttgtccagagtgattgagatttgcgttgttgtggagagaaaggcgcctgttgcacaatggagtgagattgccactgctgtcaggacctctgtgtttggcttgacactttttgagttctcagcagtctcgggaccctcaagagtggaagcatttttggatgttaaatgctggggttaattgaagttaagagcttgttttactgggcatggtggctcacacctataatcccgacactttgggaggccaaggcgggcagatcacttgagtccaggagtttgagaccagcctgggcaacatagcaaaaccccatctctacaaaaaatacaaagctgggcgtagtggtgtatgcctgtagtcccagctccttaggaggctgaggggagcagatctcttgagcccaggaggcagagtttgcagtgagccatgatcgtgccactgcactccagcctgggcaacagagtgagatcctgtcttaaaacaaacaaaaaaaacaaacttgttttcatttagactcttcctggcgttggggacctattggaataggtttagtgtgaactgagagctagaagtgttagaggagagagggagggaacagagcccgctggagcgagtgcccttcctaccttatcactgcatgccaggcatgtgccggcgctttggtcctcctcatttcattcttgactgccacctgagacacgatggttactagctccattttataggtggtgaaactgaggcttggggaaggtcagaccccaagggtgccatttagtcagtggcagagccagatccaaatgcaggtctcctgactccaagtgcagggctcattttatcgtccggttgcagcacgctggcggccccttgagccccaacctggataccataggggaggagcagagaagccaggaacaccacagccctgggccaaggtgcggggctgaaagaacttcccagcgctcagcctgggactagtggaatgggctgggccctggggctggcagcggtggccccggggagcctgggaatgagtagggagcacagggaggtgtgggagggcctgggaaccatgaaaaggagggcgggtgcagggaagtcgcctgctagtgaagtggcgagggggccctgtgggactccagggaatggccacggcaggttgtcctccaggagttgagagccactggacatggcagctgcctgtgttctcagccaccacagtaaccaaagaaatcttggttttaaaattcaagttgccatggaaacgctcccatcctcgacttggcttattatttaaaataacatctctacagcacaaagcccccgggtacatccaaggacactgctgtctgcccacgagacatgctaacctcacagtgtggaggctgtgtgggtcactgacatgcatggccacgtgagacgctgcctacccacgagtcacggaaaaggggaagattattaagaaagtcactaggggccaggtccagtggctcatgcctgtaatcctagcactttgggaagctgaggcagttagatcccttgaagccaggagttcaagaccagcctggccaacataacgaaacacggactatactacaaaaattagccaaacgtggtagcacaggcctgtaatcccagctactcaggaggctgaggcacaagaatcacttgaacctgggaggtagaggtttcagtgagccaagattgcgccactgtactccagcatgtgccacagagcgagactcccatctcaaagtcactagggaggaagcctcattggtgggaaggaagaccaaattggaaatgctctgaggaatcattaaaacaaatgtccttttatcagtttggtggctcagggcctttagtaatactgccaactatttttcctagaagaaacaaaactgaaataataggaacatactcacttttttttttttcttaaaagtaagggtatgttgtgaaaaaaagtctccccaccgtagtgaccgactgccgtgcatcttccttggcattttgcatgtagtggcaggagtgttcctacatgtgtagattgctgagagggtcagatgcttatggtcctcagtcacccacagcttgctttttccccacttaacattgggacttggggcatttttactctgttaatacaatagaattcacttcaactagttggttttttacttttattttattattattatttttagatgaagtctcaatctgtcgtccaggctggagtgcagcctctgcctcctgggttcaagtgattctactgcctcagcctcccaagtagctgggattacaggcatgcgccaccacgcctggctaattttttgtatttagtagatacagggtttcaccaccttagtcaggctggtctctaactcctgacctcaggtgatccaaccgcctcggctacaggcatgcgccaccgtgccccaccaactaattgcttttttaatggttgcttcatattctatttaaccacttaccgtaatttaacagttactctgttattggatacttgattcatttccaggacatgcagatttagaaactggtgggcgttgctggttgatgtctcggtggttgtgcccacccaccccaggcactcattatcatgccttccgtttccccacttcctaagccctgcaagaagtgccaaactgtccagcccttgccaatctgatacatgctgaatacctccttgattttatctgcacctccctgaggttgaacttattttactttattttattttatttttgaggcagagtctcactgtcacccaggcaggaatgcagtggtgaaatcttggctcactgcaatctccacctcctgggttcaagtgagttgaagcaattctcctgtctcagcctcccaagtagctgcgattacaggcacctgccaccacacctgggtaatttttgtatttttagtggagacggggtttcaccatgttggccaggctggtctcaaactcctgacctcaggcgatccacctgcctcagcctcccaaagtgctgagattacaagcttgagccaccatgccggttgaacttatttttatctgtgttggccatttgtagtttttctattatgctggttccatttttctgactttgaagagccttttgtggaaacgaagcctaaagtatatgtgagtactgctttgtttcgtcagtttttgttttaaagagacttttcagtgtaatgcaagcattttcccttgaaggctgtgtttcctgtcaatcctaagctttcctccagcattacctttttaaaaaactttattttctatattgatggggtctcacaatgttgtccaggctggtgttgaacacctggcctcaagtgatccacttgccttggcctcccaaagtactgggattataggcatcagccaccgcacccagcctgtttttcaaagggcattgatttttttcataaaactttttaaattaagatctgtgggcctggtgcggtgcctcacgcctgtcatcgcagcactttgggaggctgagtcaggtggatcacgaggtcaggcgttcgagaccagcctggccaaaatggtgaaaccctgtctttactaaaaatatgaaaattagctgggcatgatggcacatgcctgtaatcccgctgctcgggaagctgaggtaggaaaatagcttgaacccaggaggcagaggttgcagtgagccgagatcatgccattgcactccagcctgggggacagagtaagactccgtctcaaaaaaacaaaacaattctgtgttgcatgtggtactttttgtgtgtgaggagtccagtgtgaagattcagacttcaggcagccacttgtacaagcactgtcctgttgcctctctggcctcacctaggtaacgctgattcctccacggaggatgtgcttctgagtggtccgttgggtgctgtgctgatgagcatcacccagcattttacgacacatgtgctgccccagagggctgggctcccgtcagagctcttttccactggctgggtgcggtggctcacacctgtaatcccagcactttgggaggctgaggccagtggatcacctgaggtcaggagttcgagaccagcctggctaacatggtaaaaccccatctctactaaaaatacagaaattaggtgcgtgtggtggcgcacacctgtaatcccagctacttgggaggctaagacacaagaattgtttgaacctgggaggtggaggctgcagtgagccaagattgtgccactgtaccccagactgggtgacatggcccacagaccaagaccctgtctcaaaaaaaaaaaaaaagcttttttccagagccatcttgctgtcctcatatatttattctcctagatgaattgttgcttaagcaacaatgaagtttaaattgttcttcagatagaacccctaggtgccaggcagtttgttaagcactgacaccgcagtcctgtgactttcatgacgacctgtgacctgtgggaggtagaacacctcacccacccgtgggagcccctggagtgactgacaggaacccctgcctcacccagctccccgcgccgcggctctccccagccctggatgcaggcgcccaggagacatgtattgcttttgttgagctgctcacttaggagggtgactcagagttcaagctggaaagcactggcttgtgactcatgagccagtgcaagatcaaacggctggggcatcgaggtgagagttttccttctcagaagcctcatctccgcagccggaagcagagcccttggctgactggaaaaaccagagaggccccgggagtgggtggatggccagcccagccccacctctcagcctcaacctccaccagcccacaccgagcttgtttgtctgtgtcctgtcgaaactaggactcctggattgtaacttttcttacatttccctgtcccctgggtcctccacttagggtgtaatcacacagacaggctcttaactgtttcatatcactcacttgggaaagtgtctcaagctgttctacaaatccatgcaaaggccgtttaaaaatagcagcgaaggccctggactcggtctcgtccagcacagccccttggctctctctctgggctctggccgcctggcccccggggacccacacgaggtcatggcgtgctgcgggcagtggggcggggatcccatagacacctcagctccttagagttctccgcctgggccaggacgagcatgggggtccccactgatgcccgagacggtgcccctgtgtgtgtgagccctcgacccacataacagagaggtgtcctgatgccctctgtcctctccaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggtaggctgtggggctgcgtcctatgtatgtcccctcccaggtcggtctgtgcacactgactccaggaatgggaagccagccctcactgtggcccacagaacattgtcctggactgttgaaaaatggccctgaccctgagtcatgtcggctctggaccacgcctccctcctttgtcccataccccacgtgtgtgcatgagtgtgtgtgcttgtgtatgaatatatggttgtgtgcacgtggaggtgtgtgggggagtaagtgagcttcggaagtgttcaaaaccagctagcccctgtgacgcccgccgtggcacagtggcagtttatcagtcccgcccctgattccctttgtctctgcccagccctgaccctcggactgagaaccaagaatgaggagtgagccatgttgagggctggagagggtctctgattgtcagcaaatgggagcagatcaggggagacacccactttgcccgtgtgtcactctgggctgttccccagtgccccccaacccttgggcccttgaattgggtagggcctctggttttccctgggttgggcttcgtgtgtgggcagcgtgcccatccaccgccatcccgggagacccttcagtcagtgggtgactctcttccaggccgggcacaacttctacaacgtggacatgagctacttgaagaggctatgtggtaccttcctgggtgggcccaagccaccccagaggtgagtgcctgctcctctgcaccgctgtaatgtgagtggcaggcgttggtttggggcagtgggaagtgggagagtgaaggcctctctggcgtccgcagggctcatgctgcccagggctgccgacaccgcttgaggtacagtacttgtttcttttcatttttgtattactttctttttttattttattttttccttctcaagttattagtagagaagatgctggtgcttttttttggtttttgagagagtctcactctgtcacccaggctggagtgcagtggcacgatcttggctcactgcaaactctgtctcccgggttcaagcgattctcatgccacagcctcctgagtagctggggccacaggcttgcaccaccgtgcacggctaatatttgtatttttagtagagactgggtttcgccatactggccaggctcgtctcgaactcttggcctcagcaagtcatctgcccaactcggcatcccagagtgctgggattaccggcatgagccacccccagtgttttctattgtgcttctccaaggtgtctcagccgcagatgtgacagacaaggtctgggtccccactatgtgggcagactcaatcttgagtaatttaagggaaatctaagaaaagccagatgaggccaagtatggtggctcacgcctgtaatcccagcactttgggatgccaaggcaagcggatcacctgaggtcaggagttcgagaccagtctgaccaacatgatgaaaccccgtctctactaaaaataaaaaactttgccaggcgtggtggcgggcgcctgtaatcccagctactcgggaggctgaggctagagaatcgcatgaacccgggaggcagaggttgcggtgagctgagatgatgccacttcccacgtgaggatggggtagttaagttgcacgacactgccttctgcacaatggggatgatatgagaaatgatgagaggatcctgggcagaggttgaggcaggagagcagggcaagaaacactatctggactgaataaacttatttaaaaatgagtttataatttgtggataaattcatcttaaaaaatccattacataagcctagaaagaagcgtacaatatcgcaagtcaggccaggtgtggtggatcatgcctgtaatcccagcactttgggaggccaaggcaggcagatcatttgaagccaggagtttaagaccagcctggccaacatggtgaaaccctgtctttactaaaaatacaaaaattagccgggtgtggtggtgcatgcctgtaatcccacctactcaggaggctgaggcacgagaatcgcttgaactcaggaggcagaggttgcagtgggcagagatctcgccactgcactccagcctggatgacacagtgaaattctgtccactcccaccctcccgtcccacccaaaaaaaaaatcaaaaggtgcattgagcaacagaatttccttttgttttatgaaattaccaaggacacctgtctgcagccttcttcggcatgtcttgtgctcatttccttgttaggggagtgtggcccagccaaagtggcctttgcagggattggggagggagttgtgggatcagagcttgtaatgaagaccttcctttatccagagttatgtttaccgaggacctgaagctgcctgcaagcttcgatgcacgggaacaatggccacagtgtcccaccatcaaagagatcagagaccagggctcctgtggctcctgctgggtaaggccctgctggctggcggggaagcgctggagagaaagtgggagcaacactggagagtcttgggggattcggggtggggacaactctgacaaggcaagttatagaaactttctgagtcccagtttccatcagtacaaaaatcacaatccctctggccatgaatgatggcgaggattaggtggagtggcgggcagagcatccagcagattgcaagtccacgtgtacaggtggcgaagcagctccctttccctgacatgctggcccgtccgcaaataccaggagctctcactgctactctgcttcaagaaagcatccctttagtgtcagtgagctgtcttaattttgtcatttaattgtggtaaaatacacgtaacagaaatgtaataatcttagcaatcttcttttgttttctttttctttttttttttttttttttttggagatggagtcttgctctgtcacccaggctggagtgcagtggtgggatattggctcactgcaacctctgcctcctgggttcaagcaattctcctgcctcagtctccccagtagctaagactacaggcgtgtgccaccacgcccagctaatttttgtatttttagtagagatggggttttgccatgttggacagcctggtctcaaacgcctcacctgttgatctgccttcctcggcctcgcaaaatgctgggattacaggcgtgagccaccgtgcccagcaactattttcaagtgtacagttctgtagcattaagtacattcacagtgttgctcagccatcaccaccatctgtcccccgaactctttttcagctcgcaagacagaaactctgtccccattaacaccaatattgtagcccctggtaagccccactctactttctgtctctatgaatttgactcctagggacctcatacaagtggatcacaacagtatttattttctgggtgagctgtgttttttgttaagaaaaaaacacagccaggtacggtagctcacgcctgtaatctcaacactttgggaggctgaggcaggcggatcacctgaggtcaggagtttgagaccaacctggccaacatggtgaaaccctgtctctactaaaaagacaaaacttagctgggcctggtggcaggcacctataatcccagctactatagaggctgaggcaggagaattgcttgaacccaggaggcgcaggttgcagtgagctgagattgcgccactgcattccagcctgggcaacaaaagtgaaactccgcctccaggaaaaaaaaaaaaaaaaaccacacacacacatacaaactaatactacacattttgcagatttcagaaatgaaccgagttcccaggcagaggttcacggtggtgcttctcttgctttaaaagctgagttgggcagatgttgaggcaggagagtggggcaagtggctcatgacgcctctaatcccagcactttgggaggccgaggtgggcaaatcacttgaacccgggagttcaagaccagtctggccaacatagcaagaccccatttctaccaaagaaaataaaagctgagtttgagccccaggagcgtcccctggtgttgagagatcagttgcctacaaggtctgaggtgcccctgtggccctttgaggggactgctgcagagggcccagcccggacatggcagcctcacccggtggggctcgttcctgcaggccttcggggctgtggaagccatctctgaccggatctgcatccacaccaatgcgcacgtcagcgtggaggtgtcggcggaggacctgctcacctgctgtggcagcatgtgtggggacgggtgagtcaggctgtgcttccacagcgggtttagtgctgagagaccctgggccccagcttctcagtggaggggactttgaggacttcctgggactgctgcgagtcagaagtgtttcggggagactccgagagtctggcaggcagggcctggcaaggctgctgcttcctgggaggtgcctgaaccaaggctggcccggcagagctgtctgaggggtggcatcccagcaaaacagtcagtttcagaaaatgtggtggaatgtctggcccctggtctggtttgtgtcatcgcatgttcctttttcctgcttggggaaccagtttggggcgtttccttatgtgtagttagcggggatggctccaccttaacaacaaggtggtggcacagaactttctgctccagctgcctgcagcctcgccttggttccgcagtagcggtgttcactggcggctgcagatccgaaatgcctgagggcttaaaaaaatgcatgggcttctcccctaactagttaaatgggaatcactggcgattctcatttcagagaactggtggtgtttttaagtaccttagggaagtttagcgtctgctcagttgagaatcagtgttctacccggaagggcactcgtagcctggtctggtatggacatgaacaggagagcctcctgtcttctcccggatctttgtgggtaggggtggggctggcggttattccctgcaagctgtgcttatctagggagcgtcccttggagggtttggggtctgggaggtctgctcgcaccacttgctgcagctgggggtgggtccacgagtggcctcgggcacttgggtagcacacagtggtctggagagctggtggtgcttctctcagaggttttcattagaggctgtcttttcagctgtaatggtggctatcctgctgaagcttggaacttctggacaagaaaaggcctggtttctggtggcctctatgaatcccatgtaggtaagtgtgtccccttggccactttctggccagatggattgtttgagcaattaaccatcatggctttatttgcctttataaactgggggttgagacagaggggctgctgagaggtgctagccaggtgtacaggcctctggcaggacctgcctggcgtccatgctgcaggcacgaggcttgccttgccccaggtctgcctcgcccagctggggcttctccgtgggggctgtaggttgactccgctttctcccgggtcccatcagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggtaaggggcctggggcctggccacggcgcacgtggaggctggggagctgctgcatccctcctcacgctgcagcgaagaggtcagggctgaggagccttggggtcccggaactctaggatagaggagggggagtgatgccctcttgccaggagaagcagcacactctccactttctgcctgttccaccctgaactcagcctcagcccttccaaactggaagggaccaaagccctccttttacaagggagtggcgtgtcctggagtcttgaggtatcctggcctcttccggggcctcgtgctcattgctcccttctcccatttctgagcttccagccccagccctgtccttagttcttcaggggagccttccttgagctcccctggcagggcaagtccccttagatgcagtcttcccctggaggccaccagaaatcagtgactggctgaccgtggcgtgccacgaggcacggtcactgccctccccaaccccgagctcggttcattttccaggatacaattcctacagcgtctccaatagcgagaaggacatcatggccgagatctacaaaaacggccccgtggagggagctttctctgtgtattcggacttcctgctctacaagtcaggtgcgtgctgatggctgatggcaatagagggtgggggtcgggaggggagcctgggtgccaggatggttcatgttgaccaatagggctggattgggcaggcaggggaggggctggggaagagggctgtgtggggccttccatataggctcactcctctgtggaccagcctggcacctgactgtctttgtccaggtgttgtgccaacacacagaattccagaggcctctcccagagcctctgggctagttccttcccatccattggagtccagctcatacatgttctctgtgggaacgcccccctccctggtggctggccacgcctgccctcgccttcctggctttgcattgctttaccagcatgtttctgttataatggcaggccgttcgtgtttgcactggctgacacattttcttcatctttctctttgcaaaggcctagatcgtgcctcacaccagtggatgaacacacagggaggaccttgccctgggtagtgccatagggactccaaccaaggaatctggacagtccccatccccaagtcctgtcttagaaatcccttgctccagatgaacagtctttgctgactgcatctatcccattaatattttgctagattggaaacttgtaaaacaacagtttgacaaaggaagatgattctggcaagaaaaagtttctgtgaagatggcacttcttagcatagtcctcgcccttattattaaaagatgcatttccactttgacagtgatttccccacccgagagcctggttgggcagccctgagccccttagccagtatctttcccatcagctagcattagctgccaccagtcctcccttctcctccctcacctcttcagggtgtacctggagcagctattaaaactctttaagccgtgtaacgcttttgacaaacccttacttacatggaatcccagtataaagaacagatgaatcagtcatctagcattaaatgttttatcaattagaatgtattagaaattctatttttaaagccaacaagcacattttgtaggaatctatttcaatatttactcaacaactttgagtgtgttgggccttcaaaaatatatttaattccccagtattgtgggaccccccctggagcctcctggtggagcagcaggttccctctggaagctgtttctccttcccggagcatgaccagctgagtgtggggggtgctgtggggcgtgggacagtggcccggtctcggtctcagccagttcttcccttttcaggagtgtaccaacacgtcaccggagagatgatgggtggccatgccatccgcatcctgggctggggagtggagaatggcacaccctactggctggttgccaactcctggaacactgactggggtgacaatggtgagtggctgcccccttcctgccaagaacagtgaattgtgagccacaccccgtggccatctcggctttctctgttctacccaccgcacagccttaaaccctggacctacggccaggctgtcagctcctcctaagtgccaggcagtcaggagttcccttttgctgtgagggcagactctgagcagcttcagagccaacgcctgcaacagttcccacagcatcgcgccagatcctgtgatgggaagggtgaccgggcagggggcttgcccgtggaggtgtgccccacggctccagaagccttgtggtgttgaggactgtgctagtgggcccacagcaggagtggccagggatgagtgacttaaggtcttttaaggatgagtctgactatattggttgacccttgtcacactttaaaagcaccttactttttattcccaggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggtgtgagccactgggccctgcctgtactttttatcagccacaaatccagcaacaagctgaggattcagctcataaaacaggtttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtggtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaactgagttgattcattccatgcgcactgtctccctcacctccatcgtatacgcacctgcagctccttgcctgcttctagcatggagccagcggggatgtgctggtgagtgacaaggaattgtggggcatgtcgacatcagcttaaggctttgttagaaacacctgccttgcagtgtttgtgactgggaaagagctcagtgttttaatac

SEQ ID NO: 17499 - DNA, 26011 bp, Human
ttaaatcccttctctgtcacttcacagctgtgtgaccttgggcaatttacttaacttctctgtgcctcatattctttattttgaaaatgatgataataatagtgcttcctatatagattatatgaaatattggatgaaatgctttatctcaagtgctaagaacagtgcctagtacataataaatgttaaataaatgttagcattagtggtttagtaaccttatgcaaaatataagttggagtattattttaatgtatcatctggtgtgattttttattccagtactttatttttgtcctctggtctttcaaatcagacaattaagcttccattgccttagagaaggaatactaagcagaaaataaattttagtttcaaaagccaaaattttgcaataccaagagccttggcattccagtttcaaaagactaaatgctaaaagaccaaggatataatgttcatgctagaaagggttgattggatgaatgcagagtgatggaggaactagcttttctggctcagggagataaatattttgtaggctgggagagcaaaatgggactgattgatgtctatgctcagataccagtttgcatccccaaaataaggccctgtgtccaggccccagacatgggaagttcaggagagtagaaaatagaacctgcaagtagttgttgagatccaagaaaaaaataatacctgtgtctcacagtcccctaaagggactgtaggaagcagcatgcttgtccatcatggcaagtgaacagtaaaacagagatggattgatacacaggaatttaggcagaaagccttgtagaattttctttcatccagcacaaggggaacccagggacagcctggaagaacatgagcaagcaccagttcatcttgtgagcaataattgcacaaactaatgacagtgatgacttgaggggaacacagccattttagccaatgctagcataatagatggttgtaatcaatgattagcagtcctgtctcatagctgggcattttgtgaacccccaggaatgcagacgcaatgctagagattgggacaattatggggtattgtggtggtgagagaccgaattgacagagattatgcaacattgactggaagtaaattcttatctccagttggaatagtaacatgaaataaaaataaagttctgttaaaaacagataaaagttacattttttaatcatctctattatgaaaaatagaaatatagaaaaaataaaggaaaaagttacatttctttcctttgccccttagtatgaacatacatacagaccaaatgaatggatccatggcactattgcagagaaaagttcaactgcctctaccctgacttaccattttatagaaggatgatgcccagaataacattatcttaaatactcccaagatttataagaaggccgaggatttctgcccagacacatgaaaataaggcagcgaaggaaaaaattaaagccagtactgctttttaaaacatgcggtttatatgtaagacttgcagaattaaaatcaacctcaacaaaattcaaggcagtcaaataatgttcttgaaaagtggttaccctctgagttacatttttaacattaacagacatggattttttgggaagtggatgctgtataacatttgtattctcagcattttctgtatttatttaagccagtttgttttccccagtgatcctatgtctttgagacctcgctcttgacaatggtggcttcaggagcaaggccccaaattgccaggcattgctattgtgttgaagccacgctgctgcttttccctcctcatatcctgagcatgctttattatttcttccatttataacctctagttctgctcccacaaaaccaaaattctctggggggtaaaaacttagctacaacattccctgaaatagcgattagattgaagcttccttggatttgtccaaatccaaacccccatttctgtactttgctttctgtcttcaggtgatcaggatgcccttctctcatctgtctacctacagcctggtttgggtcatggcagcagtggtgctgtgcacagcacaaggtaaagaaactcaattcccctgcttggagcccagcaaacacaatttctggggtgaagacatttagccagtattgtttgtgctgtgctggttccatttgtctgcatgaattatttaagcatgtaatctgcctggaggagtggacgtggttcttttctgctttccacacttttgttttcgatgtagaagcacactttgatatttagaagccgtttccatagtagatgaaccagacttatgaaaaaatcctctattttaaaatgtcatttttcacttactgaattgaattacaaataatgatttcctctgtttttaaatatatgggaatgcttgaattcaatctttttggaaagtaatctggcagtaagccttaaaattggatgtgttacctttttacagaaaaatgtagaaaacaacgaaatgtagaagttatataggctcatattatctattgtataacaaatttggttgtgccatctacttatctaccgaagttcctagctcttcctcctcagttccttgggaggccacactcactttaccactggccttttcatcacttgcagtgtgatgttgctcagcatcagcctccacagatgtgggtgatgctggtgaagatcagataggcttcatgcccatctccaactctggtccacaacattcatcacaggacttatcaactgaccagaggaatctaagtgagattccatagaggtagcaaagaattgtaaatttcccctaaatgatttcttccatagtcaaaaagaaaaaaaaaactcatctaagagttgaactctagttttgagttccctttcactctgccttctaaaagcagtaatttcttcaaatctctggtctgcaaaatctcaacaaactttcaagaagtctcaatcctagcaacagatagtttcccagaacttttcacatctcccaagagtatacatcatttagttttgaatcatgcaatactcaggggttccagcctgtatttgttatacccatctttcattccctgatattgtgggggagttgcttgtttactcagccttctttttttttctacttatacttgtcaacattttatccagattatcagtctttaaaaacaagtctggatgcttgtgatcaagtttacattttgtgtaccattttattagtgtctttatctttattaattcactgcgatatttgaaagggagggtaggaggtttggaagtaagtgtattcatttttaagtatctcttcttttctattaaatgttgctagaattaaatgtttctctgagaactgtccttccttccttccttccttccttccttccttccttccttccttccttccttccttccttcctttcttctttctttctttctttctttctttctttctttctttctttctttctttctttctttctttctttctctctctctctttctatgaaatttcactctgtcacccaggctggagtgcagtggcacagtctcagctcactgcaacctctgcctctcgggttcaagcaattctcctgcctcagcctcctgagtagctgggattacaggtgcccaccaccacgcctggctaatttttgtatttttagtagaaacagggtttcactttgttggccaggttggtctcaaactcctgacctcaagtcatccactcgcctcggcctcccaaagtgctgggattacaggcgtgagccactgcaccaggcatgtcttacccatgtctatagatttttaacatattatgttctcattgtcattcagttataataatttatgattttttctatgctttctggtgtacctaagacttaaaagaagtatgtaaatttctaattttattgtattatgaacggtgttcaaggccatacgtagggtagcaacttttttgtagcctattttgagttcaatttggaggaaggttttatgtgtgttttgaaaagattatacatcctttctttgagtaaagtgtgtgtgtctgtgtgtgtgtgcgtcttatgatatctttattcatttagtatgagttattgggtttgtaaagtttattatttctctttcattgtattgactttctcaaaagtttggctatttgttattatgttgagattttccatcaaataatctatcatagtatgagttgctaatattggagaagggaagaaatttatatttatacacacacagagagagagatctacatacatataaagtatatagtgtatataatataaacatataaaacattgataatattaaatacctaaagtatatatataaatatatattgtttttcaaattttcttttctttgtgacatggacttaccttgtcacccaggctggagtacagtgctgcaatcattgctgactgcatccttgaactcctggccttaagcaatcttcctgtcctatgctcctgagtagccaggactacaagtacatgacgctacggctggctaatttttacatttcttgtagagataagggtctcatctcttgcccacgctgatcttgaactcctggcctcaagtgagtcttctactttgacttgccaaagcaccaggattacaggcatcagccactgtacctggtagtttttcaaatttcctatttaactttttttcctttaacaattgtttaaatatattaaattgaaggttctcggtatgattgtgaatttaaattttttctttgtaattctattagttttgctttatatatttcggagttatgttgttaggtgcataaaggtttatgattactataatagatctgattttagattgttccttttatcattttgaaaaatactttttcccttcttacagtggttttgtcttccattcttttttttctctccttttagaagtcttactgaactgattttggaacatttaagtctacttattgaatttttccttaatcccttccatatcattatctctttgtgctacattctagaataatttcatggcctgttcttactttttactaatttactcttcagtagcatctattttgctaagtcagcctatctgttgcaattttatattcctcattttctatatctctaatttctactattcataatgcttttattatgcttttattacacttatatcatcacatgtattcatgtcaaagtatttattgtcttatgatatctttattcattttgtatgagttattgggtttgtaaagtttattatttctctttcattgtattggctttctcaaaagtttggctatttgtttttatgttgagattttccatcaaataatgtatgatggtatgagttgctaatattgaggaagggaagaaattaccaccatagcatttagtgaaagcagagggtgtgtaaattattatttgtgtgccaaagcttcaagattctccagaacattgtcccataaatctctttacctatgttcctatatacactcttgcttcctggaggcagacacctctgttccacctgcttcctttgtagattgtgtatgtgtgtgtgtttgtgtggaatgcatagggctgctccatcttctttacttacagtggtcactctgcctgttatcctttggccttttcctgctctttgcttctacttctccaagcatggacaagattggtgaagctgctatcctacctggcagtttacatcttcaatctcattgtacctacttcgcagcttacacagatcattcacaatttcttgtaactgagagttgctctcttgtttttctactctgctactattctttaaagattgaacaaacatatttgaacctatatatttctctggcatcacgtaggaatgtaaataaatgttttcttttttgcattttctctttcttttctatatttgacattgaatatacattttatttataatcaggaaaaagtgtatgtgtgttacaatctttaaatataaatgttcttttatgattccatagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatggtgagaatctctgagaatcattgtctgtgtctggaaatactatttgcaagaatgtttggaatatagccgtagtgcccagtttttcaggattttaaccacagaaagggtcatgagaagatagcctttcttgtctactatagctgtgtttatgattatttggagagttcatggggctacactgagttctttggctggagctatcttttctctgagggatcctgctgtcaacaggagaaatttgaggacaatggtgagggcaacaagttctccataagcagtgatatgattcagacctggctttgccactagcaatcatgcgaccctagaagggtcctatccactctccactggagtttcattgtctggacaataagtgtgaaatagatcatttctagggtcacttacaacttcaactttttggatctaaggacagagccagattggactagccttgagccagttatgattgtccttctcattttgcttggggagatagctctttcaggattgataagggcacatagagcagagccttttcatacctgaaatgatgccaactaaagatataactgggcaagagcattcttttaaaatccaagaggcttagtttgatgagattcttcttaactgacacacagctgagatgaaaggttacgaagtgagaataagagattactttggagcatggcacacacggcagtagttttagggagtagaggacaaacttatggttattaggaatattaaggtgagagtttactcatgccaataatattgcccacagggaagaaaaggcttagtagatgagaatgcaagggagataggacaatgccaaaagaaatttcttttacttattttgcctataatgagtcctctctgtagaatcttatgtcgtttctttcttgatttccacttctttcattctctctttttctgtttctcctccctgtctccttccttcctttcctccctctctgccttcctttcttctttccttcctcctaatttttctttttttcttgtgtcatatttttctcatttctgttcctttttattctcttcctcttttcctcacctttctttctcttagtctccttccttcactcatagacttttgtatttttttttcctgaaaagcagatgtctctgagctttaaagctagtaattctgttctcttccacactgaccttttccatccacaccttataactttcatgtaagccattctttgatacatcataggacctcaacactcagtctggcccatcaaccatattcatgttttttcatttctatttcccttcttccagcgctcacagacattagtaatcttagccagagccacagttccatagccctacttccccaacccagtgtcttctacctgcctcttgaacctataagcacagcccaggctttcagttagcactgccatttaattatcttgtgggctccaaagccaaccacagaaagacaagtttacatctgcttagaaaagaaaaattctatattccaacaaaaatgaactcactagtcaggggattttcaaaagggtacaggctacagctggcctgaaaataattttctcatgagctagttattttttcttaacttaatcaggtgatttccagtgctcttccaacagtcatttcttaatttttatggttattagctacgaattccaaattttggttttgtgtagctcttccaaaaagggattttccagctctcctccatgcgtctaattcactggtccagctccaagaagaaaatggctatctctaagcagtagcctttctatgggctctctgttccaaaactgccctagtgcctctgataggtacaggacacatgtatggcagtgctggttggtggttattgtcaagccatttaagaggaatacccagaagaaggcagagatgctgcattgcccctggaagagaacagaataattaggactgtttgggagagaaaagtatcatctgacttctcaatactctatgttcatctgacaaattctgctacagacaaattacagaaagggtctttctcatcacaggtttgtactaggccagtctccatcctgcagatcagaaaattagacacaagaggaactggaaagtccccagtttgggtaggatatgccatgctatctttctagcctccattatctttctataagcatatttccttcatctctctgaggagactgcaggactcagaccaggtgcttaactgataacagatcatatttattttttgtcccagtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggtaagagaaagtgagcaaggtggctgtggttgtgtctgtgtgcatggacctggaaggcagtgaatgtcctgcagaggttttcagcctcttagcataatctatttggagaaagaatggggcaaataaggaaaaaacaaaacaaaacaaaaaaattgaagaaacaaataaagcaagttttactttcataaatgtggttcattgcccacacaccaaatgctgttgctgagatccattcatttatttatttcttccactctactaacatgtaattaggtctgttctgggccagactttgagttgaacatgaaaagtgcagcaatgagcaagactcagtctctaagcttctagtctactagggaatagagataaatggatgggcaattgtaaaactgtgcattacattctccagtgagaaagctatgatgcaccatgggaggattggaggttgggaaggaggggctcaatctgggggagatttggaaggtttcctggaagaagtgacatctgtgatgaaatcactgtataatctacactgtgagaaagggacctatctgaagtgctttcgtcacccattttaaagcaaactgcctcctatccaagtccctttttgctttcttgtgtttttgtctaaactactgtctctgggcctcatagatacaagaggtgagaatgacagaggagagaataaagggagcagagattataaagacaagaagttttagcaataatagccacgtcttttctctgtgtagttttgaagcactgactcttgatgaagcagtcagtaataagcctcctaaaaagtattactcctcttttttggagaaattatgagcaataaactggaaaagctttctacacccacctctttactgcagtggcctttggagtccctgaaaacccagactaatcagaaattggatatttaggtaaatttggtcaaaaagacttgcagtgttggatttggatatttgtgaagagatcttcagattcagccatggcaaagggtatatttcctggaaaaacaagaacctaaaaaagaatgtcttttttttttccaagaatgccagatttgacttatatcacttacagtgtttatataccacttgtataatgtttgtttattctgtgaacatttaccaaaaaacttccatgctcaaagcattatgtcaagcactggacctatagaaatcaaacaaatccctgtctgaggtctgaggtgttcagttaaataatgatgtgacgaatcccattatggaggtatggagaagatgctagagactcccaaatcaaggagttcctcatttgcctttgcattgcaacatgacactgaggaactgatatttaggctgagttgcattaaagacatagataagaagaaatttaccaaaaactttgagatgagttatctctgggggttgaaatcatgagattcatgtttctttctttgtacttctctgcattttccacaatttcctcaataaacatgtattcttttaatagacagtatggcaaagaatatgtgctttagaggcaaacagactttcaaccaaaccttggctatcccatttgttattctgattttgatctcagttaaattctcaaagcctcagttttctttaaatctgttagaaaataataactcttgggatgttttgaggattaaatgcgataagtttaaagctcttattacacagtagccagataaaacatgttagctattactaatatctaaatattattaaaataatatgaagtcatacgtataaacctacatatgtatgtatttaaggataattttaactaaaagctcaactctttttgcctcaacaatttcctcatgtgatgtcattttcctttttctttcttcaatatctataggctattggttttcagttccgctattgctaagcattgtttccctggtaattcttctcgtcctaatctcaatcttactgtactggaaacgtcaccggaatcaggaccgaggtgagttgtcacagggagttcaaaaaatgacataaattaaatttgatttttaatgacaatttgtgagtcatttgaagatataaataagggaatggcaacaatgtgttttgtctgttgtttccaaaatacagaaatgttgatactgttttaaaatgcgtcggggcattttcttgcaattggacattaaattggacatttctgctttttgtttgctaagatgacttaaaagctaatgaaatcaaacaatggtgatagaaccaaagaaagaagtctggcacccacacaaggccctttccactcattaatgagaaggacaatctcttctctttttatagcacttcacaggccatctgcccatttaagaggctgcaattgtccaattatgatcactcattaagtagcactttctgtgttatactcccacgatgcctcaaacactgtcagcatcatgcaagtgatccatacttacagtaactgtgtcatgccattctgcccttctagactgtaaatttctctttatctttcacaactatcacagcatcttatatataccagggtctgaataaatgttaatttactgaatgaactgattgaggacagagagaatttttaaggtgattttttttcaattccttttctcctattgtaaattcagtacctcataaacgccagtctaagatattgtgagaaattataaaacaagagacactataaagcaagagcagtgagctagatagagaggaagaatgaaatgtctttggtttctgtagacaatgcataatttattgaagtgaatacaaagctgcagtttatgttttgtgtaatggaaatttgctagggtgaaggggtgatgtgggagtttcctccatttcagatgactgaaggataggggtcaggaaagaaaaatagttggctttgatagctattttagactttgattaaaaatctcactcattttttcctttcattttatgttttatagaaatgtttccttttagttttatgtttatatttttatgtttttgttcatgtttcaagtttttgaccactttattttgcataatcctccagattaattcttgtgaattcataaaacacacaaaaagccttcagtgtcagtggcccttttgcaaaagtaggtaaaggtatttgttctgtccaggagagaagattacaaatcagttaatcttactacacataattataagcctgtggaactcataagtgctccacagaataaaatcaaagacagaagtctgtttgattctactttatccagaaatttttcttttccaattaggaaactgaagcccagagaggaaagctgacttccttccataagtttatacagcttcttaagagcaggctaggactaaaccccggtgccctgacctctgccaaatgttcttcctgtcattactgatgccccaatgtcttgacttgaaaggagctattgttatcagttgcattcacttaatctgtgcttactgtctatgcccttttcttttggaaagtgcaagcagacaagtataaagtatttaaattcatttttaaaagtccctcttgggcaaaagttttataatgcaatctactcaagcctgaggtaaattctactggaaagagacatgcaaaataattacccttgttcattaagcaagtcttggattttctgggaaatatagtcattcaatgccaatatccgattcttgaagcaaaaagaatcagcttatttctctgcccaagtttttcctcacttatgaaataaatacctgaacctatgttgactcctgtacgcatcaggattgccatttactgatgatgtcttcatgacatatggccaattgcattaattcctctgaatgactggatttttgactcatttcttttccatttgtgttgcttacaaaagttacctgaggctgggtaattcataaagaaaagaggtttatttggtttctaaaggctatacaagcacagtgccaacatctgcttctggtgagggcctcaagctacctccactaatagcagaaggaaaaggggagccagtgtgtgcagagatcagatggcgagacaggaaaataaaagagggtgctgccaggctgttttaccagctctcatgggaactaacagagagagaactcactcacaccaagggcattaatcaattcccaagagatcttccccccttaaacacctcccattaagccccacctctaacaccggggatcagatttcaacataaggtttgcaggatcaagtatccaaactataacaactgatttagaaattttaacagccagataatttggcatcatacacttacagctagtaaaaccaagagtcaattatgctgaagcttaaatgctcagggctaagaaaatactggttcatttagaccaaacttcaggttatacaaaaagttgggacaaagaaaagagaaaggacagaaaatcatagaagatagtgacactttttatttctaccattaacaaattctgattgatattttgtgaggaagggaaatagtcctacacatttgccttccagttgttttcatccttacttttcttttctttctctttttctttccatcatctgaaaacataaaatttccaaatgagcaggaaaacacgattggtccaaaataatacaaaggttttgaacttggtgacctcaaaaatggtgatgtgaacagaaacactaaagtgaagaggtggaactgagagagagagagagagagagagagtgtttagagtttgtagaaaagcaaaggagacagacgaataagtttttgaatttattgagtgtgagcagacaaagaattatcttcatgtagctgtccagtagccaataataaaaatctggtaagtaaggtaagtctgttaagtaaggtcaattctgtgttgggtaaatgaccaaaacagaagtttattttaggtcataatcactactcattgctcacaaatgcctaagcaaacttacagttactgatgttatttttacgtagaagttagacgaccattacttttcttgtgatcctgtataatgccagagagcatgacgttggttttttccaactgcgaagtagcacaggccatttttctgcaccactcctgatagaattatcacagttacttcccaggagactaccacagtaagactaataagatttcaaagagcattcttttctctttcatgaatccagcactttaaaacagtaagtgagaaagaattaaaatttcctagggaaattttccaccatctcgaaatacttctttctattaaaacccagtgatttcataaagttgtgcctttcacatatatgacaatgtagttaaatttggagttgagaataatcttttatttctcattagtcaacccaccaacaattacatgcttctcagaaacaataaaagaaacttcactttgaggcagatcatcatagacaatcacctaatttttaggcagctttattttgtttggtttggtttgctttgctttggtttggttgagtcaaggctgctttggagaacaatagaaaatttagacaatcatgtaaaatttatatgccaaacttcacttttttttcaagtactagctaatccatgtagaaatatgtttttcatctgcatgagctgtatatttatcttgatttccttctcttcacaataacctaacctatgaatgggttcctgacaatgtataataacaatggcaaagttaataaaacgtcatttcctggataacagcatgtgactttctcctattttaagcttaatacttaatacaaacaacaaaggtgttcgataaacaatttgtgatgatgtaattggtcattagttgaaaggggaaaacaaaaaatatctgttcacccctcctgaaataacaacctttgctttgctcagaaagcacttttgcttcccgtacaaaggctgtatgaatgggtagccctctgtccgggctgtatgaaataagaacctttgctttgctcaaaaagtacttatgcttccctgacagaggctggatgaatggcactacccaaccccaccccagtatcctcatagttccaggaggaagaaatgtgatgctttacatgagaaaagcgataaagaatcttcattgaactgcttagattagtattgctgggagaaatcttgaattccagggctatttttccgcaaaaattttacaaattttgggtgatttacctatcatgccaagatgacatacataatcttatcacaaaacccttagcaaacagattcttaatgcctggacattcttgcctggagctgttctttgctgttctctctaacatctaaacccacatgggcatagatgacccaaattttaagtttcagtctgtatgtggggaacatctctaggaatcaagacatctcagtctcctgcccaataattcaatgtgtgttcagtcctcaaatggcatactcattcccttggctttttggccatggggcttttcaaggagattagctgtcagtacctgttagactaattaatgaaaaacaaaaaggatgagaaaatctaccagctgaaaaatcctctaacatctctgctccttttgcattttagtttgcatatatcctttacctagtgtctattaccagtttgttttgtttggaaccgctgtgcatttcagtagtatagtcacacccatataataagcttgcctctaaacagatacaaggccctagcctctactaacaaaagaagccaactgtatgctatttaaactggaaaagattgggccacttaatgaaagtactcaacatggcttacagagggggaaacatcataaatgctgtattaattttctattgcttctttaccaaattatcacgcacttagcggcttaaaacaacacacatgtattatactacagttctagagatcagaagtccaacatgggtctcactgggtttaaaacaaggtgtctgcagggagacattcctttctggaggctctaggggagaatcctttttttccctctctctcttttcctgcttttagagactgcccactttccttgccttgcatcttcaaaaccaacaatgtccagttgagtctttttcacactgaatcactctaaatctgaaacatttgtctcctttttcctttataaggatccttgtgattacaatgggcccaactgcataatccatctcagggtccttaatttaatcacatcagcaaaattcctttagccatgtaaagtaacatattcacagattcctggaattagaatatggatgtctttggggtgccattattatgcctatcacaaatgctaagagggtgtgggagtgacttacttagagggacagctgtttactgacctcccagtggaagcattctctctctgtaattccatagcctttgctctgttcctggcaactctctatcaaagaacttcaaaacctggtcagaacctctgaccaggcaaggctttattttccaggattatattttgtctctcaaatctgtaatgcaaaagcatcacttctgctttcccttgttttctatcactaactataatattacaaaaactttttttttcttagaatctcagttcttgcatatttcctgcttctccctattcctaccttttcatagaggaagcaattctgacttcctttgtcttcgtcataagcatcccgtaaacacaagttcacagggaactgtgaaagttcaaagtgggaaaattatatttatcactatgtgtggtgatagtaggcataaccaaattggtctttccccgcttatcataacgtattaaaccgggaatttctcagtccctaatacttgcagagtcatgttatgaggtcattatagattttaggagcctcaatgcttttcatatcattttcagaattcttcaaaattcccatttataggccctaattgatttcagcagcccagatgcagtagagcagttcttccactaacaatttttttaaagacagagctaaaaatatatatatttgatgaagtatattaagtagaaaaaaatgttagaaatatcagaaaaaaattaagaaataaaagtatgttcagtacaatttaatttgaataattttaatctctaaaaataaccatattgtaaaaaaatacaatttcttctagtaaataaagaacaaatgagattttgtactacaaacatgcaagacatgttttgcaaaaatcacaacttcaatgttaagttccgcatttcatgaggcacaattatggaaatttatcaatgagaggctattaaaagagagcctcttgcccctctcagtattcaaactagatagaatttcatgatgactgaccaatgctgctagttctgagtctccgtggacactagtttataaatactccaaccttctcccttttttatacaataaagagaaatgctagccttgtgttttgaaagtcctttaaagagttcatgttaaatacctttgggattatgtacacaattgtcttttaatcttttttaaaaatattacttattatgaatttttgtttttattttttaattgaaaacagaaattttatgtatttatggtgtacaacatgatatttctatatatgtatacattgtggaatggctaaatcaagctacttaacatgtgcattgcctcacatacttatttttttgtggtatgaacacataaaatctactctgtcagtaatattcaagtatacaatacattgttattaaccgtagtcaccatgttgtacaatagatctcttgaagttattactccttatctaactgaaattcttttcatcttaaccaaggccacatgaaataagaaactgaatgtgatatttatttctacaatatttctccttcaagagtttaaagttttcaactgttaattttagcaaggatgattgcaaatgacatataaaattggttgttttctagtcagtcatttttatttgcaacaatgaacaattacttagcgattttgatcaaatcctgtcctttacaaactagctgagtacctttggacaagccatttaacttccctgtgcctccttttcctcactgagtaagatggggataataattgtaactgtatctcataagaatgttgtgaagatttaaacgggaatacatacaagtgcttagaaaagtgcctaatggccgggcgcggtggctcacgcctgtaatcccagcactttgggaggccgaggcgggcggatcacgaggtcagaagatcgagaccatcctggttaacagcgtgaaaccccctctctactaaaaatataaaaaattagccgggcgtgatggtgggcgcctgtagtcccagctactcgggaggctgaggcaggagaatggcgtgaacccggaaagcggagcttgcagtgagcagagatcgcgccactgcactccagcctgggcgacagagcgagactgtctcaaaaaaaaaaaaaaaagaaagaaagaaagaaagaaaaagaaaagtacctaaaacgaatgatacgctggaacactggcctgggaggagaggggcggagtgtttatttgtagctgtcgccaacttccgtgaagtaaatgttcccaccatagcaaatttcaagctactaacaatttaaccatcagcgtgagccaataaagctctagcacaccaatgcggcagactaagtttgtaacagatgttcatttttgtaattactaaatctaaggtcctttttcgttttatcgaagtatattttcatgaattgtacaaatgttcaaggaaggacgagtttagagaggtaaatggagggacaaacaggaattgtagcagttaggacagctttgaggaagatttcaggttatctgaatctgtttggacacatgggcatgcgtatttggaagggagaagaactcatacagtaagtcttaatgtcatcaataggttcttggaaactgcgagtttaagcaaaacggcatgtaacagaaccaattttaccacaggctaaatgatagaaacaagacttaagttcctatggcatatttctagtcacaaaaacatcaccaaacttttaataaagaccaaaacatttctaatattaaacattgaaataaatgtgagttatgcatacatttaagaaacagtaacaaaaacaagtgagataattattcactcaatgatttcagttcaagggtatgggtggccagagcctatgcagctcaggatgcaaggcagacactgacaccagacaggacgtcatcccagagcagggggcattcacacacgcgcacacacacgcacacgcacacacacacagttactcagactgggaccatttggacatgccaatttacataacatgcagtacgtgtttgggatgtggggggaaccagagtatccagagaaaacccatgcagacttggggaggatgtgctaactcccacacagtggtcctggatgggaatctattgtttttctcatcaacattataacaacatgttgtggaatgaaaggatgttgttggaggacctgctatataagtcatttcagtagcagtcttgggagaaatttgtgggacccactggggagacagaatcagaaaatgtgcattctaaaaacgtgcgtatactgaaatgaacttgtgatgcctagatgaacttgtgatgccgaaaactgatttcctgctagtgcagttgtatctctttttgaagaagagaaactgttttgcttagacattttttttgtaggagtatgggaagaaaaattactcactgaagctagtgcgagtcaagggtagagggagggcagttcctgtaaggatgtgtataaatggatttccaggaaactaaactgccgcatgtcaggaagagcggctacctgaaggtgcttgtagatccaaagctgccctaggttccccatcagcactgattcatgagttttgcatctagtttctcctgtccttaccacaacttggctgttctgtcttctctgcactaaacaacttcttcactctctattccatatgttttaaacttatcttactatttttgttccctcataccttgcttcatagattacccaatccaacaagaaacaaaagagagaaagaaagaaaagtgagaggaaagaaagagagagaaagaaagagagaaacaaaacgaaagtatattcctgaaccacacaaaaagacaaagaatcacattctctacaagtgtcctgtgtttttgcaaattaaccggtacttcaggtagtccttaggtattctagagtttagaagaatcctaaaaggttttgctctggcaagggctgtgagtaaagcatggcctttgaggcgatggagggagaaagatatatagaaactttattttagagaaaggaaaaacttcttcagaccagatgcagaatcaagtaatcaaccattcaaagtcaggcttaatttaagagctttttttaaaaaaaacagacaaacaacaacaacaaaaatgtatactagtgatctttaaaggaaaccatgctatcatttagattattattctggattccagtcagtagttaggtcatataagaattataaattctgttattggtaattgatagttcaaaatgcatagtctcaccactcagggaaaacagcacttagatttcagaagataaaactttgtaagtggggatgaaaggagggcatggagggtgttcttaaatatttaaatggatgttcatgagacaaaaggactagacctggaagttattacatttaattctcatagcaattgataaggaaagtatttccatctgataggtgataaaaccaaattcacagaagttcaattcattcattttataagtatttattaataatttttaatatgcttggcattgtaattagcactggttattatactataatgaacaaaacaggaccttgtcattttaatggagatgacaggttagggggacagcagagaaatgacaagtgaatcaacaaataaggatactattaaaacacgagattttagcacaaggaaataatatagaataatataaaatatagcatgcaatgaaagaggataacttgaaaaggataccagttacttggattttgttagggaaggcttcgctgaggtggtgacttttaatcagagaccttcaaggagagaataatccagccatggaggagacaagggaagagtggtttttagcaaattaattgcaaatgtgaaagctctaaggcagaaaagtcattaatattttacagggtgcggtggcacatgtctgtaatcccagcactttgggaggctgaggcaggcagatcacctgaggtcaggagttcaagaccagcctggccaacatagtgaaaccccatctctactgaaaatatgaaaattagccgggcatagtggcatgtgcctgtactcccagctactcaggaggctgaggcaggagaatcacttgaacctaggaggtggaggttacagggagcagagattgcgccactgcactctagcttggttgacacagtgagacttcatctaaaaaaaatatatatatatatgtatatattttagagcagtgttactcccaatatggtctgaggatggttgcccatccaagaagtgttctttactagtctgaagtaaaataagtacataactgagaaaaaatgcttacactctatgataagaatttgacagtaattttatatctgttaaatctgataatttaaaaatgaattatgttattttatgtcatttttctagtaattcgtttttactattgaaattgaaaaatattgagccatgttgggagaagatggtctttccatggtccattgatatctgatgttagaaatattgggcaggatctaaaatgtgcagaactttgcaggttctggtaaacaattacctaagattacacagagagtgagaggtggtgccaagataaaattccaagtcttttacttcatcgtctatgtgccttgagaggtttccaggctcccagtatgtgccagaaagccactagcccttggaaaggcctctacttcgtgaccatttctaccctgacatccagtgagttattatccatcagaaacaaagcttacaaatagaatacattttgatcatttggaatttttgaacatattcctttacttgtagtcttaggtgattttctaaaccattatttcctaggattacgtatgcccttttatttttgcttcagttttgtttttgtttttggttgttgttgttttgttgtttttagagatagtgtcttgctatattgcctggggctggagtgcggtggtgagatcatagctcactgcagccccaatctcctgagctcaagttatcctcacgcctcagcctcctgagtagctgggactacaggtgcatgccaccatgtccagctatttttttttttatttttattttttgtagagacaaggtcttactatgttgcccagactggtcttgaacttctgggctcaaatgatcctcccgcctcggcctcctaaaacactgggcttacagccacaagccactgcatccagcctacttttgttcttgtaaagagtcatagtcccctcacaccatactgggtcagaaatgtctacttctttatctttgccaatgaatatacactagaataactctgtgtttcttaatctctctattatttatcttcttaaaatgtattatgatagaatttacaagtgtccaaagttaataccttgtttttcttttatccagagccctaaataagtcacacagcaccctgaaagtgattccctggtctacttgaatttgacacaagagaaaagcaggaggaaaaggggccattctccaaaggacctgaaagagcaaaagaggtgggagcgaaagccttaaggatcccacgactttttactgccatctgagctactcagtgtttgaatcccaagaggaagtcagtttacctctcaggtctgttgtaggacttgattttgtaaagcaatgccatgttatgtggttgaaagggcactggacttagttagtatcaggagcactgagctcacagactgacttgggctcctactggtggggacctctgttagtcactttacctcatccaaagtataaaggaattggaccaaataatttaccacatagctctaaaacttaatttaaaatgtaattccagaaaaaaaaagggaataagcaaagggggaagaattgaaagagagagagaagaaagaatacagagagcttaccttttgcctttctgttgatgttacatctcttcttcctatgttcttaggtctatgagtctgtttccccatcatttggtatctagtccagttcctgcttactgctttgctaatagctggccttgctagaatccttggtttcactgctgttcttcatgtgcttctatgagatttactccaacacaaataggactgaatttattgtgaagtaacattggcaatcttaacttattcatttaacttatttttatagctagataaatattgttagtcttagacaatagctcacattttttgagaagcatgccctccctgtccatttgtcttataacatgacccagccctattttacgtcattctaaattcagcctcatataatgaaaatacattatgaaaacagatgtttaggagatttcctgtatagcagtcagccaattcatatgctttgtctctgctggcttctttttccatgcgttaacttttcccaatagcagaggaggcaaatatgagcatacaatccctttgttctaaagatattgttccagctagtggaatgatgttgaatctttaataaccataattagttgctttttcagtatcttctgctttgtctgtgtctatccagtggcctaggaattaaagtgtaagttgttttcgctgttaaattggatatttatatatatatatatagcaagattttcatgtgttatttaattctgtattgtttcttatatttgtagtaaaatattgaacaattaaaagtgttgactccaaatatttggcttatgatattctcttgggaaatgtggaaatgaatgataatccttgtcttttcccatcatatgtaaaaccctcccctcctctctatctttcccctcctaaaagatgagctgggctgggcgcggtggctcaagcctgcaatcccagtactttgggaggccgaggcgggcggatctcgaggtcaggagatcgagaccatcctggctaacacggtgaaaccccgtctctactaaaaatacaaaaaattagccgggcgcctatagtcccagctactcgggaggctgaggcaggagaatggcgtgaacccaggaggcggagcttgcagtgagccgagatagcgccactgcactccagcctgggcaacagagcgagactcggtctcaaaaaaaaaaaaaaaaaaaaaaaaagataagctggtgtttctgactaatcacaaaaacacaaatcagatgtctggccggtgtgagctcctttgagttggtgcctatgtccttttgacatgaccctgtcagttctgcagcacttctttatatgtgttcttttgattttgcttttagataccaacctttgcagacagattagctcacatagttttgaatttagtgggaaccaaccccttgtattttgctgtatttctagtatctctgctaaattggtactagatcaggcaggatgacttaatgcaacagttcttaaacattttggtcttaggacccctttatgcatttgaaaacatcattgaggatcccaaagagctttttctgtaatgtgaattatatctgttgatatttatcatatttgaaattaaaactgataaaatttaaatacaaaaatgtgtaaccatatatcctattagccatcagagtgatgccaacatcaaacatcatatagcttctggaagacttcagagcacatttattagagaatgagagtgaaaaagtcaaataatttattggtgttatcatgacaataattttttgattatgtggaccccctgagatggtcttagggacaatgctaaagactactgttttaaagtattggcaaagaagaaaaccaccttatgggaagatttcatgagtctttctcaaaggaactccttgctaaacatctatcttcatggtacctaagcatttcaccttttaaccaggactttaggccattgtattactgggagctcctcctcaaaatgcagagaaagctcaaagactaatttttatctattgttaataattcaatttaaattggcttattaaatggcttttcagttacttttcaggatgttgagatacttggacttaggataggtatgttttatggggaagacttgggaggttatagagaaataaaggggagaaggaaagggtaattgagagcatgcctctctgctgagaaggtggctccatgtggaacaccacagccttgctttctcctctatgtctcctgccctctcaccctggctggctgctcaccaacccttccatacttatcctaaactttcaactatgggtgcttttttgtatttgtgaattagaaagaggtagcttgggctttgcatatttaagcagattgggaaagttgtaaacttttgagtcccttagaataactcagtcatgtatttctcttcttagtaaaaattcagaaaaattccagagtagtgcaaacctgcttagagagaggagaaaacagaagaagactgttgtgtttaactgaaactgaaactgcaaatgaaggggtttttttgtcattttatgttttctttttggtttgtattcctcaatccgtgccttgataacaattcataaatctaggttcaaagagtacaaaatccatattactactaggaatcataaggctttgattaaaataatttttttgaactttcttctatggctattctgagctcagaaagagtattttatttaatttttgttgtagagacagggtctcactgtgtcacccaggctggagtgcagtggtgccatcatagctcactgcagccttgaaatcctgggttcaagcgatcctcctgcctcatactcctgagtagctaggactacaggcacacatcaccatgcctagctaactttttattttttgttgagataaggtctcactatg

SEQ ID NO: 17500 - DNA, 7441 bp, Human
ccttcctccccaccccattccagctcactcacagtagcctttgtacagcttctgcgtatgcctctgccggctgaggtctcgatcccaggcgatgtgagtatgtcaggtccaccacctgttcccacctgtgggcacagagtagggagtgggatggggagacatcagcggtcagcaagacactacctccatgccgtgtagccttcttcagggctctatctcccagtctccatccgagcccccttcacgtcccgcccctttctgctcttaaccctgcctccgctccagtatcccacccaccccaggctgtggctgaagtgttcccaagccctcctggcccggccttctgacagccagccccgctccttcaagtgcagtacctgagcaccggccgataatccacgccaaagagctgctgctgccgctggaggtggttgggagtgtcgatgggtaccaggcgggctccgccctccgccgggcggcacaccagcagccagccttcctgcagcccgcagtcgcccaggtgctctgccagctgctcctgccgggacgcgtaggatggggacagccgtcagggaactgcccagccgcctgtcgtgcccagcccagggcaaagggcgccgaacgcaatgccaactcaatacaggggagaaaaggcaaacagccagaggtttctctggccccaggggtcttttaccgggtcctgggcagggaagagcgcacctttgtcagcttcacccagagcccgtggccattgcacagctcctcgcccgtggtgcgcacgcaggcgccgcgccggagctcaatgctgtcgcgggcggcgcggaggggcccggagccggtaccgggggctgggcctgcggcgcccacacgcagccccaggccctctgcctcccacaccggcagaagcacgcgcgacggtcccgctgggtccttgtaaagcttgtagagcacctctcgcggcacgaaagccagcgctgctggcagcggccgcccggcgcggaggctccgcgctgcctctgccaagaagcgcacgcggcccagcagctgccggggggactccagcaccgcgcccgggccaggacccgccatggcgaagtggcggaggtgagcacctagaggcgaccctgcccggggaacagctggcgcgaccgcggacagagcttcccaccacgcccttccccgcctttggccagcctttgccgtatgttctggactaagcgcaccccagctctcactgtattggactgtgtactcccacactcaaccatattacttatctctgtgccaccctaacccagccgaccaaacccaagattggtgattgctacctgatcaatctccctctctccatttccttgtgactaccattttatctctactgctactaccctcattcaagtcaccattctagctagcctgggtcattgccaacagtcatttttctggttcttcggcctgctgtttttcctcccactcccagcgaatctgctggactccctatcctatgggtggtgtgattaaagtgtttgagacaatggccccttcccctgccactgacaggagtcttgagtcattagggttgattctgtttgtcactcctaatcccaaggacactggagatcattattcattttaatgtgattgctgatttctgtttccccagtcttgtagctccttaaaggctggggctgtcttgagcagagctaacctctgcacctactataggtccaggctatagtatggacctggctggataagactgttggtatcatgagtgggacttgcgccaagcctccggatacccagactgtcagatgagaacaaattcctcatgacaccgtaagatacatttacagcggagttttcttttgggcctttgttgttgcgtcgctacagcaaactttacggtgaaaaaaggtaggggtcctacgggcagcagccagggcagccctggagctgtcgctggagtccgatcatgtgatcttcaacatggcgacgctcttggttccctacagaaaggggcggagcctggactggggggcaggctcagattcaggttaaattgtggattgagctcgcagttacagacagctgaccatggaagcgaatgggttggggtgagttctccagagcacgcggtgtggctagccgggcttctaatttgagtcttccaactcaggactctatccctctactcccctttccccaccctggagacctcccaacctgaactccgttagctgggatcctgaatcctaaaaccatggatttttgagatgttcatcccagggccttaattcaagggatgcctcaggatttccaaccaggatctctattctgggaccatcaactctgatccctctttatcccccagcctgggtatttctcagcccctgaaccagcccagtgacattcccgtttctgaggctcactagttcgaagacccccaaactatccttagtgggccttcattccctccccccagtccctctggttgcttcgagcttggaagagtagagactaagtggagggaagaggccccagggcgggcccttctggagtttgtgcaccacctgataggcagagaggaggtggaacgggcggaaagccagggtttgggagctggcctggaggaggtagatagcggtcctggactgaatcggccttatgaacccgcgctttccccagcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccaggtaagagtcagggtctggaaatctagataaaactccggagggagaaaagttttcgaggggcaggggagggctctggagggcctcaaggctgagccctgtcttccctctgtatgcagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtaatgtgggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggcttggatttggtctgtaaggaccagaagcaagagtgtcctaaacctgagagggcaggggtcttaatgccagggatgaaagaaccttggcctccagtgatctagctgagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccggtaagccatggaagggtgaggccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggtaacagccagggcccctctgtgtgtctgttactgtgcactcctgtggctgtggttgtattattctgtgtgcacttgtttttaatgtctgtctgtccttttcttctactctgtacaacataagccctagaaagaccggactttttgttgccgttgttcatttgtgtttatgcttcatgcctgggtccatactagggatctgataaattttattgaatgactgaataacactgagtagaagcatgcctacatatgcgtttgtcactagtatatatagggaggacaaaggcttgctggtcctcctgtagccagtgccctgttggtcccccaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaactattgtgtagttttgtttgtgaaagattgtgcccatatcctcagttcttcttagcctctgctccttccctgggaaccctctctatatcctcttcacaagtcatgggggttaggtatcagtgaatatgtactatagcacttaaggattctcattcccatcttactctcagatacctaagtcccagaactacatggggtagggtagagctttcctagcagttcaggttgtgacatttgcagaaaaacgggtggggtcctcacaacatacaaaggccaaattgatagggctttatgtctggggaggaagggaagtatacatcaaaaaggggcacagaaggggttagaacacttcagagaggcatggggaagaagatggagtctaggcaagcagggagaagctgagggaccctcagctttgacaccaaaatatatagaggacatgaaagctcagagctaggttgcttaggattggagctttagacaagtcgatcatcaccaaagcaagaagtcctctgaaaccaaaagaccctctggcaactcaaggttgctttatattcttttctgagcatcccctttaattttctcaagatcttggttattccacccttcctggtggtacctgcttcccaggacaaggctctgaggtgtctgtaagccctggggaagggtctggtatggcaagaaattctttatctgtcagtcattctgcatctccttagaccactaggcacccactgtgctgtaggctgaaccagctccctggcccagccagggcaatgcagaaaggagagatgggtttcatttagtgagagaacacaatttctgcttttagaaaaatgatcttttatgtgatccatgatttattcatagaaaagcactgtgaattcacacacttgctaaaaaagggcaactgtgatacagaaatgagagtggcttctctcttttttttaaccaacccattgggctgagacgtaggggcccttggctggacagtaagacttgagtagccacaaatggcaaatacaacttcttggtcagtttggagtaaaaaaggtgacagtttgtcgaagaaagaaaaagtaaagcagatggagaagttcttagttcacattctagctataccaccccttccctatcaaaccccacccccaactcaggaactaagacatgaaacagtaaacaccaagacactggttccaactgacttttctgagtgcccttgctacctcctataacaattccaggctgagcacaggggtcaggaaggtagcaggaacatgatacactatggaggtcagccagggctaagacaggactgcccactagggctagaaattaggaagggagaggctaagtgcagaccagccctagcctccaagtcagcgagcaatgagactgtgacaaaagccggcgaggaagcttgaggtagaaaggcaggggaagaaagcaagtatgaggcgagaagagaactatggagctaaagcagccaatctgatggcagagggagattggtgcttagaagcttgtttggtgagagaatgaatagaggaggcacagagatggggaacaaacgtttagctggcgagagagatttaagaggaatgggaaagagaaatctggcaaaaaggacacattgatgcagatcctcaaacatgaatacacagacatccctacatgtagaaatacgctcagttacacatataaagacacagatgcatggataacaagcatacacatggatacaaacatgtttatacacatgcactcgtgtacgcagatacacatactaaacatgcacaaacatgagtgcatttgcacaaagatgtgcatcctcacatgtacacaaaatgtgtatatcctcacgtagaaactcacagtccagtgtgcacatattcaaacaggtacacagccatagaactgacacatacacataaatatatatgtgcacaaacaggcatgcacagatgtatctatgtacatacacacatgtacttagccataaagatacacacacacaattatagatgaaaccac

SEQ ID NO: 17501 - DNA, 41884 bp, Human
aactctgtatcaaaattcgtagaaaataatctgagtgtgtctttttgaatgaactaatcagaagatgacgaaatacagttgaataaaagggatacagaagtataaatacagtgtattatcttaaagaaaaatgaaaactgtatcaatatgctaatgtgttacctacctcttttgagttccggggttctgagtagtttttaaactttttcacactcatttggagtatcatttccaaataatttgccatagaactaaaatacatttttaaattaacttgcacagtaaactaggaattcagccaaagggaactgaaaatttagatttatagtaatcaggaagttgatccttgaacaagatagagttggctcttggacaggaaagctatctccttgaccatatggatttccactggccttacagaaatacttgtgctttgatctggcataggtatctttttccaactagctggactctattttctgaacctaacacccaaggattttcagtatagatagaaaatctgactaaacatgtaactacctaaattggtttactgaaattttgatagactctgcccatgtagataatccttggctactgagttgataatgaagttttaaatcacttatctgcgggaccctggacacagggctgtctttaaactcttccactgagttccaatggcctcattagtttcattgaccttcacagatattataaatttggaaagccagtgggagaacgtggcaataactagaataagagtaataggtgacattaatccatgttactatgtgatggatgttaccatgagccctgcacccagattaccttaattaacctcatagcaatgttgtgtcaaatgtactgagttatcaccacattgcatatgaggaaaatgaaacttagaggggtaaaataaatttcccaaggttacacagctatgaaagctgagtagggatttgattttagagcatgtgtaacaacctgtacctgaccatttcctgaaaatagggctactgcaaaaaccaggagtggaactcatctaattccaatgaatgatctacctatgactctctagacaagtcacagaatttacccagtgctcagttcactcttctgtaaaatgaagatgttggatttcatgtcctacagggcctctctgagctctcaaattacatgcccataaaatatactagttgtaaactattagtagaaggagctttaaaatcactgtagggagtccaagatttgccactaactttttatgattggcagtggtgagccatttaacctctccagttatttgcctcacttcaaaggttatttttcatatatatgtcagtgcttcacaaagtgcaatacagcatagaaatacaaagtactatgccatcatctaaaataagattacttcatagcatcagaattatggatttaaaatattatgttgaattggcttctcactctttttccccttttacttagaacatctggtctgcaatattttaaggtaatgcttatttgtagtagatttaaacaaagagaggaagagaggtaaagacagagtttccgattttccacttacatatgagaaaggtggggtgtccaaagaagacacacagccctatacagggggagaaggtgtgcgttactaacatattaagtaaactttagtgaggaacagcagtggaaaataatctatataccttggctcttttgcagtttgacaaagttaatgattaaaatctcctagattttccactacagtatccccagggtgtctatttaccttgattgatattattttatctcttttgggccaaagataacagccccttgcttctgtgtttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggtaagatttcttttgttgtgaccatttacaggaattcttactagtttaattttatattatcacttaaaaaatgaaataaaaagtaagaaacagaagaactggtgaatatgttggggagagggataaggaccagagaggcattaatcagagctccacgatgccatgtaatgttgaattggaattgacaaaaaaaatcaacacaagaatcttgttaaagaaagtaaatggaatgatataatttgtcaattatctcttcctcctttgttgataagcaagacctagagagaataatttaaaattagacatttgctaattgttacaagataatgcaaataaagactgtgatccaccattaagcatttattcagacttcaaatatttattaccattgagtgtaatataccatgccaatgatgcatgatgtcaacttagagatttctttgatccccttagaggaatcttatacatgcagtatttgaaaatgcattgtatttttaaaaatatccctcacataaaatttttctatagctatgaaacataaccacaaataagataattcagttatatttttcattgaaattattcttcagatggtgtgttcatctttgggcaatgtttaaaaatttttttacatgataaagactgagattatgggaagtatacaactttatgaattctacagctgggaaacttttcatcattagcttcaatttacttttctggctgattctttaatgttcacaagggacatctgcatttatcctgctttgtaaaattaaggttttcatttagtgctgtcagttaacagcctcacctaattcgtacattattattcataatagtaatgtgttttgccagtggaataaaatgtgtgttcccaagaattatcagttattaactgtaacatgaataaccttactcttgactttttattcttcttcttacatttacttttccttggtcttatttcatcattcaaattattttaactcgtcttacccatcaattcttaagtaagctatgcgtccttaggtaagactacaaagtctttcccagacagcatagggtataaaaaagcaacataaattgtgtcccttataagacctctgaataggccatgttccaagaaatccctttaagtcttattcttttggccaaggatttgctggggcagatctgatcctgaaaaatcctactgaagcaggttcagatcagggtcttcaaacacagaaggtccaataatggctaggaattggaattatatatggaggccataagcaggagcatgaatcaccatcttagactgctgactcaataggtgcacattggcttcacctcaaagaatgaaagtgtcctttggagaataacagagcattctgcaatctatatttcaacattctcagcagtcctcagattctgatgaaatggatgctaaaaacctccagtcagtcccctagaagatctaaacttcattcttataacccatgtgccatatgccagatgatatcttgagacatacataatacacttgtaagcattaactttcaatatttggggagagtagtcctgatctatcaattctctattctctaatacctgagcatgacccaaagaccaagtcagcagtttacttagaagctagctgtgttcttcctggcaggaagttacaaagtgtacagattaagggagttctgagaactcttaggttctgagtagccttgtattgtgggggattggtttgaattgcagttttctctgcctgttatagttctagagagctgaccacccacagcatttatttaagcacctgtttcaaaatatattacactcaagacttaccttgaaaagaagtttctgtggccaaatatatttaagaaatgagccataatttattccttcttggtggtttcacaattcatgcctttgtcgtcctaaaggttctgagaaacactacaggaaagaaatcttatctaactcagagtatctaaacatattgacccttttctacaatgtctatacctgtggaactattctttggaaaccttgggtctaaaatggatactgttacagatgaccctttactggacaggttccaattaagccagccctctcctatcaaacagcattgggaatcttgttcccaagccactgggtacatcttggagaagagagcttaccaaatctgctaaatctggttagtaccataagaaaatgtccacttttgctaccctatgaaaagcaacaaggcagtatttcccagttgcctacaagtagcttcttcccctaggactgaaatggatgaaatactaatatacaatatatctttccctcttcccttccaaagaaaccaagtaacaaagactggtgatacagctataaaatttttttttaacttgcagatagaaaagttaccttaatgaccaggaaacatttataaaaattgattttttaaaattaaactacagcaaaaaaattctcagttttaagttacacactgttaacagagcactaaaaatattttttttgcatttttttcttttcttttttttcgattcaagttttcttttttattattgttatactttaagttctagggtacatgtgcacaatgtgcaggtttgatacatatgtatacatgtgccatgttggtttgctgacacccattaactcgtcatttacattaggtatttctcctaatgctatccctccccctgctccccaccccatgacaggccccaggctatgatgttccccaccctgtgaccaagtgttctcattgttcaactcccaactatgagtgagaacatgtggtgtgtggttttctgtccttgtgatagtttgctcagaatgatggtttccagcttcacccatgtccctgcaaaagacatgaactcatccttttttatggctgcatagtattccatggtgtatatgtgccacattttttaaatctggtctatcattgatggacatttgggttggttccaagtctttgctattgtgaatagtgccacaataaacatacatgtgcatgtgtctttatagcagcatgatttaaaatcctttgggtatatacccagtaatgagatggctgagtcaaatggtatttccagttctagatccttgaggaatagtcacactgtcttccgcaatggttgaactagtttacagtcccaccaacagtgtagaagtgttcctgtgtctccacatcctctccagcacctgttgtttcctgactttttaatgattgccattctaactggtgtgagatggtatctcattgtggttttgatttgcattcctctgatgaccagtgatgatgagcatttttttcatgtgttttttggctgcataaatgtcttcttttgagaagtgtctgttcatatcctttgcccactttttgatggggttgtttgtttttttcttataaatttgtttaagttctttgtagatgctggatattagccctttgtcagatgggtacattgcaaaaagtttctcccattctgtaggttgctgttcactctgatggtagtttcttttgctgtgcagaagctttttagtttaattagatcccatttgtcaattttggcttttgttgcctttgcttttggtgttttagacatgaagtccttgtccacacctatgtcctgaatggtattgcctaggttttcttctagggtttttatggttttaggtctaacatttaagcctttaatccatcttgaattaatttttgtataaggtgtaaggaagagatccagtttcagctttctacatatggctagccagttttcccagcaccatttattaaatagggaatcctttctccatttcttgtttttgtcaggtttgtcaaagatcagagggtcgtgacacagctacaaaattattaaggtaatcatgccaacaggaaataaaccactgcagttgataagagctgttggcaaaaagaggtttttattatgaacattttcctttttgctttaagcatttcattcacagcatttttttttattaaacatgatataaaactgcaagaagaaagttccctttgggttggtgggtgagctacacttttccttctcttccttccctgtcaaaacagccctacgcaagggctgaagtcatacagctctcatcactgagagcaatgttaacctccctgaaaatcaatagcaatgtttcatcttactgatatcaggtgcaatgccacatatgcagtcaccaatatgtaatataaggagaagtgtgcacactctgtaaaacaccaccagcttaatctatttaggacaggagaaaatgaagaaacctctaaaaggaattgatgatgcccttccccagtatttttggtcacctaacttcttcattctacccattgcttcttctctctctctcctatttttctcattcattctgatctgaccacactggcctccacattatctcacactctaagtcctttgcaccccagggctttgcattagttcttctctattcctagaacattgattgtccagatattctcatagctcccttcctcaccttcttcaggcatctactccaagtccatttatagagggggcttccctagccaacctaccacaaataacacctaccagtccattatcttctatccccttatttggatttattttttcttcttagcacctagtaccttaccttatcactggttgttcatttgcttattgtaataaatatagaatgcaagccttgtgaaattaagaacttttgttatttcctgtaattcccagtaatagaacattacttggcatttagtaggtgttcaaaaaattattgtgtaatattacaaaattgggtttttgtatatgtatgtctaccatcagactcaggttccttaaagattggtggctttagagttttctttcatatgatgccatgctcccaggagatagctgatgtgtctgtgtgtgtttttgtgtgtgtgtataaataggtatgtacataaatatatacactcatatgtataaaaatgatcatgaactggatttagctaataataataataataataataataataataataacaataactgacggcaatattctgtttcctgaggatacaatcttcattttacaaatgagaaaactgaggaagaacagagaggataagcaacttgccagcggtctcactatcacctagggtagcaggaattcaaatccaggtggtctgtatccaaagcctctatcttaaatcatgataaaatacatcctcatatggatgttttctttggccctcatggtttgggccaacaaagtttctttaagtctgtctttaaagtctcatttcacttgtcaacattttaaaacctggagattccacaaaaaaatctagatttctagcttctctggaaacacaggaatgtgtggtaataagggccaaattttcacatggcaatgatgaactggagctgaattgtcactcctccttttggactaaaccctcagttttcaccactgagcatttaatgctttcttcccttggatcaaatgtaagttgtgtggttcctagatcctatgagcatttgggtttgctaacctgggtgtcatggtaaaatagtaacttgaggtttaacactacctaaagaaaataatattaacaaataattgtatctttacatttaaaataggcaaaataattagttaccagtcatttttattctctataaatgaaatcacatatgaattgtttaaatatgtttacatttaacaaattgtgtttttcatcttagagaagtgaaacttacataacttttttttgaaagctgatttagaaagatttattggaatatacaaggagtgttatgtagttatacatgtctttcacattcatatctgctgatgcagctgaattcctatgtgggttttattttgtttttttatatatatatataaactttaagttctggaatacatgtgcagaacctgcaggtttgttacataggtatacatgttccatggtggtttgctgcacccatcaacccaccatctacagtaggtgtttctcctaatgctattcctcccctagccctcaacccccgacaggccccagtgtgtgatgttcccctccctgtgtccatgtgttctcactgttcgactcccatttatgagtgaaaatatttttatatggaaataactgtgatttttttatctattaaaaaatacaatagcaagagcacagtcttagaataaccatttcagtcttcaaattttactacacgaaagtaaatttgttattttgatattatcagttctgctgcaaatgttaggtaataattggttttaaaatgaaaatacttttatttgacaattgcatactagattttaaaaaatataaataacaaaatacatggttggattgttgactaggctaacattgaagtgagtgttccttttaagttttcttagcaaatatatctaaggaattatatcctggtggcaattggaatgtaatatctagtatatatcctatagaaaacattggcattccattttccatctacatgatactgcaaagctcattattaatttatttgtttaaaaggctctctttagccttactaagacaaatgaagtgctataaaagcacttaaagcaatgtatatcacaatggttaacacaaaatagcattgagtacttgatagtgaaatttcccatttaaattacagttcttacaattgtccaataataagccttcagtttcttactgggatttaataagaaaattagaaaattatattccattcatgaaaaaaaaattcttgctaacacatcactatagcagacaagcaccataaaactcttttggccatactaaaaattaatatataaatatctactttttataattttaaaaagataaattactaatctttgaaatagaaattttcctatacaagataatgcaatctgttggacttcaaatgcatttaaatggctcggggatctgtttgacaaaaacatgtgtgatgatagagacataaataatgatacacatccaatatatcctctccattagattgcataatttgatttcggtttatacagtataacttcagtagtcattaagacgtgtattttgttaggaaacagtgaaagaaaatcacccatgtacagtgttttctggtttaaaatgtactgttttttaattggcaaattataattatatacatttctggggcacaatggaatagtttgatatctatatataatggggaatgataaaatcatcaatgaactcctctaccatctcactgcttatcattttttctgaggcatttgaaatttactcaagttattttgaaatataaaatacatgattaactatagtcaccctgacgcaaaatagatctcaaaacattcctcctgtctaactgaaattttgcactattttcccagcagctcctcattccctccctcctcttctccctgcagcctctagtagccatcattttactcttctgtgagttcaactttttcagattccatatatgatataatgcagtatttttctttctgtacctggcttattttacttaacataatgttctccagggtcatccatgttgtcacaaatgacagaattcccctccttctctttttaaggctgaatagtattcaactgtgtaaatacatcacattttctttatccattaatctgttgatggacacttaggttgtttcagcatctcggtagctgtgaataatgctacagtaaacatgggagggcagacatcccttcaacctgttaatttatatttctttggatatatacccagaagtggtattgttaaatcatatggtagttctatttttagtttcttgagaaacatccatactgttttccataatggctgtactaatgtatatttccaccaacagtggaaaagagttcccttttctccacatttttgccaatgcttatctttcaatctttctggcaatagccattctaacaggtgtgaggtgatatctcattgtggttttaatttgcatctccttaatgattcctgatgctgaacattttttataaacctgttggccatttgtatgttttcttctgagaaatgtctgtttgggttctttgctaatgttttaaatcggttattggttttcttgttattgagttgtttgagttccttacatattttgtatattaacctgttatcagatatgtggtttgcaaatattttctcccagtctgtgggttgtctcttcactttgttaatttttcttttgctgtgcagtagccttttagtatgatgcaatcccatttgtctattttttgcttttgttgcctgtaatttcagcgtcatgtccaaaaaactcattgcctagaccaacatcatggagcttttcccctatgttttcttgtattagtttaacagcttcaggtcttacatttaagcctttaatccattttgagttgatattttctcaagttttaattgagatagatcatacatggctagccagggaggcagaatcaccaccacttactgtttatatcaccttatcaaaggagtgccatgtggaactatgactgtgccagcccttgttgaatgatactttcttcagattttataatacttgcttaatgaagtgacttttatgggaatgtccagaattgtgccaggcatccaggacctaaaaatttagacatgatctttgccctgaaagaaccttcatggaaaataaagacaattttgcttaaaggcaatattagtatatgctgcctttataagatctattagcaaacgtctagtgagtattacttcaagtctctgtcactactaagaccaaagcgcctgagtctttcaaccaatctgctcacctttctattttcctgtgccaaaccctgcaaactttttcatttaaaaaaaaaaaaaaaagggccggggaagaaaatgaagaataagaatgacttttttccaggactgatagtcaaagataaagatttttaaacaggcatgaataataatgaatctttcgataccataaaaagaatatcactaaatttcaatagagtaattctctaactcatggacaaaatgtactcaaaaagttatatgttatttagaagttaaagtacaatttttcatagaaataatttaaatatgagatgaagttcttaaaatgatgcataaaaataggtagtaaacatgggatgtaaactgtgataaccacaaacctcataaaatttttgtgaagattaaagcaagtaatacatgtcaaatatttagaacagtaccaccaaattgttggcactcaaattttaattgttatcatgatattattattatttatatttatattgctgtagaatctaagtgcttcaatgtgttctaagcgtccaaattaaatgcaggggatatcacctttacccatcccaaaagtggaagaggcaaacctcccccctctatctttacccctacaaaagcaattacagatgaggaggtaaccaacccacaaaaggaaagagaggtgggatgagatgcatggagaaaaaatgcttcctctggaactttggtaagtgtcacaaaggacaggctaccacccgaggtgaacccaaggacattagtttgagtgagtctgtgatgctgtctcctattgcagttgcagtttctgagtaattaacccattgactatatatcttttgctgttttcgtttgtgtttgaattttcaaagtctgaaaggacgctcaatttgttgcactgatatcatcctaagaggtacagttaacttctagattagtttatctatagatgtcatgtgggtctctgggtttagtattaaaagggttgaatttcttttcattgactcaagctcaaactttttcattggcaatatttttagtgatacagaaatctcttataaccagatcagcttcctaaaccagctcaataatgtttactatttaagtcaattcactactgtgaaatgaacaatatcatgcctgactagtttgaataaacactgcaaaccatattcttaaaaggtaaatttatttaaaaaaatactaacaaatatactgagcttttctgacatggatgagtctgtcagtacagaatagaaataaaaatgccaaagaaatgaaattgtgaaaatataaaatgcccaacagagctgttaaagcccatgattctccagaacacaataggaaaacagcaacttgagatagttcctagcatcctgtacgagcacttatttatgtcaatgatatttaggatccattaatgtacttggtatacgaataactgttctagggagccaaattaggttttagtgaaagactagtaatagtgaaggcatccaaatacctactttaataaactttgtaacaaagcagtatcttattagctatccccattacaacgaaagttacatgagggcaaggatgtgtctattttgggttccattgtaagttcaaattcaatattgaacccaatgcctggcacaaagtaagcctcaaaaaatatctgttacatgtatgaatgaatattgtcaactctgttggcagaggtaaggtgcctgaagcagcaaagatttcctgaaaataaatcacactggctttcaaaagttcagaattaaacaagacttaccagaatgtttcacaatatagataaaaagtgaaacatgctattgcagaaagcaaaaattctgttagtgaaatttgtaaacacttagtactgtggggggtcacttcatgtgaaagtgatttcatcagagtcactaagattatgccaatatttactagggccatatcaaagtccaaatcaccttctttataaccgaatggtacatttgaaaacagagcgtataattttacagttcatttgagacaggaattaactatatgaattggagtgagctcaactggttttacaccaaaaacatttattaagcagtattccatggaatggggaatcaattagtaataatcacattgcaaattaactttagtatttatttgctgtatttgaaaattgagacaatgattgacatacattggctttgtcttgtaagctagatatcttctctttgggcaaatgaatttataaaattattttatcagaagtacattttgggtagctcacctgaaagatcatggtgcaacagcttcctctacaggttatttttatattttaattctgagctttctcaatatccctcttgagcttcctcccttgcttcctgttatgcccaaggctgaatgttccagcaaaaatagtttcaaaacctctttaagccttattcattccatctagtttcccacttttctctcatcagtttgcattctaactaaagcagtatataatgcccatgaattctaaagtgctgtgtgcaaacacaaatagttaaataaattcaaactatttaatgggataacatgcagtgcccagttacactaccttcacatgcacactcacattcccataatatatgaaatgaaactttacatttttagtgaaatgagaaatcagaatctggaaggttagaaacaaaatatttctcaaaatgttcatcgggggtaccccatttgaatacaggatttcactttgcatgttattgaatggtcacaagagaagtactaataaaaataaactcttccattttgtaggggggaatttaaacaaacttagctcctatttattataaggaaaagaagttcttattagggctattttgtgtatgtcttaaaatacagtaagccttgggaaaaaatattccttataatctctcgctatttttaaaagagactagattataatccccagcaagtgatcttatagatgatgaggatacattgtactaaattcagggatctttacaatatatggttatttaaatctattttgatatttacaatgataaaacaaactcacctcttcaaaaggctgctttcatttcagttataaaatagacacagttggaataaagatttcttactagaatctactgccatgtaactgccagacatttctcctagctctgctttaggagcaaactaaaaacaactcttgacatcgtaagtacagctcatcaccacatgaggacagttctagccctaattattcttctctgtgttctagtcttcaattccataaaataccattaatgattaatggaagttttctgccttgcttaaccttttgaacgtgtcacaatatccagccttgtaaactaatcaatacatttcagaaaatgtacaagatgtgaaggttctcagacattacagaggtttgttgcaagtggtttttttggttccactaacaattagctttatcaactctactgccttgtcctagttgccagaataacatcagattcaggattcaggtatgtgggttattttccaccttctgtgtggttttgagggtgtttgagtaggtctcttgttaaaaagtgctgctgaagaatgtctttttctcacaattatcaaatccgacttttctcacctcaaaaatattttgggggggtatccatccaaaaaagtacatgctgcgactgcttcctctacaggcaatctgacattaaacaggtgacattaatctgatgagccctaaagagaatctttaaaaaaaaaaatacaaccctttcaagtctgtatctaatcaccaccacctccactgcaagccatcaaatagaaatttccacccaggcatatgtttacactgtcttccataaaattgtaactgttagagaggagaggaaatctttgggattaaagcctgacagcagttaccatcatatcacctgagatgactttcccaacccttaaagtgagaaggataaaccactaaaagttaaagccacttaaaacagagtaagcaatttatatacttcctacatttttttccaaagatataacatcacaggagggaaatttcctgggcttatttgcataaatgatgagtcaggttaggagaacactgactgactttgatgtgtccgccctattacatatgtgatggacatgttgaacaagggggtctcatgattagtaactagctcttccctgtagcgtgaatgaactcaagagcaggtactgtgatttttctgttccctctcaaataccaatgtcatttcatcatgagaatggctagttacatttaatagtcaaaaatgttttaattcattgaaagttgaagctactaccccattcaggcctgtttcagttctattgcctgtggtgggaaaggaagacacagatacctgcctcttgtctcctttgcctgttctcttttcctccttcctcctacgctctaggctgcttctacctcctccagggctaacacaggaaaggagaagctagtaagagagatagcagcaggaaaaactcaactcaatgggcaaaaaattcaatggacagcatggtgagccaaggttgtctcctctggttaccaagatgtgtaaagctgccgttttctcttactgtgttcttctgtgatctctctcccttgttattcctggagatctctcatatgcagctggcaccttaagactctcctctgggcccctggttttcaaattgtctacctccacacagagacccaactgttggcagtccactgctctgtagatagcactttgttgggggtagagctgggactgggggaaatatatttaagacaactcctagccagctcgctctcttgcttgagctacatcaggtctgcaggtcacatgacaacttcccacccagtcctctgctttgttctccaggccacttagcaagcccatcaccctctagatttctccagcctgaatcagacacctgtccattacaccccaaattccaagagctccctgtcaagcgctgagtggtttcttgaagcccttgtcactatgtgaaagtgaaaggaaacacttcccaccatcccccagactcaccacactttgtctaaaatattctttgcctgatttccaccttgtccccagctgaattcctagccttcccttagacagccaggagccaagtagcagagcatgggtggcagcactaactctcctgtacctcctttaaagtcctgcattagtggcaccagcccctcaccttggagtggagacagtctccaattatttgtagttctgtttttcttttcaggccttaggtaaaactgagacaataaaagaaggaagggaggaagcagggtgggaaggagggagggaaggagaaaaattctcattttggtatcattataaagataggacctaatagttgccatatcaatagcttctgactcactagttgacatgtatcatttgactcacttacgttcagtattagtttactctctccttttgttctgctggtgactaaaatataacagaatgtcataaaattgtggcctgttatgagagaagagctagaaaggcccccaaaatatgaaattgcatatagacattgagaaaatacgactttcattgtaggccacgtggaagatcactttatacatgtacatgtaacataatattcatcaaaaggggacacatacaaatttttctatttctgcctcctaggccgggattatgaaaagaataaagtctgcaaggaattctcccatctgggaaaggaggacttcacatctctgtaagtgtgcagcagccactcactctgttggtgatttgatcttgaacaaaactgagtgtgaggtaactttgattcagcatggaggttaatccttaatccttgccaagagtaagaggacagagccccaggcccaaggtaggcacaggagtcaagcaaattaaggacatccagagattccagatgacctctgattaccacagtctaagaatttgtcaccagtaagtttatgaatgagttcaaagataatacgtaaagcatagctttctaaggtcattaaaatgcaattgtacattctaggaatctgggaaaccaaggcaatgaggtacagagcaagtacatttggggaggcttaagaaggacaacaccagattggtttgatggaagccctaagttcaatttctactgctttccaagataaatttgcctagaacaaaaactgctttttaaattaaacctcatttttttcattagccaaataaagaagtaaatgtgtacaatatttcatttaaacattgaacaggtttcatattttaatgtgccaaaatgtaaaaagaaagtttcagttctggtcgggcacggcggctcacgcctgtaatcccagccctttgggaggacaaggagggtggatcgcaaagtcaagagatctagaccatcctggccaacatggtgaaaccctgtctctactaaaaatacaaaaattagccgggcgtattggtgcacacctgtagtcccagctactcgggaggctgaggcagaattgcttgaacctgggaggcagagagtgcagtgagctgagatcacaccactgcactccagcctgggtaacagagcgagactccgtctcaaaaaaaaaaacctttcagttctaattgatatattgtcttattttcccctcaggtcactagtcctgtacagtagaaaatttcccagtggcacgtttgaacaggtcagccaacttgtgaaggaagttgtctccttgaccgaagcctgctgtgcggaaggggctgaccctgactgctatgacaccagggtaggtttctgtggctggccgtctctgtggcagcccagagaaggaagccaaaataggcctttataccacgtgttgaaaaaattttagacagcaactccatttactcctagtttgggggaaatatgaagcctgttgtgtttacagcctggtttattctaacataatgagtcaatattacccattattcctacaaggttcaaatgagaaaactgggtcatagagtaatttagtgatttattaaatgtacattgctagcaagaaggagttataaaatataaatccagatatgactctaaaacctaagtttttatcaccatacatttgatcttctcaaatatcagcccatggatcattattctaagtgaagtaactcaggaatgaaaacccaaatatcgtatgttctcacttataagtgggagctaagctatgaggatttaaaggcataagaaggatataatggactttgggaacttggagagaagggtgaagggggtgagggataaaaaactatacattaggtacactgtacacggctccggtgataggtacaccaaaatctcagaaatcacccctaaagaacttagccatgtaaccaaaaacaaaatagttttgttcccccaaaactattgaaattaaatatatatgtatatatacattttatatattatataatttaatatatatatatatatcagctcatgaacctcttgaaagaattctaaaatattgtgtatagcttaaaaacctgatcatagctttatcctcttttatcatcatgccaggactggtaccaagtgctccagaataatttagtgttggtttcaaatttggaaggaggattcaaaagttgccctgtatgcacataactgaattctaggtttctcccctatagcacttatgcaaaaattaaaatgctgacatgttcagacagtagctgaaaagggttaaatctaaggagtttcagcaatttattaatgcagtcgtcaggcctgatgcaaatgacatttagatgcattttgataaaggcttttacagacagatttgtctcactgttcaagccttcagcagatatcatacagaaacaatgctccaaagatctgattagaatagattctacacaatgaatattcttacccattaattgctttacctgtcccttatctattttttcagaattttataatccttttcttccaccaagttcataaatattttttattttaacctgaacttctgtaccaccttaaaataagaaagcgtcaaatcatcaacatgacagagcacatttttattttatttcatatatttgctaatacatcccttgatcagagatatgatctgtctctacaatcctggagcataagaaaacagatacggcattgatattttttgcatgatatatttctctttctcctgcttgttcaaaacatttttgaaaagtgttttgacattttgtcaacctttttttacttgaaagaagataactttaaaaaggcaaaaagaagggttgccagggaaatgaatggaaaggaaaaagatggactgaaaagagagataggatgaaaaagagtctaatttttaacttctccgaatctgatgaaaggatggtacggaagatggtgagaagttagtttacataagtaattcatcacgttgccattcttcactggtagaaaagatttttagaaattttaccttaaaaagatgactaacttataaattaagtataagaatgtcaaagtactgtttcccatataaatcccaaagtaattttttccatgatgactatttctattcttttttcctctatggtgactctattttagattttaatttcaaatatgaaatttttccaaaaagaacattttgatgctacgattgttttgatggtgcttagtctgctcacaggtatcagtgtatcattgttgaagcagtaaatgcaggtgcatcagtggttttcaacctacactgcacctgcacataaatcttggagcttgggaaaaacagattttcaggccctatttttgacctactgaaacagaatttctgtgttgtgcaaccaaagcattttttattttatgcactctatgagtaattctgatgcaaaagccggttcaagaatcattaggtaagagaatgcaaataatgtagaaagttaaaggaaccagcaatcaagagtctactcatttcacaaagggagggaaggagagctcatttaataaacagagggaggtcctcctcactcttattggggcatttacagcagaaagcaggtgggagatgatgacagaatcatctgtggagctttttcaaatgaccctctcatcctcagagatgttaatatccccacggaggaacactaggctagagaatacaattctaatggctctaatcagataaacactgtccatttgttattcaaagttctatttttgttctactctgaggagtcatttactaacataaataagatcctatacttgccgataatcacacaacttgtcatgttaaaaaatcacttcatggagcccttggcatgaatacatagttataaatgagaattttctaattataggctaagatattatattaaatggaagtctaaaagcctggaaatttacatatatatatgagtttcctttttccttctcctccagacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcagtgagtgccttcatcataaatagaactttaggacctaaagtatcagaaatgactctaatctaaccccctactctgtggaaacacctcttctacagcaacctgaacaaattctgataacttgactgtcatctgagacagcccatcttccctttggtgctgagttttgtgaatgcctttctcagagataaaatcaattttcccaaactcttactaaccctaatcctattatctgaaccagaatcacttgagtatcctgtccacatgatatattttcaaatatttgacagcccctgtggtgatttccctgatgctaaggatcattgcgtatgtcatatgatagaagcaattttattgctgtacacattttaaatacttaatttccagtaaagcataaaaaataaacagcttctctcttcactcctatacatcccagaaacatgtgacgtgtacgtgtaaatatgacacatctactacatcaagtaaacacgtaaccttaaaatttttatggtttaacatgcacaaggggccagattatacactgaatctttatgttagtcttggaaggtcacaaaaatgaacaaaactgggggaaaatacatttattaaagtaagaaatatatacatattcaaaaaccaggagcaatgtcattcaaagtggtcacaaattgtaaaaattagtaggattgctcattcctgtcaattttcaaagaggattttgcccagaatttcagtcccttttagatccataaggacatctattcccagaaatagaaattatttcttccaaaaaataagtaatctatacataataattatctaaagtaataaactgagatagataatgaaaaattaatctagcaattacattcattttaattaattcaattagcagcttaattaacaagcagataccatgggtgatgcacctgaccagacattaagtgaataaagggacaaatggcccctcctctcacacaaaccacatagaaatttgtaaatctatttttaatgaatgaatatactgattaatagtggccagtattataaccttttctctaaattcttagtgttttttagatattaaaactataaattaatgtaacatatatcctttgtccatcaaaatacttactaaaaagtaggttttgggggccaagcatggtggctcacatctgtaatcctagcactttgagaggctgaggtcggaggatcacttgagcccaggagttcaagaccaacctgggacaattagtgagacctaatttatacaagaaattaaaaaattagatgagcatggtggcatgcacctgtagtcccagctactcaggaagctgaagcaggaggatcgcttgaggccaggaggttgagactgcagtgagctatgattataccatgtactccagcctagatgacagggcaagacactgtctcaaataaaaaagtagattttgtttattcacaaattttttgaccaattctattttttcctccacagatttatgtgggaatattccactaattacggacaagctcctctgtcacttttagtcagttacaccaagagttatctttctatggtagggtcctgctgtacctctgcaagcccaactgtatgctttttgaaagaggtatgtcccattttacttattatatgtttacgtttttttcttctaatagcattccttttagataatggtagaaattgagattttgcaatcagtaaaagtttctaaaatgccacccttgcatcttcttaattggaaaataaatgtaatacctctggaaaagtaatatcaataagttcctttcaccagtgttcagtttcctattcattaaaaaatcatgaaattaatagtccctatttttgccatttatacagtattcaatgagtcttgaccatataatgagattctttcacttgttttctagagactccagcttaaacatttatcacttctcaccactctgtcaaatagagtctgctcacaatatgctgcttatggggagaagaaatcaaggctcaggtaaagattaagtgctattgtcatatttagatgtttggttctgcactgtctatccataatattagggtttttttaagaagctgtctatattgaaagatataaaatagacttttcagctccaataatctccaaaaatctggccaaattctcgttttcttttctctatacagattatgaaaaataaggaaaaagtttatgtcataaaacatgagatttgcttttaatcaatcttttccatatagttgaccactagaaaatattttttcagtgttcatattagcatatgttacaaacaaaaaagcaaaacaagaacaaaaacaaaccaaaaaaacacaaccttttgtttattacctattatttgccttgcccaatttttcttggaatgagacatctgaattcttacttgttgtatgaagacttgtgctatacagtatatatctcttgcccttcattaatttattctcattagttatctacctttgtattagtctattttcactccgctgataaagacatacccgaaactggggaatttacaaaagcaagaggtttaattggactaacagttccacatggctggggaggcctcacaatcatggtggaaggcaaggaggagcaagtcacatcttacgtggatggcagcaggcaaagagagagcttgtgcagagaaactcctgtttttaaaacgatcagatctcatgaaactcattcactatcatgagaacagcacaggaaagacccaccccaataatttaatcaccttccactggtttcttcctatgacatgtggaaattgtgggagttataattcaagatgagatttgtgtggggacacagccaaaccatatcatcccacccctggcacttcccaaatctcatgtcctcacatttcaaaactaattatgccttcccaacagtcccccaaagtcttaactcacttcagcattaactcaaaagtccacagtacaatgtctcatccaagacaaggcaagtcccttctgcctatgagcctgtaaaatcaaaagcaagctagttacttcctagatacaatgggggtacaggcattgggtaaatgcagccattaaaaatgggaaaaattggccaaaacaaaggggctacaggccccatgcaagttcaaaatccagtggggcagtcaaatcttaaaggtccaaaatgatcgcctttgactccatgtctcatatccagctcacgttgctgcaacaggcatattcccatggtcttgggcagctccacctctgtggctttgcagggtacagcctccctcccagctgctttcaaaggctgtcattgagcatctgtggcttttgcaggtgcacagtgcaagctgtcagtagatctaccattctggggtctggagaacggtggccctcttctcatagctccataaggcagtgccccagtagggactctatttggaggttccacacccacatttcccttctgcactgccatagcagaggttctccatgagagccctgcccctgcagcaaacctctgcctggacatccaagtgtttccatacatcctctgaaatctaggtggaagttcccaaaacccaattcttgacttctgtgcatccgcaggctcaacaccacatgaaagctgtcaaggcttgaggcttacactctctgaagccatgccccaagctctacattggcccctttcagccatggttggagcagctggaatgcagggcaccaaatacctagactgcacacagcacgggaaccctgagcctggtccaagaaaccactttttcctcctaggtctccaggcctgtgatgggatgggctgctgtgaagacttctgacatgtcttggatacattttcccccattgtattggggattaacattcagctccttgttacttatgcaaatttctatagccagcttgaatttctcctcagaaaaagggcttttcttttctctcacattgtctggctgcaaattttctgaacttttatgctctgcttcccttttgaaactgaatgcctttaacagcactcaattcacctcttgaatgctttgctgcttagaaattccttctgccagatatcctaaattattttcctcaagttcaaagttccacagatcttcagggccggggcaaaatgtcaccagtctctttgctaatacataacaagagtcacctttgctccagttcccaaaaagctcctcatttccatctgagaccaccttagcctggaccttattgtccatatcgctattagcattttgggcaaagccattcaacaagtctctaggaagtttcaaactttcccacattttcctgtcttcttctgagccctccaaactgttccaacctctgcctgttacccagttccaaagtcacttccacattttcgggtatcttttcagcagcaccgcactcctggtacaaatttactgtattaatctgttttcatgctgctgataaagacatacctgagactgggcaatttacaaagaaagaggtttaattggactcacagtttcacatggctagggaggcctcacaatcatggtggaaggcaaggaggagcaaatcatatcttacatggatggtcgcaggcaaagagagagcttgtgcagagaaactcctgttttcaaaactatcagatcttgtgagactcattcactgtcacgggaacagctcaggaaagacccacccccatgattcaatcacctcccaccaggtttctcccaccacctgtgggaattgtgtaagttacaattgaagatgagatttgtgtggggacatagccaaaccatatcaaccttatatttgcaaccttcactttgatttttgtatgactactgttaacttgtattttaattttgatagtttctatgctgcacttctctcatactttctcaaacatctagatttgccaactttttttccctccatacttacagtctctttgattccttctactatcctcacaagtttttttcctctaatgataatcaaagaacttcttgccagcaatgcataaaaagcttccgtaatgcgaatagaaactactttcttgtccaggcacggtggctcacacctttaatcccagcactttgggaggccaaagcaggtggttcacaaggtcaggagatcgagatcatcctggctaacacgatgaaaacccgtctctactaaaaatacaaaaaaaaaaaaaaattagccaggcatggtggtgggcgcctatagtcccagctactcaggaggctgaggcaggagaatggcatgaacctgggaggcagagcttgcagtaagccaagattgcaccactgccctccagcctggggcgacagagcgagactccgtctcaaaaaaaaaaaaaaaaaactagtttctttaaatataacagttcctcagaactacttgaatactcaatgacagtttctctagtcctttctttagttttccttttacgtagagatagtagtttgacaggcagaacagagggaatttctaatataaagccaccatatatattacttatataatcattaagtgatacttgtattcatgtccagaaatgtacttcaaggaaatagcatttgctatgaacagatttagctatctgataagggtttaatattcggaatatataaggaacttctataactcaataacaaaaaaacaagtagcttaattaaaataggggtaaaagacttgaataaacaattattgaaacaaaatatactaatgtccaataaacatatgaaaagatgctcaacgtcactaaccttaagatacatgcaaatcaagtctaccgccataccactctgaacacgcccaatcttgtctgatctcagaagctaagcagggtcaggcctagttagtataataattggatgggggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtggtatatacatacaatggaatattatgtagcctgaaaaaaaaagaaaatcctgtcacgtgctacaaggatgaaccttgaggactttcattatgctaagtgaaatatgccagtctgaaaaggacaaatactgtacaattccaactcatacgaagtatttaaagtaatcaaaatcataaagacagaaaatagaaaggtggttgccaaggaatgggaggatgagtgaggggaagtgggagcagagcaaatcagtgtttaatgagtacagagttttagttttgcatgagaaaaatttctagagatctgttgcaaagcaatgtaaatatacttaaatactgaatgtataccttaaaaatggtcaagatagtaaatttaatgtcattttcaccacaattttttaaaataatatttaatcatattcatgatatattaggaatattaatattgaaaaaatatttaatgttattcctggtatattaagtgaaaaaggcaaatatgagaatagtatagcataccattcacacataaaatactgaaaggttacacacccaaaatgtgaacatttgttaactctgtggtgtaaagctacaggtctctatagtttctaaaagaatttataaaacacacttttacaactctgtgagaggccacaaaaatacaacattggccttatgaatagaaagagacatttgtgacttcttcattgatgctttagatctaacattttaaaggagtgctttcactatgtatatctggcaagaagagaagctgcatttgggtactgaaaatttggaaagattcattagggatctcttgatcttgagtctgtggcttgggtacataagatctatcgcatggcagatgtgctcccatgcatctcttgaggccaaggaggtgaaattgtgatattatttctccaaatagtgcgttcatcacgaaaccaagaaaactgagaatgttgataagctaacatatttatttttaactgtttagcaatctcataaagttagcccaaaaagtgcctactgctgatctggaggatgttttgccactagctgaagatattactaacatcctctccaaatgctgtgagtctgcctctgaagattgcatggccaaagaggtaagacaagctttattatcattatcaccatgtgccaggtattgagtgccaagtactgagtggcaggtactcttctaagttctatttcatatgcattatcctaacggatgcttacatgtattctatgaaatataaataattattaacatcactgtacaggtgagaaaacagaagattagtaagggtcaataatttgttaccacacaactagtaggtggcaaagtccatatgcaaagatgagattatctgatttccaagaccttatgctacttgcactgtatggtattcattaccacatatggtcatttaaatttaattatagttaaagttaaacatatatgtttaagttgaatatgatttaaaattcagttcttcagttacactaaccacatttcaaatgcacaatggtattggatagtgcaaatacagatcatcattttcattattgcgtaaagttccattaagcggcacttcaaccattatactagtagacgctactactgtttttattatactttttataatttgatgcccatctcaattttttttaccatttttcattttcataatcctttaaaactatttaaatttgaataattgctttagctgaaggtcagtctccaagatcttgtcaatctctgtagtaatagatacattgtgttgccttgtctttttccattaaaaatgcatgtctgtgttaatagatgcttttctataaggatttataatggctaaataggactctgttgcctatatccatgtcatgtattacatctatctatctagacacaccatatttttattttactaatcctctattgtatttaggttgtgttggtttttttaaaatattttaggcaatcgttgcacttaatagccttatagttgttgtcgttttatctacaattattttctgagtataaattcttaaaaatagaattgtacatttttaagacttttagtacatattgacaaactgcctttccaaatattgtaccaattttctttctgagagtcttcatactgactttcataaatgtgatgccaaagcttgtaagcctatgtaattcttatttttaattagactatcaggaaactaacaatgcacaaactaaccattcgttttgtagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtaagtagaggtgatgtgaaaacgtgttcccattttaagttcatctggacaaaaagtgggggccagccagatggagggaaggtatgctatcactcatttcaaacataggcaaagtactacctttatgcttttcatggactttaagtatttgttaattaattgtaaatgactaaaatttttaaaacaccataatcgagtgtgatagaaagattttgggtagggagaaaggagcttagagttcctaattgtgccttctctgtttcctgtgcatggccaaaagaagtgacttgataattctgaacttcagcctattgttaattaatttggaaatgttaactcttgccttacttagcacacagactgctaatgagaaatgcatgtagaaatgtaagtgaaagtaaatgtgaaaacacatatttgcatacaatgctgaacacatgtaaaatatatcatgcaaccagaaatgtttataatattattaactagttttatcatattacttctggttcaaagtcacaaatcaaaagcctaaagtatactaaacttttggacaataagcatttgatacaaataaaagagataccaagcacagaatattttttcttagcattatcaatattcattttcattaaatttaaaaagagatttaatgcaaagaaatggtaaacttttatcctgtttcatccaactaaaaaaaagtaagttaaaaatataccatggtttgaatagatgtgtatgcataatgatggcatacaaatatttcacaaatagtttgaagcagcaggttgaaatatcaattagcaatatcagatggcagaagttacataggactgaaactttacatttttctaaatgtgtattgcttttataagtgcatagacagcagtggggtaagacataatgaaggaatttacacaaaccaattttcacagaaaagccttttgaagtatccacttgatgctttatacagagtcaattgcattatgcttgcacaaagacagttccatatgcatttgaagtagatatgtttacatataatatatttaaatgtatattacatgcaaagctttaattcagtattgactagtcacaatagcaagtattaatagcttgtatctcaatgaaagtattttataatccaaagcctgttgatttagagtcagtctgagctaaatctcttctttttaattaagatgcagaaaccaggtgctctgcctttatgatagatatttcacattttaaaatgtaggccaggcacagtggctcatccatctaatcccagcactttggcaggccgagtcaggcgaatcacttgaggtcagaagttccagaccaccctagccaacatggtgaaaccctgtctccactaaaaatacaaaacttagccgggcatggtggtgggcgcctataatcccaggtactcgggaggctgaggcatgagaatcgcttgaacccaggaggcagaggttacagcgagccaagatggcaccacttcactccaacctgggtgacagagggagactctgtcacaaaaaataaataaataaataaataaataaataaataaataggaaatatataacacatatctccttttctccctcatgctaggtatacatttgaactaagcagaaggactcatcttccggaagtattcctcagtaaggtacttgagccaaccctaaaaagccttggtgaatgctgtgatgttgaagactcaactacctgttttaatgctaaggtatatttgttggattttctttatcaagcacatagatcaagggttggaaaattatagttcatgggccaaaacttgctcactgcctacttttttatggcctacaaactaagaacagaagaatggttttacatttttacattgttgggaaaaaagcaaaagaacatcagtatctcatgacccatgaaaattattcaaaattcaaatttcagtgttcatacatacattaacttccactgggacacaatcatcctcattgtttctgcaaagcttacaactgcttctgtacagagttgagtagttgcaacaaaggccacatatggcctgcaaaccctaaaattattatccggccttctgtagaaaatagttgccaatgcttaatgatacaatatttggaattttgatttaatggcttgatgggacaaggtttcaagacaaataattttgttatgcaattattgttttcttacagggccctctactaaagaaggaactatcttctttcattgacaagggacaagaactatgtgcagattattcagaaaatacatttactgagtacaagaaaaagtaagaaacttgttctggctgtatcctccaaatttatcaataatattttcatagtactatgaattgaaagcatagttgaacacttaagcttgtcttcagtgaacaacaacaaaaggaggttcaattaggagttttttaaagtagtcagaatctcatagagtggaataatagacactggagaccccaaaaggtgggagggtaggagaggggtgaaggataaggaattccctattggatacaatgtacactatttgggtgatgattatactaaaaacctagacttcaccactatgccatacatccatgtaacaaaaatgcacttgtaccccctaaatcattttatttttttaaaagtagttggaatctaacatctgtataagaagaagctaagtttttctggaggaaacatgtcatgtgtagcaagtgggtggccaattaaaacagccataaaaatatagatgacgaaatctatctgcaggaacttgagtcaaaatggcaaaatgagcacatagcttagcaacattcttaccccagaattttctgtagatattgctgtacaaaattgaggacctataaaactgctaaaaatgttatctaacttcatggcatattgcctggcaagaagacccaaactttcaatcaagcatactgtcagctatcaccagcatatattccctataaattagaaatagaaatgttaactaccaataatgttatataatagtcatttttctcaattaagagaaggaaaaagcatttctctataaatagacattaacagtaaaataataggccacaataaggtaagaagtggtactgggttcttggggaaagtctccattgagaagaccatgtcatttttcctaacgttagtaaatttctcagatcctattccctcctccccccaactttctttttttttttttgcctcctttgagtctcttcttgcctcatttgcaccccccggcagctcaaacctacttgtttcaacaatgcttttatgaactaactggtcccccttacccttttgtcccttcccagcatccactcttgccaagcccaactctagattaatttgagtctccttacctcccattgccccccgctgggctggcaagcatttcctgaagaaagtcataaaaccaggctgagttgttcatgggagtggagagacgccgagatcatcgattgtacaaattgaaagaatcaggagatatcaagtcttatcaccatcctgaaagagaaatggagagttcgtttttagtagagctaaaaataagagcgaaaatttccttactcctgtattggtgttttccaacatagtgagttgagaagtagataaattgagggtgaaattatataaattatgagaggaaaaaaaggcattaagctggtatgaggtcctgtaaaggaaatattctttaaggaatttgaaatttaaaactgaagagaaggtgaaaggttaggataaaatagaagaggtactcttccattttgaaataatgagcaaatgaaagaagactggacttccaattcagcagcgatttgtatgtttatttttatgatctcgaagaggcatgtttcactttctgatctcaaattgactattctataccacaggtatagaattttcttgagacaggcaagtatttctattttcatttttattgtaaaagatctgaaatggctattattttgcattagaaatttgtataaaataaatacatgtagtaagaccttacatttaaatggtttttcagactggcagagcgactaaaagcaaaattgcctgaggccacacccacggaactggcaaagctggttaacaagcgctcagactttgcctccaactgctgttccataaactcacctcctctttactgtgattcagaggtaggaaaatgtaaccctccacttaacatggcagaatcttttaagaacgtatgcactccaatctactcatttctttcctgttattgagatgccattatgtgacaggcttttcctggtgttattgtaacttggctgtctttgcaatgaaagtaagaaacataactgatttcatgctatgctcatttaaaagcaagttgaggtagttgtaaaacttaggaaattttatactttttttaagaaacaaaagagtctgtgaacacaggcaacaaagtatgtgtagtgttttacaaattgtgagttgtaacctagtaacagcctatttaaatgaaaaagagaagaataagaatacagtgagaacatcagagttcattaccttcacatagtgaaggtaaattgtatttcatatatctgtatgtgtgtttatgtagatacatacatatgcatatataggcaggtagattgataaaaataaatactttagaaaaatggggtcatatcataccttctattaatatgttaattataaaaatattatttaactttgttttaatatgacataagaaaaaaatgcaactgaagaatttctaaaggtcacataaatgtttcattactataagagttattttctaaaaactaaaaaatgattttaaagaatattaaaattttagtcattttttattacgaatttcttttttagacactatcaattgtctccaaactctgaaagctaaagatattagaagtcctatatatcttccagtttccctccctactcccctcaattttggatagttcttggattcatctttctttaaatgtcccttcccctcctccctgtctcccctttttcttccttcccctcccgcttcctggttcaggtccaatattgttaacagtaaaataaccccttcccctattcccctcctcctttctctctttccccttctctcccataaatgtatttgcataattgccagatcatttattttttaatttgtgcaaaacaccagcagttctggccagacctttttgttttctctgatagtattaatagatgaattagtgtttatctaatcaccacatctgaggcctattggttttctcctataaaccacagtgttaggttggtatcttgtattctgcccatctttatatagactgaaggtgtgagagaggggaggagacctcaggtaggttgtgtgggcccattgttagtagacctgagctatgcttcgacttctgagatttcaagtgtcttatgctaagatttctttcaccaagtcagcatctgccctattttcatggtgaggggtgtattttgctggcctttttcagaaaatgtcagcccatacgttcacatcctccattttacctgttactctccagcaagcatttcatttttttagaagagtcaaaagataaaaacagcacttcatttcactttactgcttatttggagacattagtaataactccaagaattgtgttgtcttgcccactctatttctgaaatatagaggcagggttaggaacaattctatgccataccaaatgatacttaggttaaatgatttcatgccaattagaattagaagcccttaaacccgttttttttgtttgtttgttttttggagatgaagtcccgttctgtcacccaggctggagtgcagtggtgagatcttggctcactgaaaacttcacctcctgggatcaagtgattctcctgcctcagcctcccgagtagctggtattataggtgcccaccaccacgcccagctaatttttgtatttttggtagagacagggtttcaccatgttggccaggctgatctggaactcctgacctcaagtgatccacccgcctcagcctcccaaagtgctgagattacaggtgtgagccactgcgcccggccagaagcccctttctataagtgaaataatttaagaatttacctgaagttttgttcatttatcagccacgaaagcaataaagcccagtttctattagactgcatttaaaaatacccaagaacttaatttttaaaaaagcaagtcacgaaagtataaatgttcaaagaaaactataaagatcatctagtgtaatttctcactcagttaattccttctagaggtgcattcagcctccatttaaatttctatagtcaatttatctactcctaagagtagaaatggaaatggcctatttcattgccaggtagctgcattatgagaacattcttctataaattaagctgtgatattccctttgtaatttctcctgcaatcaccctggctttctctatcaactagaaaatgtctattctctgttcgcaatagcagctcttttatacttgaagtgactttttaaaaattaagctgtgtaaagtatttttttaaagtcttgggctatgcattccaaatttcttaatatccatattttagtaaagttttatttgttttgttatgttttgttttgttttattttattgtacagtgcctaagaaaaaagtcttagtttgacaaatggagctacatctttttctaatttcttccttataaccttagggattctggtttcttttctaatttccatatttacactctggtcccaaacctatttgctaatcttgtttgtaacaatttataaagtcagaattccagatgaagagagtacggtagaataaaagccttttctttaaattctcctgacaaatatgccatcttaatctttcattaaaattcaaactacttaagattctcaacataaaaacagaagaagctggattgtcagaatattttggtcattaaaacatttttagcataaaataattaattaaattgaacagttctttcttttcataccaagttgcttttagtaatctaaatttagttccaatttaggtggccttaacctagaaaaataaaatcaccttacatagaagttgtttgctaccagaaaaattttctctgagagtctgttattacgaaagaagaagaaaacagtctaaatgtcttttagattctataagaaatatcacttttgaaacctttccctgtccctttgttatctgtctatacagatatgcactgtcctgcctgacaccatacaagacaaactgagctttaagcgcaaattcatgcttcctaaaagcccctggtttttcatttctttgagttggttttcaatataacatattgccattcaaatcattacaatgatgagaagacaggtttgtagctctctcacttcttgctttatcgacagtaaatttatagcagctgagtagcctttcagtaattgctaaagtagagtgcgatgaatggagttgttgagatacttgtgcacatttgattattcagagtacacagagattaaatcctctgctatttcaattagccctctgattgcctttgtaaactgatctcatagctaggtaggcaagctcacccctcctttctgactttactttagtgcaacatctgtttgaacagcattctctttaatttccaatgcctaacgtgaatgtcccatttgtcctataatatttggatcctaatttgtgagatctccttgtcatacatttgcttgaaaaaacttttccttaaaagtaatatccatctactcctttcactgcaagtcacttatatccagggatcagtctctacttgtcattccaaatacacttggcacaactactggaagactgggaaaaggggcttctgaaccatacttagtgtttcattacatgggtatctacccctatcctcacccaatcttgaaatgaccaggaaatagaacaatcaatgtcattttcttttggctttaccatggcactcttagaagtggttcatttgtttatgccaaaaaagacccatttgcctacagaaaaacctatagttacaaaattagacttgaaatcttcttttctctttctaccatcattcaggcagggcatccctttgggctcttctgagaactcattactatgcttcctttaaaatgtttcaacagactgctagtgagcatcagatatgatttcccaaagtattccaaaagtcattgtaatatgctggaattgatcactaaaatctgaaaaacacagagacaaatacaaatagccaagtggaagccgggcaaagaggagactgacaagtagagtgatatactgtctaccccccaccacctgtctttcttgtgtcaggaaaaactagtatagtcactgtagtttgttttatctctcagtataacttgattttataatcttcagtgtcatagctatcattgattaagccattgctatttgttaagcagaaatattaatagcctggcatgtatgtatttatagaataacccaaaacaattctagatgttaattaatattttaattcccccttttacagatgggttgaatgaaacttacagaggttatatgatgttaggaaaatctaaatttattctgtattagtctgttactctccctcaatgtccttgtcatagacgtcagccctaacttagctagtcatgacaaaagcaaactattgatagaagactattgactgaaaatccaaaattatttttaagtagcaaaaatgataccaggttggtaatatcgctgtgaattttatccatctcacttccttggactcttcctccattagacatactctcttcttttgtgtcaacatttttgccagctctgtctaatttgtattaaagttactcttcttcttatctcaaaaaataataaataaggcactttagacacctctctagctatatttctttctcctcccttacagccaagattcttgcaagaataccatatactccaactcctcacacctcttattaattcctcaaccctttgcagtctggcttttgatggtaccatatgactgtcaacaaaggcacgccaacaatatccttcttgttaaatctaataaacatttttcaattcttaccagatttctccacaaaacagttgatacccataagtataccttccttcttgaaacaatttacttagcacctgtagtattattttctactttttgtctttctatgattcctctcttcttgttctatttcatattgtcctcttcctttacctgtctcttaaatttgtttccagagttttttccttgttcttcatttccatggcactacattttctcaactgttttcatcaatgcttaggcttttaatctccaaatctctacctccaaccaagatctctccctcagcattaggatttttaatccaactgtctaggactctcttctcccccaatatcttgtcccataagaaattgaaaatcaacatggacaaaatatttttcctataaactgctcttatgttttttgagtttatgaatattatcatcatttacccattgccccacgatgaaaatttagtgactctttttatttctccttctctttttccatatgcaccaaataaaattccaaatcccatcaattctaattctgcaacatctctcaatctcccacccacattcttctacattcttggtatttagtttcaggcaatctttcacctggtttatagcctgtccattggtctcctcccacctccagtctgcccacagtgcttcacattccaatcccatctctatactgaggtcaaatcaacctttttaaaacacaaaaatggttaatactcttctctaatagctctcattgcctccaaattaaagtagtttttttttttttttttttttttacaaaatagaggtattttggaccttgatttcttctccaagtagtgacttgctatcatgacttgttgtgcctcctgcttgggttctcctgaactacttgcagttttccaaacacattaaacttgcttttacctcaaggcctttgcacataatgactccacccgcttgccctatttctcatcaggcttgccgtggctgaatcattcatcaggctttagagttcaagttagaagacatctgctccgctgagaattcttccctggcactcaaacttctctgttgtcccacaacattctgtttgcacccaataattagcacttattaaactctactgccattttttcttgtctacttttcccagcagactctaagcccttcaagggcagagatgatgtaaagctaaataaatgcaaagggtggctaataaaaaactgcaatgtaacattgcatcttggcaagaatccgctcccctaaccaaggtttcaagattttgtataccttctgcatgatctagtagcctacaaatgaaatacttcataagttatataacattcttttttcattatcagattgatgctgaattgaagaatatcctgtagtcctgaagcatgtttattaactttggtaagtatattttataaatgcaggaccaacggatccagcattgtaggatgtattttaaatatcaaagaatgggaaggagactttaataaatttattcttatctgttcaaactcattttacagatgagaatattaagcaccgagaaaagttaaagagcttacacttatacaagagcagccaatttctgatatatgtaagactagaatccaggtttactggtcccctgccttgtgcttcatccatcataatctcacatgtaacataatgataccataaagaacatttaaaggattctgatgcacttcaataggaagaactctgagtttaaagacagggctcatcaagtcttaaaaataacacagcaaggaccttaggaggaaagggacattcttattcaaatgaaaacaatactgttgaaatattattacttgcttttttcagtcactatattttcacctattaaaaaatgccagatgaagatattaagaacataaaatagtttattccaacgtaagttcacatcttaaactgaagagcacccccgccgaactctgcacatttcaacaacaatattttctctccagattcaattgtatttatgctaaagaaattacacctgagacttttgatgcaaacttgtttggatctcagttcttagctgaactgaggcttttcaataatgtcaacgtttattttgctgacttactgacaactctgcccaaaataatgtggaaacaaaagccttccaatccattcattaataacattaaatcatttcaccatattcagcttttcaactattatttaaatcctctgaagctgtaaaaaagaaaattaacagtctgagaaccagtacaagggggatggtcaagaaaacttatatttgaaatcacccaacctgaattagaatccccactctaactatctgtctgtgaatttgagcaagttatctatcctgtctaaagatgagtttcctttcatgtaaaatgaaaatttccatatctccctcacagtgttgttacaatgattgaggtgatgtatatcaaatatttaaaaagcagtaaaaatgaatattagcagtaatactagcaaagttgttgcactgatgctcctactactactggttgaatctaaactaaaaagttttcctgcccatatatttttgtgctctggtatacaaatatcatgtcccaacgataaagtaagttctctaaataattttccaaggaataaaaatcaaaatgcaagttatttgaagtgtaaatattctagagttaaaatagtttctgatctctgttgctgctaaattattacatcctccccccatttgaatgaatctttcctttatctcaatccccatataataatctccaaagagttaaaatcccaatatgcaacagtgacctcacctctcatccttcaagatttcttaagctttaattaagagtcagggttatttggaaagctatatgataactttgattttgaatatgtttttcactggactgtgttattattcagaactcagagtgcatttccttagtgttgtatgtttttaggctttgggaaaactaattaaaataggagaagatatcctaaggtaagtaaggaggaagtaataatttgatggatttcaagagatttcttttcagaacaaatgtcagaagtatcttttttttttttttttttttttgagatggagtctcgctctgtctcccaggctggagtgcagtggcgcgatctcggctcgctgcaagcaccgcctcctgggttcacgccattctcctgcctcagcctcccgaggagctggggctacaggcgcccgccaccacgcccagctaatttgggtttttttttttttttttgtatttttagtagagatggggtttcactgtgttagccaggatggcctctatctcctgacctcgtgatccgcccgcctcggcctcctgaagtgctgggattacaggcatgagccactgtgcctggcccagaagtat

SEQ ID NO: 17502 - DNA, 27360 bp, Human
ttggcatggctttatcacacagaattctggttgatctggttttgaaggtgtgttcctcttcacagcttttacatttacttcttcctggcagcttaaaaatgttaacaagcacaggacatttattattttaatattttagctaacagaaaggataaattcaaaccccaaaccaaggtcagagcagaacagaacttttttttttaacctatgtagatcccatgccaagtagataaacttttttcttgtctgttgctgcagattttgactaatttacaccctcaatgagggagtagcccttcaagtgcctggctttatatagacatctcagtttcaaatttgcatcttacaccaagaccaattcctcccccctcaatgcccatgaaaacccaagcccctggcttagtgcaattagcaactcctgtcttgcccccagccccttcccctaccaggccagcttctcattacacattcttacaggagaggcctacggggtaggaggcctcagttgcaggcaggagggacggtggaggccctggaatttgacctgggagggactatctacttctccagcccaggaggctgaatgctcagtctacagcagcttctggctggacttcacaggatgaatctccaaggtttcttatctgtctactccttcctccactcattttccatttgtggtaaagttatttctttctcaccccttacctttccccattggccttttgacaacagctgggccatttttcactctgtcttcctaactccagtgtatttactgaaagataaatgtgctgttttatatccctcgtaccacacacagagtcatttacttagatttcacagcacaaggatacatatatgagagctgcagtgtcatcatcaaaataggtctcactttgggaactcatggtatatctgtctcaggccacacctccattcttcacagtcacttctcagacaccacatcttggaatagagtgtcagagcaataaactaaacccatttccattgggacagcccatttggagaacattcctgaaccaagggtccttgtccagctatgcccccactttgatccaggtgatcctcagctttccccttggatcttaaaacaacattccactacccctctgcctccatctggactccctccaggctcagcttgcttttagcagaatcatgttcccagaaaacacttttctcatgtctcaccctgctgctaggaagtccacagggcaccttgcttccacagggaagcaagagagatttggtctcttaagtcaggctccaaacctctttcaaagctgacctagcacactgttgaagaaaaggatttggagcccaacagatctgagtttgaatcctggctcaaccacttacaagttgtgattagacatgtgatttaacctccatgatcctttctcatctgtaaaataagcatggttaaacataactcacagagctcttgtaagctgaaacaagatgaagtatgcatgctgcctggaacagagtagagtagagctccacaggtgtgaattctgtcttttcagtttcaccagccttgctatgagtgctggattcatggctgatagactccaggcttgaggcctgggtactagtgacccatagtacatgtggggtagaccctggatgtttgttttcttccattactggatgaaatgttctgtgtgggacaaggggcccatggggacccagccagccaaaaatgagctgctctagggccctgcttatggtgcaggacactaggacacccacgcctggccataccaggactttgttcgtgggttacctatagtctcgctgaactttacaaagaaaagttcttttgagttgtgcttctgccctttgaacctcttatcttcagagtcacaaacctggcccactaggctataaaagaagctcattccagtgtattctccctgcagcctgctccttgccatccaccacaaaccctcaccgaaccagtggccaccaccatgacaagggaccagaatggaacctgggagatggagagtaatgaaaactttgagggctacatgaaggccctgggtaaggaggagactggggatggggagggtagctgttgttgggagtactgtggtctggccctccagacagtgctgctatggagttcaacagacctgtggcaaatcctcatgcctcatgtacagctgtgcaatattaggcagatcataagaattctctgaggctcagttttctcatctggaaactgggaataatgataaatgagattatgtctaggatgccttagcacagtgcctggcccacagaaaacatacactgaatgtgtatgtcaggaggatacacacacaacagagtaaagccaaacttgagaggataacacagtcgctcttctgccttgtgaccaccatctctctgataaccacttggacctgatattatccaccaatgacctctgcattgttcttttatcagttttgtaatggggaagcagaaaagaaatagctagcaaatctctcagcctagggaaaatcaagctcatggaagcctagagaggctgttgtcagatagcacaaacaacccactgcttatatgacttctgaactgggttccaggccaagggctaccaattggtgcatgtcctgagttcaccacagagtgggttccctgtggaactggcagaaaacacatagccctgcccagcctacaggttctgcctgggactagagtgagtgggtccccagaggggagctcacagttactgggtggctcctgtgctccaggtgctgagcaaggggctttggctgcctgaccttattccatccctcagcagcctctttatcacctcttctagctttaaagttctccacatatggggtaacttcgctggaacttcctccacatgcagaatgagagaaacggcagtgggtggagttagaggcccaataataacttggatatgatggtgggaggtctctccaagagtggaaatcatgagttttttggtgtgataaacttctagcttgaaaatgtccaccatgtcaatgaaaaaggagagctgtgatatgttccatatttgtggaactaagcactttcttcatgttcttttttttttttttttttttttttattttggggacagagtctcgctctgtcgcccaggctggagtgcagtggcgcgatctcagctcactgcaagcccacctcccgggttcatgccattctcctgcctcagcctccagagtagctgggactacaggcacccgccaccacgcctggctaattttttgtatttttaatagagacgggtttcactatgttagccaggatggtctcaatctcctgaccttgtgatccacccgcctcggcctcccaaagtgctgggattacagacatgagccaccgcacccggcctcttcatgttctttagactggtttccaacactgaatagctttccttttcattctggttagcaggatttttacctcaatatagttggggggaggaagaaagagacaaaaatcctcctaccagagccccatcctcaaccctgttgcacctgtgatttttagtaccaggagtggccaatagaaatgggattctgatactacacatgggtaaatggattggagcatagcttggaactagaattctgaacaagattatacagataaggaaaccaaagcagaagggtcaacacagctcggactagagtccagggcttgctctgtgaccgtgaaccagttttttaaccttttggaacctcggtttcctcatctgccaaatagagataatagccccagccttgcctgtccctccagatgatattagatgtacttgtggttttgagcaattaaaagtactttaacaagggttatttggaagtttcaaggtttcagcaatatgctgaataagccagagtcaagtaatataattagaaagaaaccttgtgtcttttgctgcttatgcttcagtaacaaaaagtcctatgatgacttagatttaaaatctaggctctgtttagtttatggctctgcagagtggacccctaaagcccacctctctaggcttaaggtgagaagcaagcattcctaccaccctctttctcctcctgggggttgggaggatgcagagtacactacaccatcagctctctccaagaaatcctgcctctaacaacagccttcctctggactcttttcacatcaacttacacctttaatgtgagtaaggggctcacaagttgtgaatgtgatatttgaatatcttcaccattgaggtttcagattggacttcctaatgctccttggcatcaaatatttattgtctcttaaagcttcagccaaaacttccaatttaatatcacattacattgatttcactctaatgagcaagtcgtttgatctctttgtcccatgatctccgcagtgtagagtgttaggctgacactcaactgattaagattaataccatacatggtactactaggtaaacccagagtgggaatctgttggtgcctggtttacccagatgctgacagcccagtgtctcaggaccccagaaacttgctcctgcccaagtcatgaggccctgtgcagaaatgcctcacccagagtcatcttatcaccattgaggtaggaccccttgtccttctcaacctgccgtgggaacatgggtggggcaggcatggcagtgattgaagacaggtctcagggggctcagctagaagcaggcaaggaagagctgccccttcaatctaacctgctaaaagcagcccaacagatctcaacagtttcctccatgcccaggacataagacaggctgctttcccaacactgagatgtcaacgaagcttgccttccttacccttttgagcagagagacccttagcatttgggaagagtatgtgtagacatcctcaaatgtgtgactattgttaaggatggtgcctattccctatctaagaatcatcgatttctaatactttaacccctagcactagagagtttgctttttctgtgggcctggttgttggttcagtaaggaaagagcaactctactgagatgtggggttgggcagtaaactggctttgtcactagcccagtgacccactccacacactggcctcccatcatgactcagccaccagtctcagcagagtaacacatcatggtaacctttgggtttgccacaaattacatcattaagagttcaaaaggtgagtgagccaagggtcagtggtacttcctctcctgccttcttaggcacctggtgtttctcaccccagattctttcttgacagtgaggaaaccagttggtgaactcttttgccctgaggaacttgtcatgtcctgaagtcagtcctccttcaggtcagatcaggcgatgaaggaatgggaggggtggtcttcatttttaagagatgatcaagaaggacagacataaggaggtctcaataatgtgaaagaatactgggagagagttcattaactctgcccaggtgggaatcattcaacttctctaccaaagctttagaaggtgctgtggatgccagggactgtgccatctgaagcagaaccaaccctggaatctgctctcaaggagtcaggttacagccatgcacaaatggtattcctgttttttattactgtttgatgaattacccccaaaacgtagtggtttggaacaaccacgtcatttaattattatttctcatggttctgggggctgactgggttcaccccaatggttcctgctcaaagtctttcatttggttgcaattgggcagcagctggggctggagccatctcaggcttccttactcatatgcatgtctggcagttggtgctggctggcagctgagaccttaactggccttcagcatctacatgtggtctccccatgtgacctgggtttcttcacagcatgctggctgtatccaaagagaagagatacaagctgcatggccttttatgacccagcttcagaagctaccgggtaccacttccaccatattctattggttgaagtggtacaagcctgcctgcattcaaggaaaagggacatagaccccacctctcagtgggatgaatgtcaaggttgcattgtaagaacagcatgtaggatgagaggtgttattgcagccatttaagaaaatataatctgccacagatgggccagttgagattctatgccttgggctcaaaggggctatgggtatcaatagaacaatagtaacaagaagtgtgtgcatggtggtgaaaggagctacagtacatggagtcagtaaaggcttcctgagtacttcttggtggggctttgaaggaagaacaggagttctccatgcagagatggagtcaggcatagccccatgggtgtgtgcacaggcatgggcctgggacaccagaaggcactgtattaccaaggagtgaagtgcaaggaggaggcaaaagaatagtctggaaaagcaacaggatctttaagtcagtgtgctgcacatgaacttcaccttgcaaggagagggtctaggaagaaattgtatgcagaggagagagatgctatcaatgctcactctaacagagatagagtgaatagaccagcagactgtcagagaactaaagaggttgttacaatgaccctgggaaggtattgagagcagtacccagaaagggtgaacagggagatgtccagagcaggaaatagactggatttggtgactagaggaggaagagtcagggaggagtcagcctagaacatgaaaaactatcacataactttaccagtgaagatggggaagcatgtgtccaaaaattagatgttaaatttatacctcttttaggaaattttcattccataaattgtaactatttggggaaaacccattattttcttaattcacaaatgaaggtgaggattatcttctatgaagaacatctttttcacttaaattgacatgcacaaacttaaaagtgcagtggctatcacaaacagttctagtgggtctctgaaagctccactaggaaggcagagccctgagaggctgaagtcagacagctcccatctaagtggtctctgccaggaaatattccccgaatatgtgtcttgtgcaaaatctcatcttgaccatttaagagcctgcagtctagcatgatgggtgagcacaagcacaaattattctcataccatgatacacatcacactagagctttatatgcatttcttcattttagtgcattcagttttcaacaaatgtatcgagcacctatgacaaatcaggaagtgctctaggcattggagatatagtgggaaatgaggagacgagttccctgccagcatagagtttacatgctagtggggagacagaaagtaaacaaatagtttaaggttattttgggtagtggtgagtgctgagaagaaaattaaaagaataatggagtggcgtgtgatgggtggtcagggaaggtttgagggggtgacagtggaacccaggtttgaacgctgactagtattattctggacacaggggacagcaagtgcaaaggttttgggtgtgttcaagaacatgaagccaggtgtgatggctcacacctgtaatcccaacactttgggaggccaaggcaagagggtgacatgaggccaggagttcatgatgagcctaggcaacatagtgaggcttctgcctctacaaaaaatagaaaataaaaaaattagctgggcctggtagcacgttcctgtggtcccagctactcaggaggctgaggggggagaatcacttgggcccaaggatttgagaaagctggtgtgttgggagttgaaagtgtgtgagccggaggggttgggggtgtggtcagggagtgagagtagaaaggtaggcagaaggcaaagcagataccagccttatgctgggaagacaaattaatcctctttgtattctttaaggatcactatggccacagcatggaaaatgaatcataggagggcaagattgcaagcagagaggatgagagacccattaggaggctgctgtgttgtccaggcaggaaatgaccatggcttgggctagggcagtgcctgtggagctggagaaaagaggacagattcagcatatattttgcagataaagctcacggggtttgcagatgaatatgaagtgagaggaaatgatagaaatgaatttgggtcccaggcttaggcctgaataactgggcagatgacaatcccattgcctgaaatggggaagtcaccgggaggagtgagttttggtggggaggtaccaggctggggtggcgggggagcatgcattaagaattctggtttgcatattttggtttcagatatgttacacattcaaatggagtattaaaattggcactttgatatgggatatagagctcaggatatagtcagagataaattcagaagaaatgccttccgttttatggggtgaggaatccagagaagtggagagacttatccatggccacgtgtggttaggaaatgatggagcctaagacaggagcccaggctatctgcttctaacacccacagccctttcctcagcactgttcttggtaggggtataaaacatggaggtagggaagaaagagcttcactgtgaacaaggtatgtccaaatggaggcatccaaagtaaataggcaggaccctcagaaacactgaaagagaatcactcagagtccctgggtgaaaatgagtaggtagatagatagatagatagatagatagatagatagatagatagatagacagacagacagacagacagacagatagatgtctgatgctccaattaagaatttgtttcataaaatctggattcctgatggtgctcacaagtcaatgaaggtatacacgttgccaaagtctctacttgaaccatatggtacctggtaggactttcaaaggggaaatgctgagggatggaaaaagcctaggtaatgataggtgtcatccctttgtacaagtctccccttgcatgtgttggcatcagctccactctaatgtccatcccagtaagcatgcagtagactaagaatggggaggagaaacagtgcatagggagcagggaggcaccctagggtctccagcctgcccccggtgcctagaaggaagtgagaggaggaggcaggcagggatctcatctaattcctttctaaatgtgttttctggaggaggaagtggcatggaaaaaaggagaaaattgttcttacactctgcttctcacaattgcctaagagtgccaatgatttgagaattaaggagtccaaatttgaagcccatcaaagctgcactttgaatggttctcagatttcatatgatgaatacttgtgcctctctgctctttaatttacaaagagcacctgccctttttgcctgcaactttagcttttttcataagcacattacaaagcattttaatgttgagtagcatactcatatttcacctttatggcttgtattgttcaaaatgcagttatgaaaagtatgttttaataaagtcaggtccgtgttgttttttttccttctgcagcagctaaaagccatatatattattcagaaatagcttgcctttggacctttccttctgagatagaaattcatttcacctggctataaatcagactcagagatacccttaatccagaaaaggagataaaacatgcttgataaccctggtgttaaaataccataccaggaaaataattttctctgcaaagtacgaagaggaagtgtttttataatctgtgtgtgtgtgtgtgcatgtgtgtgtgtgtttgtgtgtgtgttctacatcctcagttaaacccttttgattagaaatatcatgagtccaccaacagaacatttggctaccttccctggggcagagcagaggcaacatgatttactgggttgtgcaaacactgaagggtggccaagaggccaagccatttttcaatccagaagagtagtgatgcttgattccatttgcatagtcttctaataagattcccccggcactggtcagaaagattgactagggatggtgtttccaggacaaaccagttctgtcagcaataggtatttttaactgtgatctacctttctatgcaaccagggacaagcaatactttttactggggagcggaggtgttagttgcaaatgacaacagaatgcgtttgtaaagaaattgtcaggagtgctatcctaactgggtagctctgagctcaccacttaaattctcacggcctcagtttccacatccattgagtggaaatagacttgctctcagaggaacacttcagttctaaatttctctgtagattttcaattattccttagtggttttacctagagccttcccctgtttcttctggttatggttaacagatgacctatggtttttcttttctcatctcctaactattgttccagaagtatggtttagcacagctcagaccttagcacaaaggactggagaaggagctgaagttggttctacccatcaccagactatagagcgaggaaactgatccacacagagaaaagtgttgccaggctggataaaatgcctatgggacagaccaagtctatgacagtaagagagtgtatcagccaccattcccacttctcctgtggagtccaagccccttgcaaaacatggagtgcagacagctatggagatgcataaatatgacccaaaactttcactctggactgaatgctgacttggtccctacttgacccaaacagataaggccaagagtggacggcaatgtgcactgcatatggacaagctacttggtactatgtaaagcattttaccattatttttactgaatccacactgtaaatagtcctctgaagtgagcattcttttcctcattttcctacaaaggaagagtgatttctccaaggtcacacagctagctaggaaataagagacaggattgtacctgcatctgccccttacccttactcatttataccacagttctaagctttagcatgcacatgatcacttggaagacttgtaaggacaagcagagcctggccaacagagctcctactttataggtctagggtgggccccagattttgcatttcttttatttttatttatatttatttatttagaaacagggtcttgctctgtcacccagcctggagtgccgtggcacagaacctgcatttctaacacgttcccaggtgctaatgctgctgccagcccaggaacctcactttaataatcactgtcctggcccttgctgcctccattagctaatccatagtatttcttgagtacctactatttgcctagctcaagacctggttctatgatggtgtggtggggaagaacacagagcaagaagatgtcattgtccttgtcctcatagaggtgaaactgcaggaaagaataaccaactccatgaaaaatgcagggggaaatgctaagtactgttggcaggcagaggggagcagtaaaactgtttggcctggatagcaggtaaggaaggaggcaagaaagagtaggaggaggcaaatctggggctcggccttatgagatttggaaagctgggacaagagtgacagggattcagagagcaactgttcaagggatatgtgggaaaacacaaagaactaaggaaattggcctgtgagatcaggggcttcataatgatattatgatgatggcagcctccatttacagagccatgatcacaggctgccagccactgggcaaagctcttcacaaacaccatcaaatttgatcctcacaacaaggtgatgcagttaataacagctccacatacggccactgccctctgctgctttagatctggaaccaaatgtccagcgacgagactgaagctggacacacttggggcagaaggagagaaatatcagctggagtgtgacatgccagcctcttgccagttcctctgcacgacacaagcatgtgcttgtactcactagaacaaggaagatgctcttcagtggcttgtagcaattttaaggaagggttcattttttaagtcggaaatacttgaccacttggtcctacctaaacaggtcagcagttaccttgaagagagaaaaattaaataggtatgattgcaaggccaaggtggctgagatacatgtgtcagaaagggtttggtaagccctttccatagtaagttgtgtcgggacacctggcagactgcatattcctccacagaggggctccgtggccacctcagactttgaaaaggtgcatcctctaccttccctccaacttggagctacaaagcacctttcccatattaaagaatctatgaaattctacagggcagaaaccagcttgtcttggttttaattcctcatctcccaaacttacttgctcgtgagcccatttttttgaccaccaaacatccgatggagctgtaccccatggcaaatacagtggggaagtgggggctctaggaatgttggccaagaagactagaggaattcacagaaccaaaggcagccgagagaccgttcgtctctccccacaccccatgcctcacaggctatgtgacttggacgtgctcacgtacaattccataagccacagaggtgaagcgaaatgagctgccagataatgtagccggctggagtgtgattgcttcagctctcacttattatacagccctgggcctagaaaacaattgccatttggtgggggacagtatgcaagggctttggaaaacaaactgcctcaaacagggagggctcatccaactgaatcccacagtccctgtgtctccaggggaaatttaacagaatcagaagttactagtatcttgggcagccacagaaattgcacacatggggatggtctaactgggctaccccagagcttggggagcacagcactggcccttgagacagatcatcctaagttcaagtaccatctcgactgcctcctcaccacataatccagggaaagtgacacaacttctctgaggcagtttttccgccgtggcaaaatgaggataaaataaaacttatcttgtgggtttatttgaagaataaaatgaggaaggtttcccaagggaggttacaccctgagccaccatccctagacactatccctagacacaaagggacaccatccctagacacaaagcgtgtcttaattgccaccccaaatattaccaagagtccacacagcatggctcgcagattcaccttacctaaaattcagttcactatgtatccccataaaactagttccctcttttattccctggctctcatcttgatcatccaagctcagaacaactgtttcttccttccaactcaatctctctacacatctatccaattaccaagccactacaattgctgtatcagccatgtatatttagacaagtagactgacctctctaggtcttacttcatcatctctgacatgaaaagtaggcactttaacagtaagtagctttcaaaatttttaaaccatagaagtctttttccaaacagcctcctatggacaaagttcaaaatctgaaatcactgagctctaccacccagagattctaggtctgggataggacccagaaatctgcatttttttcattgtttcaggtgatccagaaaggaaactagctttgggacccactggttcctagacatggaaggtactcaacaaatagtagagaatgagaggtgagcaaggcactggcatttgtgcagcagctcatgccaacttgaacttacttctcttttcaacttaggatacaggtatgtaatctttttaccttctggctagctaatattacttaaaattgttctgtcaggctcaaatctgactttatacaagttagagtctaaaggtacccagggccctttctcatgcagctgtgattctgttgtggattcagattgctgacccaaagtgaggttcaactcggcctctccttgattttggggaaaaggggagtaatagtgaccaaagaaggatttttttttttgagatggagtctcgctctattgcgaggagtgcaatggcacaatcttggcttactgcaacctccgcctcccgggttcaagtgattctcccgcctcagcctcccgagtagctaggattacaggcacctccatcatgcccgaataatttttgtatttttgtagagacagggtttcaccatgttggccaggctggtcttgaactcctgaccccaggtgatccacccacctaggcctcccaaagtgctgggattacaggcgtgagccaccaggcccagacccaaagaaggatttttgaaggaaatgggtcagaaaggaaatggggagagagtaagggaagtgatgcttggccaccatgggaagacagcagagtcgtcaatctccaaactgacaggaacttcctgagctacctgctgctctgtctttcatggccacaatatagtgtttgtcctgtaccggacactgcacaacatgaaatttcatcacttacatatcataaagatggtactgcagttctcagagaaatagcactcgataaatttgaactgttcttattcttgaggtcaatattatctttgggttttaatagaatcaattctaggttttttaaaaccttctcagtggattttctaaaaaaaatattaaagatttaaattggcatctaaagatatttggagaatttacaggcataatgggaatcagatatttgactaaagaccaagagtgatgatttcatagcaaggaaagaaattcaagtattttcagaactatcctctctttctagatctactccacaggccaacaactttttggcatggctctagttgagccacattttatgcttaactaggggtttgcttcttcttgtaatatgcaacgcttaggacattcaacactcctttggtttgtttcaacattttcataataaaaatgtaaacaattattaacctatcccttaaaaacaacagaagaggccgggcacagtggctcatgcctgtaatcccagcattttgggaggccgaggtgggcagatcacaaggtcaggagatcgaaacaatcctggctaaaatggtgaaaaccgatctctattaaaaatacaaaaaattaaccagacatggtggtgggcacctgtagtcccagctacttgggaggctgaggcaagagaatggcatgaacctgggaggcagagcttatagtgggccaagattgcaccactgcactccagtctgggcaacagagcgagactccatctcaagaaagaaaaaaaaagaagaaatctctgaacaaatatttattttccagaatacgtttaaaactaccttgggggccaggcatgatggttcacacccataatcccagcattttgggaaactgaggcacatggatcgcttgagctcaggagtttgagaccagcctgggcaaatggtgaaaccccatctctacaaaaaatacgaaaattagctgggtatggtggtgtgcacctgctgtcccagctacttgggaggctgaaatgggaggatcacttgagcccaggaggtcaaggttgcagtgagccaaaatcatgtcactgcactccagcctgggcgacagagtgagaccctgtctcgaaaaaacaaaacaaaaaacaaatctatactgggggctaagaactgaggcagaacagtctgctgttaaaatgaaagcttgtaactatccctccccgctgtggacattaacaaaagtttcctaagtttcatctttatccatgattaaaactagtgatttccaaagtcttttttcttttaaatcatgagatctttttgttcagcaaactcttaggaggatgcccaacaggtcagatagaatagagctgctgtgacgtgtgtgtgtgtgtgtgtgtgtgtgtgtgtgtgtgtgtgttggggagctgcagcttaggggtgaggcttgtgtgctacatctccctcccatcagggatcctgaggaggtgccaggagactcctaggtttcccagcaactgactgaaatgcccaacttggccacgagtaagatgcttgtttcccacttaagcaaagacaggtggcctacacacaatctgtgtctctagtcttgaatgtttggtcttgttaacgaaatgaatgagtctggctgagcacatcataacctccacaactccctttgccaacagatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggtactgaccggggctggtgtttttcattcacacattctgtgccaggggctggctatttggtatcatgatgaaaaaaaaaatattagaaacaacctgggaaaaatcaggaaaggaggaccaggatggccttaatcatgctggcaatgagcaattattgacagtttagtaggaagaggcaggcctaggagagattaagagctcaacctctccatgatccagggccagggcctatgagtcatatacagccatgggcctggcaggcagagggaagagggcaaggtggaacatcacagggagggacagcacctgcacctgctggggagcaagggcacatggaaaggtggcagccctgcccagtgccagccaagcactgccatggaggagcgaagcctgaagatgccagattttttttaggagatgtagagaaatcagatgtttttatataaaatatctcaaatttttatgattctgctgaaaaagagcaagtataaaatgaaacatctcaattatagatgatcccagctgatttcatttttttagaaaagaatgatccaaattaaacaaaaaaaaaaatcagtaggttaagtggagtcaagatttatccagccctaataacttggagaaatctctggcaagtttgtggcttctgtcctagcattgccttaaccaacaagggataatctaggcaactctccatgtatcagaaggccagactttcaccatttgaactactgaatatagatgggaccctgaaagcaggcagaaaacaactctgagaggggagtagggagttatctcaaagcccaaaaacttgagtttgcagaagaagcaggctcttgcccacaggagctgtttgtaaataaggcagaggcagcagggagaagtggagaggtgctgggaaggcaagggtaacagcagctctccccagcatcaccgtgtggtatcccaacccagtaaccagccctcctgctcacattcatgctcagtgtgcctgtttttgattttccaaatcaaattacacctggtcagtccccaccaaacaggtataggagaaatccaatctcagttgtatttaaggattccaccaaaccttcccactgtaacgaaccccagggatatgcagtccaagagatttgggaaggttcctggcttgtcatttttcatggttgcaattgactgttcactgtctatgcccatgcattttatacaaggctgggcagtatgaatattcaaagcatcctttccctctgggccaattcagccactggaacctctgtcctatctcccaaactgagggaggacagagctgagtactctgacccaaggtatctgtgctgtcaccttcccacccccggcaaagggccagcccttcaagtgccacaacaaagcaagcaacaccctctgccctgccctgcccccctcaccatgagtcctgatcttcccaaggtcaggccactacccagagactctcacactgtccttccaggagttcattagaagtcagaggtctcaactctccccgaaagcaatgggcacaagctctgactcctctcctggggtggggaggaaaagctgttattattatttggtgacaattaaaagccaagagagctggacacactttatttctcagtcaagttgtcctgtagcattgataatctcagccatcaagtcaaggttgaattatatttagtgttctttgctaaagaaaagtagggaaatataaagcatgatggaaatttttccaccagagcactcttggcatgagaacttatgattctgggccctggaatgtccacttatggaacccctccctgaggggataatggatcaacaagccttttctgaacctgtgaaccatctggctgaaaagccaattcattggacaccagaattgctaggaaaattgatctcagaatttcttgcatcactctgctgttccaacccaatcagtgcaaaatgattcattttccctcacctttctgttttggttgtgggctcttgaaaagcaggcctgtcctctctgacttgatcctttgtgacctttgatggtagagaacttgttcttcctaaaataaatcacccttccagcccttaatggattccacgtgttaacacactcctacctttcttctgtctctccgtgttccattttctcccctctccagtcagcagttagccctgcagaaagagagagaatcctctttcccacagcttgcctcctctttgccttcactagaaagccagagtgaatgcacacacacacacacacacacactcacacacacccttagtagggagtgagaagtacccaggacagtttgcccagcctccaacaatgggccattcccatgagaatcaccatgcagagcagatgcccaagggactacctacttcctgtaacttcactggaacccttcagctggaagggggtgctagacagtgggcaaatctctttctctgattaatttctttcttttttttttttgagacagagtttcactctcgttgctcaggctggagtgcagtggctcaatttaggctcattgcaacctccacctcccaggttcaagcaattctcctgcctcagcctcccaagtagctgggattacaggcgtgcgccaccatgcctggctaaatatatatatatatttatatataaatatatgtaaatatgaatacacacacacacacacacacacacacacacacacacacacatatatatatatagtagaaacagggtttcaccatgttggtcaggctggtcgtgaactcctgatctcaagggatccacccgcctcggcctccaaaactgctggggttacaggcgtaagccaccatgcctggcctctgtgattaatttctgtcacccacacttggtggcatgcctgagtgaacacctatacacgtgtgggagtgtgaggatgtgtgagtgtgagagtgtgtgtggtactcctcatgctattgttttccagggctccatgtctcaactacttggtcacccttacaagccctctggaaatctccccactcggcagtgtggaggagaggtgcatgttgtgccctgtagtgcccagttctatgccagcccagagcagaagcaatgcaaccacattgatcacagagtcaattctcctctgaggagtcagggactccccttaggaaggacttcctgtgggttctatgtattcccaacttcctatcctggctgatttctaagagaagttaaagccccttccaaaactacacaagctacccccaaaataaaataaaattaaaaataagcaattgatacccatgtaatggaatgtggagtatatgcagccatgagaaaggatgaaggacagactcatgctacaaaatggatacacctggaaaatgagctaagtgagagaagccccacacaaaaggtcacgtattgtgtgatgtatgtgagacgtccagaacaggcaaattcatagagagagaaagtggttgcccagagacaggggatagaggaaatgaatggtgattgctagtacataggggttccttttggggcgtgaagaaaatcacctggatttagatatattgatggttacgcaaccttatgtactaaaagctaccgaattgtgtatcttaaaagggtgaattttatattttgtgaattatatctcaataataaaataagtaattgaaattggggcagacagtaagggcagggaaaagcagggaagacaatggcggttagagccaataatgccattctgatggcagaagaagatgggagcccccagaagaggagtggcagacaggcgctgccagaggaagggccctgcaggcgaaccaaagaactcttaattgagggcaagtgcgctaaggagggttgagcatgtgaatactgtccttcaatgctcttaaagagctgttgttttcctttaaaaaaaaaaaagtgttggcgagtaattccaacttacagaaaagttacaagaatataacaaaaaacacctgtacactctttaccaagagttaccacattttgcccctttgctttatcatgtgcacatgctttctctctaacatacaaatatttttttctgaacaatcagatgccttagccctaaatacttccgtatgtatttcctaataattaaggtattctcttgtaaaactgcaatatggttatcagcttctataagtttaacattgatacagtgcctgtatctaatttatcataaagggctgttttaagcaatgttagctttggaaactgtgatagtggaaagcatggtgggagcccaggtttcttcaattctgtgtacagctatctgcccttggaatgtactccttctttatcccctagctgagaaagaagggctttcctcacttgtttccatttcctcaacctgaggatcttttaaggcaattgagcctcctttaaaaatctcttctaatgcagggatgaagggcaccaactaaaagcagattaaattgagaaattttagttcatttaaccattctcttctttctgcttcttatttttatataggagtaaggctataatattgtaagtattatcataatttattggtaaccaatttactttagggtcagaacaacttttaatcttgctgtccagtatgagttattaaaataaaatattaggacaggcccatgcactaacatttttctccttccttcttccttccttccataaaatttgctaagcccctactacatgccagggctaagtcagtagctagtgataaaatgatgaatcagacgccctctcctgccttcaggcattgcaagcctcctggggaaggcagacaagtaaatgaacaatgaccatattgatgtacgtgtgtgcactctggtaggaccatagaaactaaggcaaggaagcaaatggatttacttcaagattatgtttcaacaaatagagattcattcaacaatgctgatcactgtgctgagtctggtgttgcagaaatgaacagcagatacagcatcttctttcatggagcttactgtctactgggggagacaggcatcaattcaaccaacacgtgttaggtatctatcatgtgtgaggcaatctgggagtgaggaggacagacgacaccgtccttgcccaaattgaagacatgagtcctttctcatctgtttagaggaaaactcagagtccaaggctcatgataagaaagagcaaattattattccagacatcttcctcccaaaagagcaaggaaggcaacctatgaatatagcttctccaagacctttaaagatgtgaggtttaggatggtcctaaaggaaaaggagaccttttttttctttagaaaacatgtagaattttattttcaaattagctttgggaatatgaatacatgcagatggttaaaaaaaatcaaaaagtaaaaagtaacattttctttctatcctagccccagccacaagttctctcctcagggacaatcactagtaagggtttcttttacttccttgcaggaaacatgtacaaacatatgcatgcatgcatacccacccccgtctgctttatgcatttggctctgctccttgctttttcgacttaaaccatacactacggctatattctttcaatgactgcatagcagggatgaaccataccatatttaactagccacccactgacagaatttacgaagcttctagtcctttgctgtaacaaagaatgctgtgatgcactggggagtaaaatgagaaggaataaaattgtacataaagtatataatatggtcaaggtcaaatattattttagaaataggtagatttaacaatctgtagaaaacagatttgtaccaaaaaaaacaggcccaaatgtacaaggacactggggaaaaaaccacaggtcagtttatcaccaactgggtttacaagacaccaagaaaagtaaacatctggtccttagcataatattgttcagagaggcataatgtagtttgcacatacttggaagaaaatcagctagcatcagggtcatccccgaagaagaacaacacaggcacagaaccattcttcagatgggaatgacataatcatctcaggaagggcacgcctaatttgggcacagaagtggttggccctgtaggaccacctaggggtagtacagattatagcaggtattaggaggggtaaaagtggggaacagaaggaggagaaatttgaagagtaaatagtttgtaaacatgtacacaggggtttgagcactcttgggattcagaaggcctacggcttctccaacctgctggccactgtagcctggctgttcagcacatgttctgctgctgcccctgtgctattaaccagttggcattgctgctgggaggaacccaagaaccagaaggtccacccatctggttctggataagaaggcaggtactggagccatctgggcaaccccctgattatttagggagctcccctgcctttattggtgtcctatagtgggcaggtctcacagtgtgattcctgaaggagaaattcccagaagtagaatttctaggtcagaaagtacatgcagttttatattttgaaaggtaatataaaattgccctccaaagagatttataccaatttatatccccatgtgccctgtataagagagagtgcctgcttctctactctccctccaattcagtgtattatcaaactctttgatctttgaccatatgatgaattgtatctgaaaaacaaagtcttcatttgcatttctcttataatgtgaggctgaatgtcttttcttatgtttagaagccatctgctagggctctctcccccttgtaagctgttggttcatgttctttgttaacgtgaactattaagttaatgacatttttcttattgatttacaggagccctttatatatataaggaaatcaaatctttgctgatatgttatcattttcccccagttttttgtttctctgttgactttaaggtattttccccttccagaaattttacatcgttatatagtgaaatttatcatcttctccccactgatttgaaatgctatttttaccataaggaaaaatggaagagtagaattccttgaaagaaaacagagcaagccaagataagctggtttggctggaatggagggtgtatgtggaaaatgacattggaagcatcttggctccctgaggctgagggctctgcccttcgagtaagcaagaccctgaaatggctgcaggaattgcagctgcaggtttagatttgttcagtccctcaagaccatgtgtttgatttgcctgggaatctgtctttacaggcactggtcacctgggaaggtgatgtccttgtgtgtgtgcaaaagggggagaaggagaaccgcggctggaagcagtggattgagggggacaagctgtacctggtaagtactgggttctgctcagctcacttccattgtgcttacacacgctactgtggtcacctagccaggtgttttgacaagaaaaatggccctgcactcctaccccgagctccagccaaatgcatgtggtcatatagtcagaaagccattcccatctggctcaggggactccaggaagaaatctatatggctgtttctgtgaacagctgcaattcaaaagaaagttcaaaatgctgagttaggaagcagagatccaaggagaaatacagggaacctgctaaagaccagctggggagaaatgtgagccacagaatttagatgccctggaggagggtgggacagggccttctcataatgatgggagcctgggagagagagtggggtggggaggagacaggacccactctgcctgggaactgccacaggtattgacctctctccatgaggtatgtccttctgaccccaaaatattttaaggtaatttggtactagaacagagcagtaggaacaataactgatatccttaaatatcttatacctgttgagacagcttaattttttattcttcaatcttcaaggcacttcatgggttcagcattcaaatggtgaaaaatctctcactccttcatcctttttcgctcatttgtaaatgaatggctcattcagtgaatggctcttcattcattaattcactcacctttggaatgaggcaggtacctggctccaatgtcagtattcaggttgccacagtgcccttcacagccagccttgcttcacctgagatctttattttgaaggcaatgtcagctaatgatatatgggaggcatttatcgtgttttgcattgatggctttccctacctgcactggtttggatggtggatttttctaattgtaatacaatccccagtgctctctgtggcttagacaatggattcacagtcaactgcaatgattgtggtggtccttcccacactcatgtttttccctcctccttcgaggatcagtgagggtcaaataaggcctgggctccctctatctggatgaaaagcgggaccttgtcggctgcacaggcaagcctgggaaagcccttctgcacctcacaccctgcgggtacctgcgccaccaccagccaatgttctaatcaccagaggccagaaagcccacagggtggaggggcagctcactggccagcatcttttcaggcccctaccttccaaacacttctctacactaggtcctttccttcctcatggcttcgctgccttttataaattaggtcatgttactttaatcatgggagtaggagaaatcctgcccaagagggtcatttctttgcatttttcatttttatagttgttcaagctcaattcaagtgtcaaaatcaaattactgctacctgcagggcatgcccgctgattgggtctgtgagatgcactttgcccagaatacctaagtgtcctctttattccaacctcccacccccagataccaagggggctgagggctgggcagaagaaaggcctggcttgttagaccctcacccactttctgacgttgcaggagctgacctgtggtgaccaggtgtgccgtcaagtgttcaaaaagaaatgatggcgacgtgggaggcctgccaagcacaagctccccactgcccacactgagtggtctactggctttgagaaacagctgtggggaccttcccactcttgacagagccccattaaggcatctgggtgggttttaaacagaatgcctatgtagcagtgatagacatattcccctcctttgaaacctagcattaaatggaaaaacaaaaattactcccatattttgaaaccctttatatggatctccgtttatttctagagctgtcagttttacccacagacagaagagatgactgtctgtgtggtttttgcatgtttattaatttgtttcaatttattttattttgtttcttttttcttagcttgtttgttggttgtgggggacatggggggtggggaggagggcattttacctagaaacattctgtggcccgcacagcatctgctactgattcttgaacatcctcgtctgagactcattcctttggatgcacattatttctcaaaagttctattttaggatacatatgcctcccagtctgcaacttgccctgggcagcctgggcagagctattccaacagatctgcagtgccagctgctcttggcccaagccagcccactgtccatcagccctgtgctgtggagggggtcactaactacaggtctactcagactcagtgtaacttctcaactactgccacatgccaggtgctgcaaactctggggccaggaggcctgaattcaagtcctgccccttcacttcttagctggttgaccatgggcctgtcatttggcctctctgtcctcattttcctctatcataatatgaagaagagacaaaactatcatctcctccactgggtcattgtgaggattaagcaatttaaaacatgcaaagtgtttggaacgggccctggtatgtggtaaggattcagtccctgttagccctggtccttctgctgagttaccccctccacagtctcaggggtcctggtgagcagatgctaactagagataggtcaatacttccacaaccttctggtgccttcagaacattaggttcattattctgagcagaattgtattttgctgctggatacgcagatggaatagtgcacctggaaggacagagtggttaatgcagacggatttgtgatggatcattcacggggtcctaaattcatggggtcccacaggtaaaaggcatgtccttcatccttctgtcccaccattaggcaagcattctctttgtaaagcaggtttatccccagaggggtagcacatggtgttagcacactttggtatgatttgaatgatcagatcttttcattgatcctgaacatcctaaatgggattagggggatggatagaaaggctgcaatccagccatgtggcccagggccagccttggctcaagccctttgatcaagccatcatgctatgggcctcctggcaagctgtgctcccaaacaaccaagccatgttcctgcagcaagaaagccagaaaagtgcctggctggagcctcatgttagccgggagaacggaggaggcggagttctctcacatgcatggcctttttggtcaagtcagtgagaggcgctggggaggaaggggagcctcctgaggaagtgcaggcctcctctcctggggcagacagggaaccaagtagagggaccagtgaagtgggccctttgtccccaccttcctagagcttccccaagagcccatccccactcctatcactctcgccaggcttgcccttgctcgccacaggctcaaatgacctctcatctgtccctcaagaaaaccctattgaatgaggttgtgtctgaagcccactggggactcactgtgaagtattctgcgcaggtaaggggttagtatttatttttgatcctgggttaagattccatgaaaaggtttatggtcaaataaatttggagaactatatccccttcctagaaattcacaatgagaattagcatttttaaagctctgacaa

SEQ ID NO: 17503 - DNA, 38119 bp, Human
gccttgcgttgaaacactgcctcaatcactagctatgtgatcttggaaaagttacttaaactctgagaattaatatttactccacatacttgaagtgagattgtgagataaagaacacgacaattagttgcttttcttcttttccctcttctccacgagtaacaatccattttaatctccattttagtctagatcatttctcaggttaagcttacaggtcccatcactgtatcactaaacattacaaagttccacagtaagagacaatctcgctaacacaggcatcattatatgagactgatgagcttctagaaagtctgatgactacatcataatgggaaggataaggcgttcctcaaaatggatgccgtaagtaaagtaagcgcaattcaattgaacccgaatgtttattgagcatttcctcagctcattcaagaagtcattgttaaccatatattaaggcatccaagaaacaaaaagcgcatttgttgtagtaaaaaacaaataaaataaagctgaaaagatttcaaataaaaggtttccagaaaataggcattaaaaaaattgtcctaaaaaaaaaagtgctgctgttttttcctaaataatgatctaattaaatcaccaaacttactcaaaatggctgtgtacaaaaaatgagagttgacattagatctcggacatatttcccacatacacagtgatttgaagtaaactgcagtttgttttgaataaatctaagttatatgttgtattactatgtattgctaaattctctgcactactgtcatgcaatactaattttacaggggaagctgaagcctgattaacttcgtcagtgccacaggaagaaacaagagacagaaggaaaaagcactttggatgcccgctgtaattcacagagatctccacggtaggagcgggacgtcagcttctgcggctaaaatctcgtgactgaagcagcacagatcagaaagaacgatttaccaggtatctatttcgttctagaaaggggcccataaacctaaaaagcatccaggagaaatcgcttcctcccgcttggcggcaaaggacagagcaggagggcgagcactgagtgtttaagaaggatgaggcctacatggcaaaggcttcgataagtagggaatgcaaggaaacagaaaagggggaatcaggttcgcaaaagtttaccttttagcgccagcaggtgctcctgtttagggggattcacttccattttgaccggcacttttgacccacagcctacgggggctggacaggttcaacttgccccggaaggaaacggaaaacctcgcgtttgacaaaaccaaaagtcaaacgcactctcaacctctctctggtggtggtaccttaaattctcctactgtgtcctttacaaactggcttcttttcaacaagtccatttcttctatcttagaaacgtaggcataaaatactttgttttccatctgcaatcacacatcgcgactgcaggaaaagaaaccacccctaggtaacaatacgcggcctcccaaaggccaacgttgccggagttttttttttttaaaaaaaaaaaaaaaaaaaaaaagagagagagagagagtggcatgctgggatttgtagtttatacaaaaaccgcgttgcatgcagggagatgcccgtaccccctcaccgccctcagttcacgccctggctggtttgcgattcgagaggaaaaatcattaaaggatctggagttttcaccccaaaactttaatcgttttgtcccttctttttttttcttgtctttcctccagcagctgcagactacataatgaaaaataacaaaagtgcccatgcgcgaggctgtgcaactaaccacccgacgattgcggggaggaggagtaagagtcggctaagcggcgcccagtgtcctactgcgcctgtgcgccggtggcgtgcgcagaggcctctgggtaggtggctcaaccccgcctctcagttgaggactctgaaggctgtttctgtggcgcttcccctgcgaggatggctaccctggttgtaaacaagctcggagcgggagtagacagtggccggcagggcagccgggggacagctgtagtgaaggtgagggaccttgcgtgctctattctccaccatcggcctcccttcggttcatcctggagacctggcggcatcgccgcggcccaggcttcgataggtgggatgcgcggcctctgggccccttttggcattacaagtctcgtcctgtcctctgcatcctttctctcctatggcctgaaattgcctggtcttctgctcatgacatgtcatcatcgggacatttgtgaaaaggagcttgcgggccagtggcagtgacctagaccggtcttttctccaggtcctctgcttttagttaaactcaacagacattaattagcttagtattataaattgagtcatcatcatcgtaactacgtactaagttaggtgttttagctcgttaatatctacttatgaagtagatgtgaattcccattttacagggaggaaacccaggtttaggtaaacagtgtgtggcagagccccgggttgaccggctttaaagtctgtacttttcgctcttgtactgcgtctgtaatcagacatctgttattgggtgagctgccccctcccctgttagtagtacagtctattaactctttgcacaagtctgcagcatcgtcatagctgggcattaacgatagagtttatgaattttcttatgcttgaagtttgagattctaccatgtatacatgctccagaatcaatttgctaaaaaatcatttgaaatatgtggcactcatttttcccttccactgttgtgcacggaaagatatggaggggagaactgatcccattggtttatagagtaaccttcaggagcatctctaatctaagagattgataattctcattcctggctacatattaggatcactgaggagttttagtacactactgatgcactcctcctccagttctgatgaggttgacatcagtatattttaggaattaccagaagttattttaatgtgcaaccagggttatgaattactgatcaaggtaatatatgaagtttttttcacatcttgaaaagtagacacctatgattattcaggtaatgttggttttatatgacagcaaatgagacatttcttcccacaatttagtatcagtgaatattggtggttgttgattcagatgacctttaggtactaatgaagttattctacaggtacacggcatatctgatatgcaaaggagccctcattattaggcatgttgtgtgactgagattttatttattgaattgtgcttttgctaagtagagaatacttgaagagcagtttgtgaattaacttgaagtttaagttttatttcataattggaatgggtatcattgcagtatctatttttttgttaccctgtttgccttacagtctcaaaagtgtaccaaagcctgatgtaactccagtttcttacagcacagaatttgatacattggaggctcaccttgttcattttcatcttaacatgtaaaatattcctgaactgtgcaatgaaatagtcctttctgacaaaatcttcatgccataatttgtagtaggtatagtagcataaactaaaaaaatctcactgtcatttctatagatgaaagcaagaagtatttattggaaggtaaaagttgaagtatataatgctaatactgtgtaaaatggccttttgcttgtgaacaagttgataatgacatggcttttatcattagagaaaacagtaacataaaaatctgatattgtggctaggcgcggtggcacacgcctgtaaagcacaaagtgcctgggaagcactttgggaggccaaagtgggcggatcacttgaggtcaggagtttgagactagcctggccaacatggcgaaaccccgtctctactaataatacaaaacgtagccaggcattgtggtgtgggcctgttaatcccagttactcaggaggctgaggtaggagaatcacttgaacccaggaggcggaggttgcagtgagctgagtttgtgccactgcattccagcctgggtgacagagtgagactccatctgaaaaataaaagataaaaaatctgatattgtgaaataactgacatttaaaaatgtatcacagaaagtttcacacctttaatctcagcactttgggaggctgaggtgggaggattgcttgagccccagagtttgagaccagcctgggcaacatggtgagatcctatctctacaaataataataaaaaaaaattagccaggcgtagtggcacatgcctgtggtaccagctacttgggagtctgaggcaggaggattgtctgagcttgggaggtcaaggctgcagtgaaccatgctcaggccactactctccagcctggctgacagagtgagaccctttctcaaaaaaaaaataataataataataaataacaacataaaataaaatatctgattgattacagtttgatttacaagtaataagtttgaagcttttttggcattttttgaagtgtaaaattaagagctttttcctatctagggttttttgctgttaaccacaattcctatttatagatactgaggaaatattttcttgctgtattatttaccgagttgatgcaaaatagtctagtaactttatttttggacctgtgtttggtttgctaatcaatggaattttattagtgctttttgaaaaatacattaacagcataaggaagttcttttaaatctttgtatagtgatgggatcagagatacaggattgaaatgaactaaacaattttaatatggttctttggagtttattgtcataaatttaatttattagagtatcataatacagcatttataaaatgttgcatttattttatatcaaattctattgtgaatttttgagacagagcctcactttgtcgcccaggctggagggcagtggcacaatcttggctcactgcaagctccgcctcttaggttcataccattctcctgcctcagcctcccgagtagctgggactacaggtgcccgccaccgcgcctggctaattttttgtatttttggtagagatgggatttcaccatgttagccaggatggtctcaatctcctgacctcgtgatctgcccgccttggcctcccaaagtgctgagattacaggcgtgagccaccgcacccagcctatgaatattttttctatatttaattgaattttttttttttgaggcagtttctcactctgtcacccaggtgggagtgcaatggcacgatcatggctcatagcaacctcgacctcctgggctcaaatgatcctcccacctcagtttttgatttttttttgtagagacagggtctcgctgtgttgcccaggctggtcttgaactcctggcctcaagcagtcctcttgccttggtgtcccaaagtgctgtgattacaggtgtgagccacagtgcctggcctaaagaatttgataacgtgaaactttcccctttttaaaaaatgtaggataaattgaagtatgtgtatatatgaataatagacagaattatacgtggatagctgttccccagttgtttgcctttttcatggggaaccagtgttccaatgttactggtgtcctatgtatccttccaggaagacaatacgcttatacaacaatacaaaaaaaatttgctctttccccacctttatgcaaaaatgaatatattctattatttttctttttgttttaatcatatgaaatcattctgtgtatatatgaaaaacttcatctttctcactatcctatatagttttatagtattatgaatgtgccacaatttattttccaagctgatattgatgtatatttactttctttccaattttttgctaatgcaaatgatgctttaaggagtaacatacagattttgtcacacgtgtctagtatgcttgtaggataaattcctgcaactagaattactgagttatttaaatttggtaagtattgacaagttgccctccatagaagctgtattgctcaataaacatttcatagcaattagtaatgtatgagagtgtctgctttcccacaccttcactaacaaaatgttaccaacatttttgatctaatctgaaaaaagtattttgatgtagctttaatttgcatttttctttctttatttttttgagaccgagtgtcactctgtcacctaggctggagtgcggtggcgtgatcttggctcactgcaacctccgcctcccaggctcaagcaattatcctgcctcagcctcctgagtaaactgggcttacaggcgcccaccactatgcctggctaatttttttgtatttttagtagagatgggatttcaccatgttgtccaggctggtctcgaactcctgacctcagatgatccactcgcctcggcctcccaaagtgttgggattacaggcatgaaccaccatgcctagctttaatttgcatttttcttattatgagttagattgaacatcttttcacgtaaagaattttcatcttcttttctctgaacaatgttatgtttcttatttttattcatttttatcttcccaaacccttatttacattgaaggactaaatttaaatttcttttgaaccatgataagatgcaaagcaattatgaattatcactgtatggtgaaagatatttgcatctcaagcactaagtccaagttaattgtagagttaggtttaaaatcatagtagatttagtctgatttctgccttgggttttctgttttttacctcgtgttgtgtgtttgatgatggtgagcttaattgtttttaaattattttactggactttatgtaagcagtaggtacttggtatttaaaatacccagttcctgagggttctttggtccaacagggaaagacgggctaaaagaccaaggtattaaagtgttttgggtgttacggtagacgcttatacagagtacatcggggcccaaaggacaagtatagtcctttcctcagtgttagcatgaagagacatgaaacagtttctcatgttctgagaactataagctgttggatatagttggagcatagggtcagaagagtatggcagtgaagcaataggacagggaccagattgtagcaggtcttgaatgacaggagtttgaggtatgattgaatagtacagtgtgggtatttttaaaaaattaatgcaaggtatgaaacactacaaatatacttagaaataagtgctgaaaatgctttattgctataaatacaatttgttgactatttgtaaaacataaacttatggacttgagaatcagaatatgctgataaatggcctttcttttgactgactgtgtagccttgtgcaagtcatgtgtctgtaactagagctagaaagacaaactagtttctaattcagagctatatttattgatagagaacaggaattgaaatttaagatgattgctttttttgcctttgtattatttaatgtacattagatagtagaagatacttgaaagttacttgcagtcttttcttaacaagttctttatcatttgcaggggtaattgttatctcagtacatattttagattatttttgttgaaattaatgatagtttatttgtgttgaaattaatgatgggttaggtagttgcagagaaattgcttaagaacccaccttcagtagaattacatattgtttgtacagattcagatgtaatgactgaaatcataattttcaaaagataacaaagatgttaatttacagcatctttgccccaacacttagtatttcaaagatatttcattatgatataattttgacagggtcggtcaaatggaatgacttaaaagtgattcaagattttacaacctacatagtttttttttcatagaggaataaagtaacaatgttgattcaatatattaggtgaattttcttatatacctaaaatatgtatgcttttaaaattgtttaaagagcacatccttccttttcaaatattaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtaggaaaagtatttgtatggatttaagattgaaaattgttcatgtaatgcaaatgtcataggaaacaatgtccttccacttgatttttagaatgataaaattcccagaaagtttcagaaagcctaagtttctattaaggtcaataatcttcaagctataaactatctcactcttagttactaattttattttatcttctgagatgtttatattcaatacttatctgtaaagagctttaagacacctgagaaaaacgtgctaccctgattcaaataaataagaatgtgtatcacagagtgaatcatttgcctgaagccataaacccaatagaacaatgttttctttacaaataaataagccaataatgaaaatacagataagtcatttgagtctcaccatgtttttatttactaatatcaaggacagaagtgtttgtagcttgtgataattactctttattttctgttaaaatgagtttgaagggtttgtggcttttttttgcagttttctgtatacttttaaaacttttctttacgtatttcaaactaagttattttcagataccagatttggaaataatagcatttactaacatttgaacagttattttacaaacgtaagttctgtaagtttactctttttgataagggagttttctccaaaagagtttaaggttgccattttttttccaggtcagttgcactatctaagacagttttaatatattcatactatttttcaagtggaacacattcaaaataatttatccaccaaaaaaggaagcaagagtacctataattttaggctggaagactttgaaatgctaagaaacatggttttaaaatattttctggagaaagaaaaggatttttaaggttttggtgatctttgatgtatataaatagtctatttgcctgacaactaatagacagtaataacattatagatagcattaacttaccagtagccaagaaataatagggattgggaaagtctctgtacttttatttggtcttttattatgtgaaatatgcatatatcgtactatttctttatataaaactatacttaggccaggtgaggtggctcatacctgtaatccagaactttgcaaggctaagatgggtggatcacctgaagtcaggagttcaaggccagcctggccaaaatggtgagaccccttttcttctaaaaatgtaaaaattagctaggcatggtggtggatgcctgtaatcccagctacttgggaggctgaggcaggagaatcgcttgagcctgggagatggaggttgcagtgagcctagatcacgccattgccctccagcctgggcaacaagagcaaaacttggtctcagacaaacaaacaaaaaaactatgcttaaagaaatagtaatgtttttcaaatagagaatagaacctttcttctacttttttttttttttttttttttaaagcagagtgttactccgtcacccaggctggagtgctgtggcgcgatctcagctcactgcagccttcacctctggggttcaagcgattctcctgcctcagcctcctgagtagctgggattacaggcacctgccaccacgcctgactaatttgtgtatttttagtagagatggggtttcaccatgttggcctggctggtctcgaactcctgacctcaagtgatccacctcagcctcccaaagtgctgggattacaggcatgagccaccacacctggctcttctacctttttgaagagcactttaccttctctacattaataccacaatgtgaagagttactatcctcaatgtttaacaaaactagaaatttatgacagggaactagactgaatacatccatcctcctctctgacttctctgaatcctgaatcagaatttctctctagtccaagaagaatatgagtagttattaataccattcagcaatattcctgattttcttctgctcatatggtgaaattacacttccttgccctcttacgcatcactgtgtgatgttcattgatcagtgaaatgtaagcagaagtgaagtgttagcatccaggtagaagttaataagagaaggtttatgattttcaaagtaaattcttctccttgctgcagtgaggtggtccagatggttggaggctcggtaggctgtgtccctgtttgtggtcagtggggaacagagtctctcttgtcttccctaatccctgagatgttgcatgatgcaaaaaataaatctttgttgtgttaagccattgagattatagagttgttttgacacagaattaagtgatataaatattaggcactacctagtaataatgctagaggtttatttgtatatattcattatatagtgactggatatttagaaaattgtcaagactatatttttaaatgatcacttagtgtacttcttaacctttatgtaaatagatagaactcagcttgttgtagaatatgtgttaaaaattaaggagaaagccttctaggggcaaggctgaggatagatatgttcagtccagtttttttgggagaaccacaacacagaatggctttttttttttttaagagccaggaggaaggggggccctgcaggcaatgactccatcaaccttttatatatttattcatttaatgaatatgtattaggtggcagctatatcagatgttatttgttgcataggagtttaccataacaaatattccttctgctaaaggatctgacttttattcataggttcaggaagagtgtgtatgttgtcctgggttacaatgttatatgtatttcttaaggtaggttgctgcaaaaagtatttgaaaatgcttgttttagcatgtatagtaaaagtcaatgacaaaataggacttgtaaaattaaatgatagagaaataggctgggcacggtggctcacacctgtaatcccagcactttgggaggctgaggcagtcagatcactttaggccaggagttttgagaccggcctgaccagcatggcgaaaccccatctctaccaaaatatacaaaaaaatcagctgggcatagtggcacacacctgtagtcccagccacttgggaggctggggcacgaggatcacttgaacccggaaggtggagattgcaatgagcagagatcacgctactgcacaccagcctgggcaacatagcaagactctgtctcaaaaaaaaagtaaaagagatttaaataatttttttaaactgtggcaaaatatatgtataacataaaatttgccgttttaaccatttctaagtttagggacattaagtacattcatattgttgtgcagcctttaccaccataattttttttatgtgtatttagattttttttttttttttttgagatagagtcttgctctgtcatccagattggagtgcagtggtgtgatcttggctcactgcaacctccacctcccgggttcaagcaattctcgtccctcagcctcctgagtggctgggattatgggcgcctgacgccacacctggctaatttttgtatttttagtagagacgggatttcaccatgttgactgggctggtcttgaactcctggccttaagtgatctgtccgcctcagcctcccaaactgctgggattacaggcgtgggccaaagcacctggccaaaaaataataaattttaaagtgtgtttctacttggaaggctgaaggattcttctgttttttaagagagcattaacaaagcaattattttggtattaaaaatggggaaaatttgaattttaaaaatttagacattaactactgaactatattagaaattacttttgaggtatgggtaaaatgattaatagtccattttgttagatttagtttttgtttttatatttattctaggtgattcaggtgtctggggattgaaaaaaaattttgctttattggagcttttggaacgactgcagaatgggcctattggtcagtatggagctgcagaagaatccattgggatatctggagaggtattgatcatacttggtgaaatatttgttacgagcatgaatttttcttttaatagatgccattattagcacaatattacttcatttatttcagcaggtaaatttctagaaacacaacttttcattacattacagttctgaaggccaacactattcccaagagaaaaaactagaattatttgaaaatcctatgcctaaactatgctttatgtgtgaacttttttttccttatcataattcagttctaccaagaataaagtgaaaagaggaagaagattatggaatagtaagaaagatatgtaagcaacagtagagaagaggatgcaaaagtagtcaacagtaaaactcaatgagagaaagaaaaactcgatgtaagaggccatttaatacagaggggaaaatgccttaaagatagcagtaacttctgagggaattgttactgttatagcttcaagaaaaggttaaactttgtatagatgtactgtctttatccatacaggtagatgtctagtaaatatcagaatccatgaacactggattttaataatgtaaaagtatatttttagcacttatgtgtttgcatagctgcacatatgtactataggacatggctttcgtaggctgttatgggtaaaaatatatttggagtaaatatcagttaatgattttggtgatcaacttgcaaaccacatattttgtatgaaggaaaaaaaatgtcggattgctttcacttctctttcattagatgatgatttctttatactaaagtgaatcagtgaaatgaatttcaaactgcaacactctgttttctaaaagttatgcagttctttctgtgctaaatctttaatctttatttcaaaagacattactgttagctaatgttgacattatagtttataatttatttatttgtcaggtctgggaaacagaagacctgaatttttatggtacatgtgtttatttctcataattgcaaacaaaactcttccactttggattcattttttatttaatgtgataaagaatgacaccattgatgtatttaaacatttttatttttgaaaaaatttatactaaatttctccccttccaattatggccttttaatattgagtaaaagtgttcaaaacattcttgattatctgacatgtaattttttatctacttgaaataaaagtaattatttcataattagttattttttgtaattcctgaaaactagaaataatatttacatgcttacatataggttttatttatttgtttattgttattttttaagacagagtctcactctgtcacccttgctggagtgcagtggcgtgatctcagttccctgcagcctccacttcctggcttcaagtgattctcgtgcctcagctacctgagtagctggtattagaggcatgtaccaccacacctgactaatttttggatgtttagtagagatggactttccccatgttggccaggctggtctcttactcctggcctcaagtgatcacctgcctcagccttcttaaagtgctgggattacagatgttagccactgagcctggcctatttttttttttatttgcttaaatcagtggttttctgccgtgattgtgcaatagactcacctgtggagctattaaaataacatggcgtataattagaaaaatatatacaagtctagggttcatccacaacctgttgaaataagaatttctcttccagacagctatgtttttaaaagcttacagctaattctgatgcatactcctacattttctaaatagcatttgtgcttctgtccttcctatacatcatcatgacaactaatatttaaagctatggggatgtatttaatatcagatttttgtagttttacagaaagacttttgacttctctatggtttagtttcttttgtgtaaagtgaggggatttggtggaagagatctttgcaccgaatatgaatctatgagaatagttctatttttggcttcaaattcataacatatattggccagttaatcttggaaatagcttcttacccgtagaaatgaatgcttctcagatgagtattgaatgacctttgttcttaatgaccaatatattttcatatgtaaatattgttcagttaagcaaaaaggattatggattctatatttaaaaattcgtcatgttatactgattgggttcaattttaaggcattaattttttgtttatcagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaaggtatgaatttaattattaatcagttggatcactgtagctactttaccagctcagtattcgttttcactgacctggttctttattctgaaagtagggattgaagaagagttaagtgatgagtgattgggtttggtagcatgaaaataaatgagagatttaatttctgaatgttataaaaaaaaaaaaacttcaaagaggcatcatgattcttcacaaaaaaatagctttcgagcaggaaacaaacattctgtttgcttgcatgttttcataatgcaccagattgttttgacaatatttatgtctgttagctcttacttaggatatgattttagagatagtctcttggttttttgtttagcaataaacggacttccaaattttaaattacttctttgcagtacagttttcttataaaggagtgaaagtaaattagtatttttctgtgtcataaaagtcacttgtggctgatgcttttttgtattaatagggatttaaatagttttttatattattagtcaatactatgagttcttttctctaattatggtacattttatagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtatggattttttttcttcttcactttctcattcttttttatttttcatattttcaccttctactaagtatttaatgggcaattacaatttgccagtattgcaccaatcattagaaagttttttaaaagtccctgtctttcaggaactcattcatcatggaaaagagagagtttgaaatatggtaactattttatggaggagaagtacagggtgctttggcatcacaaaacagggacaatgatttatggaggtcagagaagtccttatagaagaaatggtgtttaaactgagatttgaagaatttcagtcagggaaaagagcagaacggggaatgagttgtcccaagaagggaacaatatgttaaaatgtttgtaagtgaggattgtacatattgtagagacttaaagaagctcactgtagttagagctttaagtattgaatgggacatgacaagaaaagaggatatggagagttcaaagccaaatcatgcaggatcttgtcagccatgttaaagagttcagaacttagtttaaggacagtgatgagccattgaagaattgacttaggaatgatataatcagattttcctcaagaaaggttgttttaaatgtagaaaatgaattggaggagcaacaaaattggaagcaggcagacctattaggatgttgttaaagttttctagttaaaatactagagatgtttatggcctataatacactagggtagtgagagtggacacaagtcaatggatttgagattttaaataagtagaatagataggtcttagtgattaattgttaatattgattggataggtaacttagaggtgatgaggcatgatcagattttgggtgtattttgaagtcagcagaatttgctgagggactagtgggctatgaaagagaggtgataatgatgactccggttgtttttgcttcaacatcctgaaggatggagttgccatttaccaagacagaggcaattaggtttgggaataggggagactggagattaggcattccattttgcttgagatgtcatttataaacagttgaatttccaatgtctgtgcattaggggaaagatctagcatggagatttatattttggaatttaatatagatggtatttaaacaatgtctcgctcggtcacccaggctggcatgcagtgttgtgatcaccactcactgcagccttgacttctggggctcaatcaatcctcccgcctcagcctcctgagtagctgggactacaggcacatgccaccacggctggctaattttttccattttttgtagagacagagttttgccatgttgcctaggctgaaattttaaatatttcacaggtaaaatctttattaacattacagttgcttaaaatttattttcattttcttaggtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggtaggtagtttaaatgtggttagggacttagttgtaagtttaagtagataattaccagaggtatacattagtgtgttttattaatattttgtgtctgctgtatgcagtaactttgtgcttaggaaatggtctgcaaccttgaattatttcactagtatggaattatcagtgtcgttcacgtgcctttcccaccataagccatgggttcttgaggccttctaacttcttgccattcttcagttatgccaaatccttttactcttctttgccaagcatatatgtagttttttttttttttctgcttggagtgcatatatctctcttttctaatagtggaaatcttccttctccttcaaggtccagcttaaatatttgcctttctttgaagctttctatttgttggtctttttttgagtgcctctctaccatgtactgcctacctctgctataattcagtggttcttcactgttagagcaaacgtatgttttgtgatggttgagataccataagaaatttgttacccagtttgcagatgacttacttttttaaataaatgagattcagttattctaacacaaatgtcagctttacccatttgtgttttggatctgttttcataagtgtgaggtataagaataactattgccctaggaatttcagaaaagctgcagtctgtgttatcttcactgatatattgctaataattgtgttgatttcaaatcattgtaggctaagccttttaccattgtagagctttttctcttaaatatgtgattacacttacatgagagtggccagtctatagcctcatcagtcttgggttatcatttagtccttaccacactgaattgtaacagttgatatgtatgctatttattaagttgattttcagctccaaacctactcttctatcctctattttgtgatactagggctagaactctacagacctcataattgtgttgccagctgggcccatgttaggtactgtcaagagggggcatagttactcatgtgaggagaccacccttctcggaggtttgagtttcagctccatgagccactcctgcaagtttctaagttttaataattctaacttcttccttttattcctttagcactggaagtggtagctatgttatttcatacaattgctacctccttaatacctcagagttccttttaaccttttagctacctagttaataactacacctagttaacagtttttattttaagttctttctattcaagtaatggtgtgatttgtgtcttccgatttgaccttgaatgacacaatatgcctatgtgttttagatgctgaccttgttcatctttgatgcatcttgttcatctttgtgtcactaaattctttgcatctagatagaaagagcttaataaatacatgtttaactcatggcggataatgaagctacatagcaaaatcagagtggagtcatgtcctaaatcatatttacttgatcacttaaaagtattttcatatttattttatgaaaaagtttgttcatagttactgaaatatttaagtattttagagtttctgaagtgttgtgccaaaatgactggtatattagtccattttcacactgctttacagatactacctgagactgggtaatttataaaggaaaggggcttaatttacaggtttgcatggctggggaggcttcaggaaagttagacaatcatgggggaaggcgaaggggaagcaagcaccttgtttacaggacggcaggagagaaagagagagcaaaggagaggtgccacactttaaaaccatcagatgtcatgattaatcactatcatgagaacagcatgagggaaactgccccaataatccaatcatgtccctcccttgacatgtggggattacaattcgagatgagatttgggtgaggacacggagccaaaccatatcaactggtaatttttaatgatacagtattatctatgttaatgcaaaaaaatcaaggtcttggattcatttttcatatggacctattagttttgttctattttataactacagaatactaaccaatgttctttaaagttcccactacagagaaaattgaacagaggaatggatggaacatcacaaattgatcttcacttctgagaacataatttaatcatccatccactctaaacaaattatgcatcatctaaagttcttggcatgatactggatgctgaatatttattcatttagcaaatatgtattgagtagctaacatatgccatgtatttaaaatatatcagtgaacacaataagcaaaaagccataatcttgtgaaattagcattctagcaagaagacaggcaataaaccataaccatatctaagtaagttaattatactatatgttagaaagttctgagagctaatcaaaaaagaattctgcaactacatgtttatgtttgtacagcagattgcattaataagtagagtagtcagggtaagcattattgagggaaggtgagatttgagcaaagattcaagtaaaaagttgaaggaattcgttcaggccgtaactgggagaagaacattgtagttgaggaaatgttatagcaaaaaccctagggcagcatgcctggtatgtttgaggaacaggaaaataggcctcttgactggagtagaataagcgaaggacagagtaataggagctgaaatcagaggttaatagagaattatatgtaaggaaggccctgtgaggcattataaggacttcaatttttttttttttttttttggccgggggcgggaggagtgggttggggacagggtcttgctcccaggctagctagagtgcagtgatacagtctcgtctcactataccttctgcctcctgggctcaagtgttcctcctgcttcagcctcctgagtagcctggactacaggggcaagccaccacatccagctactttttttgtatttttcgtagagacagagtttcgccatgttgcccagactggtctaaaactcctgggctcgagtgatccatctgccttggcctcccaaagtgctgggactacaggtgtgagccaccatccttgggtggacttcaacttttactgattgggataggaccattgtagagttttgagtagaagagtgacttaatcttatatgttaaaaggatttttctggcctatgtgtctaaaatagattgaaagaaggcaaaaatggaaggaaggaattcaacagttaagcagcagttgtagaattccaggtgagaggtaatagtggcttggataatggggattagaagtgcccagattctggatgttcaaaaggatttgttaacagattgtacgtagggcatgcgggaaagagaaagcaataatgacttcagcgtttgtcctgaacaactgaaacagtggaattgctgtcagctaacatgagtatctaacagtgagcaaaaacagataatactaccgttctcatggagcttgcatattattgggagatctctttcatataaagactatgttggtatatgtatagatagtctggaataatattcaagaaactggaaagttcttgactttgaggagtggacctgtattctttattttttttaacgaatacatgtatatctgaaattaatttttaaactttttatagacatagaacatagatatagaaatgtatgcataagtattcagttggctgaattttcagactgatcattaatgtgtaactagcactcagatcaagtaccagaacattgtcagtaccccagtagttccctcatactcacttctggccactacctgcctttcccaccatgataaaccactatcttgacttctaatgtatatcttaattttggttgttttggtaattaaatgaaatcatacagtatgaattctccatgccatgtcttcttatactccacattatgtttgtgaaatttctatcatcacgtgtagctatggtttattctcactgtgatgtagtgttccatttatctatatgctacaatttatccattctttcgttgctaagtccttaaattatttattaatgctcaattattattcttgtcaaatttacatttaactttgactactataatgttaaaactgcttttattgtgagttggtaatataagtctcttttccttatttcttataaaaagtttataagaaatattgttttgcctcttataggatgattgtagagttgtcttggcaaaacaggaaattacaaggttactggaaacattgcagaaacagcagcagcagtttacagaagttgcagatcacattcagttggatgccagcatccctgtcacttttacaaaggtaatgtactgtactttatttttaggtattttttctgacaaatcataattgatttacgtttcatgataatcaccttaaagagacaaccatgaaattcatgaattaggggctttttaagaaaacttttatcagtggaaaatagaaatggtgtgctcacttcggcagcacatatactaaaattggaataagaagattagcatggcccctgtgcaaggatgacacacaaatttgtgaagtgtgccatatttttaaatttaaaaaagtaaaaataagaaaatataaatggtatatatatggtatatataatgaatcttcctgtatccatcacccacttgagcaattataaacttatttcatctccccttttacctactccttttcctacctgcaatctcccagggtattttgaagcaaatcctaatatcatattatttcatcccaatatcttatttcatctatgaaatattttagggtgtatctccaaaagataaggactctttttaaaaacataattggggccgggtgcggtggctcacacctgtaataacagcactttgggaggccgaggcgggtggatcacctgagttcaggagtttgagaccagcctgaccaacatggagaaaccccatctctactaaaagtacaaaaatttttggcatagtggtgcatgcctataatcccagctacttgggaggctgaggcaggataatcacttgaaaccaggaggcagaggttacagtgagctgagatcacgccactgcacttcagcctgggtaacaagagcaaaaccctgcctcaaaaacaaaacaaaacaaacataattgggcatggtggcataccttatagtcccagttactcaggaggctgaggtgagaggatggcttgagcccaagacttcaagaccagcctgggaaatacagtgaaattcccgtcacttaaaaaaaaaaaagccaaaatatcattattacaccaaaaaagtttaataatgaatctctaatattttcactaatattatcaacttgttagtattcaaatttctcagattgttttcaaaacaatttttttaatggttgctttattttagatacaatccaagcaaagtttcatacttgggatttggttgatatatttaaacctcttttaaagtgggttctccctgattaaaaagtgttcatgtgtaccattttgctttccatttttaggggctggtttttttttaatttaattatgttttcacaattatgtgaaatgtttatgtgatccagagtcaaatgttcaaagcaaggtttattcagagaaatctagcttttatgcctggtccttctaccctttttacttcattccccatagaaaatcatttagaattttttcttagttttagtcatcattttaaaaagtatagagacatatgtttatatatttgtatgcacaccacttggatttaaaaggtggaataccttacacactttttttttcctgctctttttacttagctgtacatcctaaacatcactctgtagcagtagaaagtgacattttttgttcctttttccagctgcaaggtacttcattgtgaggatatgccacatttatttatcgtagtaaaaaacacataataaaaaatttgctatctcaaccatttaaaaatgtacaattcagtactgttaagtatattcacattgttaaacagatatccagaaatttttcattttgtagaactgaaactctataccctttaaacagttcccctctgccccctctcatcggtccctggtaaccactattgtatttttcccttatgaatttgactagatacctcatataagtggaatcatacagtatttgcctttttgtggctggcttattccacttggcctgtcatcaaaattcatccatattgtagcatgtgaaaggattttcttccattttaaagctgaataatattccattgcatgtgtgatatggtttggctgtgtccccacccaaatctcaatttgaattgtatctcccagaattcccacgttttgggagggacccagggggaggtaattgaataatgggggccggtctgtcccatgctattcttgtgatagtgaataagtctcatgagagctaatgggcttattaggggtttctgcttttgcttcttcctcatttttctcttgccaccaccatgtaagaagtaccttttgccccctgccatgattctgaggcctccctagccatgtggaactgtaagtccaattaaacctctttttgttcccagtttcgggtatgtccttatcagcagcgtgaaaatggactaatacagtaaattggtaccagtagagtgaggcgatgctgaaaggatacccaaaaatgtgcaggcaactttggaactgggtaacaggtagagggtggaacagtttggagggctaagaagaagacaggaaagtgtgagaaagtttggaacttcctagagactcgttgaatgactttgacaaaaatactgataatgatatggatggcgaaatccaggctgaggtggtctcagagggagacgaggaactttttgggaactggaacgaaggtgactcttgttactgttttagcaaagagactggtggcatttgcctagacatttgtggaacttcaaacttgagagaggtgatttagggtatctggtggaagaaatttctaagcagcaaagcattcaagaggtgacttgggttctgttaaaggccttcagttttataagggaagcagagcgtaaaagtttgaaaaatttgcatcctgattgtgcaatggagaagaaaaacccatcttctggggaaaaattcaagctggctgcagaaatttgcataagtagcaaggaacctaatgttaatacctaagaccaaggggaaaatgtctctaggccatgtcagagaccttcatggcagcccctcccatcacaggcctggaggtccaggaggaaaaagtggtttcatgggctgggcccagggtccccatgctgtgtgcagcctggggacttgatgccctgagtcccagctgctccagctgtggctgaaaggggccaatgtagagctcgggctgtggcttcagagggtggaatccccaagccttggcagcttccatgtggtgttgagcctgtgggtgcacagaagtcaagaatagaggtttgggaacctctgcttagatttcagaagatgtatggaaacacctggaagcctaggcagaagtttgctgtaagggcagggtttggaggggcgaggggcagaatgatatgcttgagattttgggtgtgcccccacccaaatctcaacttgaattgtatctctcagaattcccatgtgttagggagggacccagggtgaggtaattgaatcatgggagctggtctttcctgtgctattcttgtgatagtgattaagtctcacgagatctgatgggtttatcaggggtttccgcttttgcttcttcctcatttttctcttgctgctgccatgtaagaagtgctttttgcctcctgtcatgattctgaggcttccccagccatgtggaactgtaagtctaattaaacctctttttcttcccagtcttgggtatgtctttatcagcagcatgaaaatggactaatacaatgtgtataccacattttgtttgttcattcatctgttgatggaaacttgggtagcttccacctcttggtttactgggaatagtgctgctgtgtacgtgagtgtacaaatatctcttcaagaccctgctttcatggtcttttggatatatacccagaagtgaagttggtagatcatatagtagttctgtttttaattttttgaggaatccccatactgttttccataatggttgcaccatattacagttccaccagtggtgcacaagggtgcagtttctccacattttcaccaacacttgttattttctgtttttggatagtagccatcctgattggtttgaaatgataccttatttgttttgatatccatatctctgatgactagtgccattaaccatcttttcatataattgttggccatctgtatattgccttgaatatgtctatttctgtccttcgctcactttttgattgggttgactatttttgttgttgaattgtaggagttctttgtatattctggatattaattccctatcagatctgtgactttcaaatattttctcccatttcataggtcaatttttcactctgttgattttgtcattttatgcacaaaaattgtaaatttgatgtagtctatttttgcttttttttttttttttttactgtgcttttcgtgtatccctgaagtcactctcaaatgcaatgtcatgaggcttttcctctgttttttcttctaggagttttatggtttggggtcttaagtttatggccattttgagttaatttttttaggtggtgtaagatacataacatccttttgcatgtagatatccagtttccccagcatcatttattgaagagactgtcttttcattgagtggtcctgcacccttgttgaagatcatgtgaccctattcctgagggtttatttctgggctctctcttctgttctgttggtttgtatgtctcatctttatgccagtaccacatagttttcattattgtagctgatatggcttggatctatgttcctgcccaaatctcatttccagttgtaatccccaatgttgaaatggggcctggttggaggtgactggatcatgggggcagtttctcatgaatggtttagtatcatcccccttggtactgtctttgccataataggtgagttctcatgagatctggtcgtttaaaagtgtgtggcacctcccccaccctctctcttgctcctgctcctgccatgtgaaatgcctcactccctctttgctttccaccatgattgtaagtttcctgaggctttccctgaagccaagctgatgccagcatcatgcttcctgtactgcctgtggaactgtgagccaattaaacttttctttataaattacccagtctcaggtatttctttatagcagtgcaaaaacagaacaatacattagctttgtaatatattttgaagtaaggaagtgtgagtcctccaacttttttctttttcaaaattgttttggctattcagggtcacttgagcttccttataaattttagcttaattttttctatctccacaaaaaacatgattgggattttgatagggattgcattgaatctatataaattacctgggctgttattcatatcttaatattttatgtctttcaatccatggacatggaatgtctatttatgtcttaatttattttagcaatatttgtagtttttagtgtacaagtctttcaccatcttggttaggtgtacgcctacatattaggttggtgcaaaagtaatagtggtttttgccattaaaagtactggcaaaagccgcagttgcttttgcaccaacatagtatcttaagtctttcaccatcttggttgagtttattcctaagtatcttaaacttttttttctgtacatgttcagagaaacttctttagtcataaactataaaaatgatccctgaaagtataattttgatgctattttaagtagaattgtttccttaatttccttttgggatttttatcattaatgtatagaaatgcaactgattttcatgttgattttatatcctgaaactttgttgactttattctaataggtctttttgtgtggactcttcagggttttctacatacaagatcatgtcatctgtgaagagatataattttacatcttcctttacaatttggatgtcttttattattcttcttgcctaattgctctgtgggcatcttcttgttctttatcttagagaaaaagctttcagttttttgagtatgatgttagctgtgggcatttcttatatggtgtatgttaactgaggcagtttcctgctactcctagtttgttgaatgtttttattatgaaagggtattgaattttgttaaatgctttttctgcaactattgagatgattacgtgctttttttctctcattctgtgtattatgctgattgatgatgaataattcttgccttccagttataaagcccatttggtcatggcgtacaatccctttaatatgtgtttttttttttttgaggcggagtttcgctcttgttgcccaggctggagtgcaatggcgcgatctcggctcactgcagtctccaccttccgggttcaagcgattcttctgcctcagcctccttgtagctgagattacaggcgtgcgccaccatgcctgggtaattttgtatttttagtagagacggggtttctctatgttggtcaggctggtctcgaactcctaacctcaggtgatccacccccaacctcggcctcccgaagtgctgggattacaggcatgagccaccacgcccggcctaatgtgttgttgaattcagtttgctagtattttgtagtttcctcctggttgcacctcatcctcactatgttggatatggggaagggcagggatgagtgcacagaatgccccaaattttattacccctttcactggaatgccttcttggttttatggcctgggtgctgtagtttcttaactgttctctagagttctcacagaagtagttctgttccatatattgttttatttctgaggtgtataactggacttaagtatagatttggagccataatatacatggtaattaaagctcatgaagagaatgaaaatatgtagaatgagaaggaggcctcatatagaccctcaagaataccaacatttaagagctggattaaagaaaaattagaaggaacatccaaaaatgggataaaaccaaaccaggaaaagtttgtatcataaaatccaagcaaagagtgctcaaaggagtaagcaaaaataacacatatattttgggaactgttgtaaggacttttatatgtattcttaaaaattaatcctttcaagaatcctatgtaaattttgtactattttaatcctccttttatgagatgaaagaagtgaagcagagaaatcatgcagctagtaatatataaaaatgttcattatagcattatttgtaatatcataaaatcagaaattacctaaaatctatcagttgggggtttagttaaattgtggtttatgaaatgtaaagaagccattaaaagaaaaaggttggtcaatatgtattgacaggattccataatatactgttgagtgaaacacattagtttcaatgtgtgggtaatacttttttaaaaaaaaatttgttttgtttgtgtatgttggccagtatgtgcatggaaagtgtctggagggatatacatcagattcatagtagaaatttctgggaattgagcagcactttttcattttaattgatttacccttattgtgatttttttagtatagcataaaaacatgtttaagatttagaggattcatttgagttagaaaatctgagaaaattaagtgggtatgtatattctgttatacaaagacaaagtcagttttactaaggcaagatttagccatggggaaggatttcatcttcttgagatcagactcagtattttgaggaatacaattcagattgcaatggttgaggaatgaataggagatgtagaaataataaaggtgctaaatgctattactttctaactgcatgtcaaacatatttaaaaatatttaaattgtaggataatcgagttcacattggaccaaaaatggaaattcgggtcgttacgttaggattggatggtgctggaaaaactactatcttgtttaagttaaaacaggatgaattcatgcagcccattccaacaattggtaagtatgaatattggtttttaccttaatagacaaaccctagcttacagccaagttcttggggtcttatttgatactgatctgtcatggtggtgggctcttttctggctctaagatatcagcatctcagagaaaaaatgcaagattgtatgactatgggattgaaatgtggatggggataaaaagaagaaacagagtattggtgggacagttggaaggaatagaggattggtgatcctggctgagggtgtggggtggggggtagttgtggaacagagctggaaggtacatggatcccaaggtcctaaggaccttggtggaggtttagagggctaggagctgttacaggtatacattcaccacgtaggagtaggaatggggttgattaggcttcagtagatattgctgcatgtagataatttgataagtcacagttataaactgggggttgtctgtgtttgatatgtcattcattgtaaatacaaatatagtataaaagtaactttttttttaaaacaggttttaacgtggaaactgtagaatataaaaatctaaaattcactatttgggatgtaggtggaaaacacaaattaagaccattgtggaaacattattacctcaatactcaaggtgagagttaaaaatgacatttaatttttcacatttttaggatgacagttttcagtgtactgatttaactagcaaagctgatacttatgattaagtcgttgactgtatacttaagtacctgtggccagtttcttaacttgtaaaaaatgaaagtagaaagattaggatatatacttttagtttattcctgatataccattattacagaataaaaaccatacgtagcttagatatgtagtcagttaagagtactcttgcttctcttaacagagaatgtatattaccagtattatatgggtgtgactgctggtagcgtagtggtatagagttgaatttatgttgtatgattctgctgaattcagttaaactcaacatttatcccattataatctcactatagccccactcccacatttctttcacaaatagttattacctgcagaagaacttacagtagcttgcttttgaccaaaccgtattatatcatatctatactctacataggttttagtcacatttgggtcttactctacacttctgcctcatagaccccaacataatgcttacgctcatgccgcttattctgtatgttattctgctttccaccaagatgagagactgaataattatttttactttgggatttttgatattattatgagccataattaatagaaaaaatgtatttttttttttgagacagaatcttgctttgttgcccaggcaggagtacagtggcatgattgcatttcatggtcacctctgtctcctgggctcaagcaatcttcccaccttaacttcccaagtagctaggactaggtatatgccaccacattcagctaatttttttttttttttttttttgagatcgagtcttgctctgtcgcccaggatggagtgcagtggtgcgatctcggctcactgcaagctccgcctcccaggttcacgccattctcctgcctcagcctcctgagtagctgggactacaggtgcccaccaccatgcctggctaatttttttgtatttttagtagagacggggtttcaccatgttagccaggatggtctccatctcctgacctcgtgatccgcccgtcttggcctcccaaagtgctgggattagaggcacgagccaccgcgcccggccacattcagctaatttttaatttttttttaatagagataaggtctcactatattgcccaggggtctcgaactcctgggctcaagtgatcctctcacctcagcctcccaaagtgctgggattataggtgtgagccactgtgccctacaaaaatgaaattttgaatatgaggaatggttgaaagtctggagatagttaacttagacataatactttggagaaataaaaatggtgatggtttttatcttttagtcttttattcaaagactaaatattagaaaagtagtattcgaagaacaagtagcatccataggtagaggatcatgaggcatattttgaaattcgttatgtaaaaagttatttgatatacagaccaatttgcatttgatagagcaagtgttgtaaatcctttcctagatggggaaactaaacctgagaagttatgtaaactacttgaaatcatactgttaattatttgtaggtgcccctgccatactaggcaccctctgtgtgaaaataatgatggtagacaaactctaaccataacataataatgatatcattaaatatttggttcatttactgaactttagcaagtgactatttttgttttttttattttttttggggtagctgttgtgtttgttgtagatagcagtcatagagacagaattagtgaagcacacagcgaacttgcaaagttgttaacggaaaaagaactccgagatgctctgctcctgatttttgctaacaaacaggtaatgcatttttatattggaatatttattttagtagttttgtgcatgtcaaaaggcaactggaaatatttcagaagacaatcagttcaatagatatttatagtttcttctgtgtattttgagtacaatctatgtgaaaatgctgtgctgggtacctgggagtatacaaaatagaaataaggtagttaatgctcaccagaaactcctgtgtatgcatatgaacacataagagatctgaatacgaagaagactgataagtaacttaagtaacacagtgttacgggaattaggaaagtagttctaaatgtggcatgttgtaagattgtaaaatgtagaatttgagttgaaattatgcatgaggctgagtcagtatgtgaaaggaagaacattatagacaaagaagataatagcatgaatgtttttagtttagggaacatcaagcagatctatatgtcaggtctcagtagaggatgaagagaatttagaataacagacaaggccatgctgtaaaggtctgacagtgctagactgagaaatttaggttttattctatgagcaaggaggagtcatcaaaatgttggattagtgggtaataagatcatatcagtgtttcaatactataattctaggggtagaatgaatcagggcaaaggactggagacagggagatgcagtaaattgcttaaataattcaagtgagcattaacaagagtctgaattagaggaatagaaaggcggaggcagatggaaaagactttgaggcagaactggtgactgaatggggaggatgaaggactgggagtagctgaagattcctagaccttgagcctttctaggaggatgagatgcttttaagtagaggcagaaggagagtagaagtggagcagaggagatgtcatgggaggggaagagtaggatgaagaataaagaattttccccttaataaaaaaggcaaactattaagaactggtatatttaagacatgcaaataagtcagtgaaataccattttctgctcatcagatagttaaagatgaaagtgttttataatcctcagacttatatacaactgttactattattattttgagactgagtcttgctctgtcaccaggctggagtgcagtggcacaacctctgctcactgcaacctccccctcctaggttcaagcgattcttctgcctcagcctcccaagtagctgggattacaggtgcttgctaccacacccggctaacttttgtatttttagtagattcagggtttcatcatgttggtcaggctggtctcaaactcctgacctcaagtgatctgcccgcctcatcctcccaaagtgctgggattacaggtgtgagtcactgcgcctggtcaacactgttcgtgggttattaaactgagacattttcttggaggacaatttggcaatactcatcaaagtcccttaccctgcaattctacctttatatatctggtagacagatatccaaaggttatcctacagataattttgcaaatatacataaatgtatgtcaacttttgtgtatgtatgtttatgtatgtatgtgtatatatatggatttataatagcacataagcataaaacttcaatctgaacattcagtataggactggttaaattatgttgcagccacacaatggaagggaattctgatattaaaaataatgcagaccatctgtgctgataatggaaagatactcatcttcaacatgtttacgtaaaaaacaaacagaaaaccctgcaagttatagaaagtctaaactatgttcctgtttgtgtctctttgcatgagtgtgcatggaaattttctggaaaaatatgttgtaactggtggttgctcctgggaagttggggcaatgggtgttcagagtgggaatgtagtgaactcttcaatatataaccctatatataaaccatttattaaggtttctatgtgttaattttttttttttaagttgatgccttacacttaggcaggccaggcgtggtggctcatgcctgcaatccttgcattttgggaggctgaggttggtggatcacttgaggtcaggagttcgagaccagcctgactaacatggtgaaacctcatctctactaaaaatacaaaaaaattagccgggcatggtagcacatgcctgtaatcccagctacttgggaggccaaagcaggagaatcgcttgaaccaggaggcagaagttgcagtgagccaagatcatgtcactgcactccagtctgggtgacagagtgagactctgtcttaaaagataaaaaaattacttaggcagtatgtttccttttaggttgcaaggactttattgatttcattgttaagctagccttacaaagtatatacatacacacacatataaattagttaaaccaaactaattttttctattcttattaatctcagactaattactgaaagatgaatctaggttttttgtttaggcttctgttagaacactgtcaacaaatttctctataaatggtgataattagaaaaattataatttggatggactgataaaaaatatgtgtatatatctttcaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacaattgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcatttttaagaagtcccatcattattcttgaaagtctctttcttgaaccatctacctaatattattgctagttgtaaccaatttaagaagtcattatttgtgctgtggttaggagagaaaataaaacaaaatgggtatgggttggcatgcctgtcaaatttgagatgtagtttatttgatacagcaaaattttagaaataacgttttgaatttgcaacataggccacatttactgatgagaacagatactaaacttgatcttaactacacctgatcttagccaaaaggccgagaagtaatgtgcaggccacatttaaataagtaatataaccatagtgttttgaaggcggagctaaagttttacattgaacgaagtgaaactttgttactgccttttaaattttaaatgtaaacttgtttcataagaaaacatagtattttaaatgaccattttagaaaatggcttgcaaaacttagtggtagctcatgaactaatactgctaagagaaaggctttttatgtaacactgggatacttctcaattggcaaagtgctaacaaagaagaagacagctgtattcttccctaaaagaataaaggatgaaaaggactaatgaataaggatgaaattatatcctgataacttaaaacatgcttttaaaaagacatgggcaatgtatgtttttaggtctgccgattaagtttttgatattaatcgaaaaattcattagtcaaatatggttttcactcaaagcaaaataattgtatttgttggggaatgaggcatcatcaccacttggtggcaatattaccaaaaatttagattaaatttttaggaatgaataaagctaggtaggtaagactaaacaactaaaattagaaacagtaaatgtcacattgaaaagtcattttcatgtctaactttaagttctacttttaaaaaggagcatacattacaggagcacaatctggcataatctcctatctatctcacaactttgtagcacgaaataaataaagaatcctgctgatcaatagaaggaaaagtttaagccgatttaaaacttaagaatataaattccctacacaggtctgttgagaatgttcttcctgtaagtttctgaaagaaagagtctttctttctggaaacgaagcagtgagtcttaatagttatgaagttagttataagtgtaagtgaagaagatcaatataagaatttgtgctcatattgttttactgctccaatttctactaatctctccattgttagataccaaaatttttatgtatacttcttaatggtatattttctaaagatatactataacttgaggacagaaaaaattgtttacctatgttagaaaaataatctgaaaatcaacctgcatataataaactaaggactcaggtattcacttattctgaatctttcatttgaaagaatatttcataattattaaggaatataacactttgaccaaagtaacttcctgtttattgaggctttactcaccac

SEQ ID NO: 17504 - DNA, 276237 bp, Human
  misc_feature (1)...(276237): n = A,T,C or G
ccttagtgtatctggatttcaacgcagatactcaggctctggtttcactgaagaatgatgcacgtgagtcctcagtctctaaagcaaggggccagcctcagctgcttttccatcctgagagtggatggtggtaccatctatattagctccttgtctgattctgcacatcacaaagggctggagagcccctgagactgccatccctgctctggccatctttgcatgaaagagtaaagagtttttggaaaatgggtgagttaaaaatatacgaaaagggagagctacaagcagaagcattaacccagggcaccctctcacctgcagtgactccgccttctcaagaaaatgtccaaatgttttcatttcattccttgacctggctgggactccgctctttagggagtcatctgagcctttaagcctccttgattaaaagtgtgagtcattctaaaagacttagagaactttcaacgatgatacacatcaatgggaatgtgttcaataagatttatttcctctcaacaccttgctgggttgggtttacttcaggaattaacagaactgttgtgggtttgttttgtgttgtgtttggagagagggtagacagcagtgggaaggggacgtaactgagaagcatgaaacaccttgagtggaccatgagacctgcttagagttaggggaaagcttgagaggttcaaggatagaagaactcagggtggttcaggtgtgacatgggttatgtgggcatttctggattgctctgggaaggtaaacaatcattataatattgttaccctggtaaaatgcaacttgaaatccaaataactaacttgcaaagcaacttttgaaatacaacccattccaactgaattcttaaatggggggcttcttatatgggaactcaggaagaaagagagatccccaggcagcatttggtgtggcactgggaaaacaaagataggtcaaaagcttaaagcatagaatgagttagagctggaagaacatttgtccctggggtctgaggcaggcatgacctgttgaaaaccccaggccagcagagacacctgtccagggctcgatagaaaacatttcttgcatttaaggacaggaggtttaagccactcgggctacgttgactcttcattctagaatcttgggacagcgtattcccttttaactcctggggagcccagggccttggtctgagtttagcttcctccagggaacccgggtggaaaggagagacaggtaagaactccgcagaggcagcgaagcctgggtttgaggaagcagagggaggagacctggatcagttacaaatgagttgttaagacccagggacaattctacgggctgggtatgaaagggaagtcggctcaggaggaccgagtgagggcaccgaggcgggacgcacgcacccggcgaaggtgcagtgtgggcgcccacggagtgggggagctgggaagaaagggggctgcggtgggctggagagaagcgggacggggaaggcgctcgggaagctgtccccgcggcgtcgtgcgctctggggacagaggaggggaggtctgggcgggcgggtggcgtgtgaccgccgaggctgcggcggctggaacaggtgagcggccgctgggttgtgggtccccgcccttcaccgccagcgtgcctcctcccacggactctctccagcgctgagctgctccgcggctccccttgctttggggttttgcaactggctgctggcttttttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgnnnnnnnnnnnnnnnnnnnncctccccccggccacccttccccacttttccccccttttccaatcacatggcattttaagaatgccggaaagatggcggtagcggcgtcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaaggtaaggggttaacagcgcgcgggccgcgccgggcgcgcacacacctgctcggcttcccacccgcacgctcacactcacactcactcggccacatgcggacacaccccagggggccgggtgtgtgtgtgttgggggggggggaagggtggcgcagggggtggcagcatagagttttgtcaacttttacccaccctgggggcaatttgtctccagcccgcagtctttccaggctttaatccaggaggggtgtatggaaaagcgaggctagcagggtttcccagccggattgcctgcttagtatacgttgtttcatttttatctgcggataatcctggtagagtgtagggactgggatatggaattgagaatgaagggtgaacttagaatattcctacatccaacgttgccaagcagggctactgcgtaattgcaactcatagttttccgctttggcaaaatttcccactccaaagcctgggcagcccagcagaagagggttgactcataaaggggtgagagagaggtggcaatattgtgaatgctaaaactccgactatccttctggacgttccccctgcaaatgggggactagggttatgcctggagagttatgtcaggggccggggaatatgttgcagttttgggaaaaattcgctctccctgccgggcatctggccggtcagtctggattccaggttcctctgggttgagagctggtgaagtgatttttctgtctgcgttttctggagccctttctgagtggtgtggaaacaactttgcatttgtaaacagtttcccctgcgtgcgaagagcctagaaactactctctctcttgagatctgatgtccccagtcccctcattgttgaatgtgaatagaataggaaccaccgttttgcactgttcatggctatgttgagttatgtgggggagaagggcatatggtagtaaactgaattctcctgtctgcctacagctgcatttctcacttgtttctcttctctttagtgctgtgtacatacctctgtcagcactaataacgtgtaattattttatctatttactcagcctagcctagctgtagattgcggtatctggagtcttttatttagtggtgagtctctcttgagcttagttgctccatgacatgcatgctgagtaaatgaataaatgagcccgtagctattgaaatagactgtttcagctgagaccttgtaatatggtgattgatttaagccctaaactaaggacttaagtcaatttcctgcttaccgagtcgtggcactagtgtgtgaaactgagaaagtttaaagtaagggtgccagcatcactagtgtgtgacagctgatgcaactccctggtatgtcacggtccacctcctggcccacaatgcagagaaatcctcccccaccaaccttgtttgtctagaggatttgcgatgtcttcatagtcaattgccaccctggacccagaaagtggaaagctgtttgctttggcttgatgattaacataacagaaaaaaagtttgcttgactcaagtgtgtgttggtttgtgtgacaaggggcaggtgggatctggggcaagtgttatttggactataaactgttgggcacctgctcggtttgcaatacttactgtaaatactggaggaggggttggggtggggcggaaggcgggtcattttattttaggtaccatactttataatgtcccttcttttcttcctcttttaatgaataatgacttggcaaagaggtaaaaaatatctctcacccaaaaagaggaagaaatttctctgcaattgaaaataaacttagagaaagaaaaaaaatcaagcagttatgtgactttcttgaaacagaaactgaaaagtgagttttgtaaaaacctctaatatgacattcttagaacactttgtggtttgtcacaggcaggacctctggagaaaccctgtgggtctctgagatatgaacctttttggctcagtgtagcagccttatcctcagcccaagtttttcaaaatcagctgctaatgagagaagcggaggccctgctcaaaacagcgtctcttattctgagccaaagtgttcattctcaatgcaatggtagtcatcaaataccatcaagtcaaatatcacaatcctctcttttgtagcttagtctaatacagggattcccatttgagggggcttattaggatcacctcaagggctttttaagaagacatacctacttcttcgtattctgaaatgcagtgtggattccagagtttctacataggagaggctttgaaaatgtaatctggttgtatggcagggcaaagggagatgttttaaaggtacatttatatagcaagtgcacccttttttttaaaaaaacctagattcctttttgtttgtttattgggggagtaaatggagattagtttagtactccaaccaccgcctgtatgcaccccaccgcatgacatgcgccccctggtggagagttactacctctacaagtggaacaccctgtaaagtgaaaccctggaaaagtttcaatgcctgcattctaggcatagattccgccacagaattaacataacctccctgagtctcagtgtcttcatccgcgagatgggaataaggaaatctgctggacctgcttactttacagggctgctgtatggaagaacacaatgagaatgaaaggcgtatatcaaatatccgctggaagtagttagttttacaattcaaatgaaatgaacatgaaactatcccttctcaaggacagttctatctttttcctttactggagtttatatttctcatttttataacactttttttgtactatggtgtaatgctgggagaccattcctgtgagaccagaggagttaaacagaacctggagaaagagaatcataacaatagctaacatttattgagcacttaatatgtgccaggctttacctgttacacttaacagtaactgaggccagtactgttgttattattcattttcctgatgaggaaattaaagcttacagacattaagttttttgcataaagtaacatagtggccggtacggtagctcacgcctataatcccagcactttgggaagctgaggtgggcagatcacaaggtcaggagttcaagaccagcctggtcaacatggtgaaaccctgtcttgactaaaaatacaaaaattagccaggcatcgtgccccatgcctgtaacctcagctactggggaggctgaggcaggagaatctcttgaatccagaaggtgtaggtggcagtgagctgagattgtgccattgcactccagcctgggcgatagagcaagactccatctcaaaaaaaataaaaaaataaaaaatataaatataaataatgtaacatagccaggagcattccaaatctatctgatatgaaagcttatacttttaacctctaggcaatactgatgctctgagtttccacttggaactgtgtacttgaactggttggagttattgggttcaaagcattcttctgccccactcctgaagtgctggggacaaatcagcaggaaacagcaattgtgtgggccactcaaaagggagggacgggaaggaggagtgagtcttaaaaacctaatgcactaaatgtctgctgtcaaaacgaagctgctgtaacatggcccagccctaccatggttaaacacatggccagcaaggagactaaatgtaatccaaacttatatcgtgaataaactctgccagttaagccggtgtttagacaattttcattaaagttaagatcaggaatcttcacatcacaagctcatttctcattttaaggagtaggggcagggactgcgcatccagccatgcaggtattggacctgtaattccagcaacagcattcacatagaccatagtgtcaatcgcaccctctggagctgggcacagtgcacctgcacaaacgtccttggcagctccaggtcaggggggacagaggagttttttgctcttggattgatagtaaaatagtaatttgaaataggtcgacttttttgtaactgaagctacaaggaaattaatttatccataactttgttgagatcaaggagtcagaaatcttctggaagactcatgttggagtatggaggtggagtgcactgaataatcctttgatcccaaaggtctcctatggaactgaactggaaacagtggaaactcaaagaagaaagtcaaggacagttgttgacattaaccctgtccgttagagcttccccttcagcagtgctcccctggaatgtttgcctgagatggtctggaacctcgctgtcacaatcactttctccaagggtggaagtgggaatgatcgaggaggaagatgggagcaagggaggggcagtgattttctggaataaaatatcaggattggaagaaaatttgaattttaaggaatcttattttatttaggatgtacagattcttgaagaatacccaataccctgggattcaagtcttgaaacctaggtttttatcttctactagtttcacttttacaagaaatttcatctttttagggcttagttttctttactggaaagcatagggagctgggttaagccatctctaaccttattctgtcttaaatcctataaactcagacccagtgcacatcactaataacaaaattttaacaccccttttattattgtaaagtgaatttcacaaataacatagcctaactctactttaagtttaaacatcaatagaacgccctagtagtaatataaaggagaaataaaataaattgttaaaacaaaaaccatgtttcaatagataaatgcatggacacaactacatcagaggtcataatgaaagagttagatgctcgcacctttatgttaaatcactaccaatgcacggctgcacatgaagatgagtagggctgtgtggcatcatttacatttaggagctagacaagcctttcactgtgaaggactaccccaggtgttccaggatctccaggttccctggcttccttcactaaatgccagcagtgtgacaccccttctgcacttcgttgctaaaaagccttcataaatttctgaactgccattctggagggaggtgtggacccccccaccttcttgagaactggtgtcctgtaagaatgctaattctgcctcgtcactttgtagtgcctaaccttttgcaaactctttttcgaatgtaataatagctaacacatgcaaaacattgtgccacatgctgttttaagcactttacacggattaactccctggatcccaatgctattcgtatccctattttacagacaagaaaactgaggcacagagtttaagtcacttgccaaaaacacaccgtgaataagtgctgagtcttagattcaagcacaggccttatagcttttaatgctcataaatggccctaggagataagtagataagggatgcttatccccaatttgttgattaggaaagtgaagctccaaaggttggaatgatttgtcagcattggtcttctgttttcttttctggtgtactagttttctattgctgctataacaaattactagaaaccctagtaaattaaaacaacacacatttattacagtttttaaagtccgaagtctgacacaggtctcactgaactaacattatcaacaaagttttattcctttctggatgtctaggggagaaccttttttttttaatttttatttttaaatcttttccagaagctgctagagaccacccacatgccttggcttttggtcccattccattttgaaagcctgcaatggcggtctaattccttctcacatcaaatcattccagtctcttttctgcttccctttcatttttaaggacccttgtgattactttggtcactaagaaacacaccaggataattctccatttaaatgtcatctcattagcaaccttaattccatcttcaaccctaattcccctttgccacgtaagttaacatattcacacgatctggagaagaccaggacgtgggtgtgtttggaggagagggtgggcattcttctgcctaccaaatctagtttgctgaagttgtaatggtaagaaatgtcctgggtagtcattagatgatgaaccgcacctttataaataatcgcttcctctctcattgcaagagagtttctcatcgatttatatatttgctcttttaacaactaatttattgagtgtcttttatgtactatactctactagaacattgccctaaagaagcaacattctattgacagatacagataagtaccatgcagatacctacaagagggaggaaaaatggctacattatgggcattatgagatgctgtggtagcccatgggaagggtatctggtctgctcttggacagggcattatagaaggcaaatgccttcaggtagcctaagaaagagtctgggcctcatgtgtagctcagtgtggctaagagggcagaatgtgaccttcagactactgagggggaagagtggggaaaaaaaagtaaggaattgaggaccatgccttgggggggcgtattacagaattaatttcagattgagggtaaagttttaagcagggaaatgtcatgctcagttttgcatttaaggtagatcaccctctagagtaacatgaggttggtaaggctctagtaaaatggaagtgccagagagtaggtgacttcctactctccaaacaggtgctggaaatcagatgatctaacacctcatcaggcccatcctgctgtatactacacaaactgaagacactgtgggtggacaaaaggaagttaaagcggtataaggcatggcttctgatttcagggagcttcaagtaattgaggaggtagggtatttgaggctgattatgaagtacttgagccggtgattagcaatacaagttagcctttagcacagtgcctggaacatattaggctgttaaaatgtgttagaaaggaaaaaatgctaaagggtggatgaatggatgggtggaaggaaagaggaaggaataaagggagggagaaagggaaggagggaaggaaggaaaggaaaggggaagagagaaagaaaagaaggaggaaagggagagaaagaattggaagattagttgcccgttttatgactcacatcatccaccactcatactactggactgtggtggtaaacattagacatggtataatgaaagctataccttgttctgtacaggaataaagaatgactttatagacctaggaaacatttaatttaagccagtctttaaagatggttgacgaaagaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagccagacatgattacaaaaggtataggtagtgtaattatccttttaatgttatacaggtattcataaccacctttcttttgaccccctatggctcagggacctacaagtctgaatatgtaagaacgctttctacctgaggagatgaaaactgtctgcttagatattttaattgcttcttttttaagcatatgtagcaatgtgagaattcagaccattttccttccgtgaagctggtcagaacagcccttcagttccttatttctgctgtggttgggaaatgctcttcatgttcagtggtgcattttagcagtcaccccatggagtgtgtattaaaaataactcactccacatggctccatatttgtgaaaagcttctagctgaatctaccagtggtctgtttggtgaaggaaaattattctgtggtagctactggcctactaagcgttccatttcaaatgatgcacttcaaagctgttaatgttttctaaaagccagaagttcccctgcatttataccaagtgttttatataccaaacctcattacccacttcactggccttgacctataatgatgcttgcctttagctctggcctgcagagttaagacttaagacaaaaatatataatacccaccacaaaatcaatgccctaacagactcatgcaagtgagcgccactctcaaacagggaaagacaagatggaaaagcttatgattaatagtgattatgttggaaattaaaatgatgacccatactttttagctcagtacttttttataaacgactacatctacctgtggtttgaagcatcattctttgcatgttggtgagtgtggaaagatatatctaaactgactggttggtgagtatcactgcatttgacatatcctatttatttgcattgctgttcaaactgccattgtttcttcctgtcacagttttttttttgttgttttttgtttttttctcttctcaaagcaggttagtgcagtggtttagaggatgggtgttagatttactccgtctgggcttcaattcctattccatttatttctaactgtgtgcaaattacttaactacaactctcaatttcttaatcagtaaattaactttcctctttgtaggtttgttctgaggagtaaagggactaagtatgtaaaacagttaactcattgcccggaatttggtaagtcctaaattatataatatgtcacatttcatgcttagctaagtattatttcccaataattacttcccaataatacttagagttcaataatacaatagcattcaattgtatcagttacaggctttaatcatatgttatataaagttgtttaggggtacaaggaacaatttgtgatttgccatatagggaatggaacagtgtaacgaatgaccaaggcgaggttgtttgctttgtgaggtgagagttatgattccacacgggtgtatttccttgatgatttttaagcagcatcagatgttttccatcaaccagaccacagtgtaggctgctgtgggttttggtgggcaaatatgaaatctgtattaaaatgctggttgtgcagaaacatgcaggaaactgttttgtaaagggaaagccaatacataaagatttaacctacacagcaaacttcaaacttctttgaaagtttgaattttcaattacttcaatcttccagtaattatggaaatgtggaaatattattaaccgaaaaaagtcaaaatgtttcttttattgactgttaatttataaaacttctttctataagtttacataaatgtaataacataattgttattaagccaacactatactttagttttttattctctatttagtcctgtgcttcgtgaaatcccagaggccatcccgtggaagatatatcatggtttattcatctttaagaaagaaaaaactgtcttcaatggggagtctaataagatagttgcttaaagttgggacaccaaagggttatctcttcaatgcagggaaaaatgagaaatagacccatcactcagaaagggaacttgcaacaaaggaacttgcaggtctcgaatttggtcctagtagaaggaaggacaaatgtcttccctgagattttgattttacaatgtcattgtgaatttttttaaaaaagtttagatagataatttaatttaaagtggtctcaggtggggaggcccccggacaaacgataggagcagctgtgaatactctttggaagaactctatgtccatccaagtctccagggattttaagatggcagcaattttcaaggacattctcaaaatcagagatgataaaatatgaaaaaatcggacagtttgaattgattaaatacagtgcataatagtcatacaatattgttaaaatcatgaattttgacaatatttgttaggtgagatcttattgatagattgaagcaaaattttcattccattacaggaatgaaattaaactcctttccttctaaaatagaacagtctggaggagagacaggtgtagagtaataaattacatatatataagttacaaatagattttataaaacaataataaattataaaggagtgaatgttgccacagaacttacagaatgaccagagaagccattacggatatctgaaattgaatggaatgtttcacagaagaggtgacttatgtagtagagttacattagcaaagtgaaacttaaaatataggtaattatttggttctttgaggccttgcatttcaaatactttcatctgaaacattctttcatctgcaatgaaaatcaaggttaatgatattttcttgcttgcttgtaatattcctatattttcctctgttctctgcttcatttttagaatttttctaaatcaaaataacatatgattacagcatttctttgcatacctttctccacaccctcttctgccaaggatattagactatatatttcccagaatacaaaacttagagtattaaaatgtatattcaaatattaaaacatatattctaatattttaaactctattcatactagaatatattttaatattctaagtaatatgcttatactgctttttcttgatatatcaattctaggcattattagctaaatcaggctatgtttacaaaattatgaccatgacagtatcattccattttttagccaagtaatatctatgattagatttcttagagttattaaccacttctgtttttcctgtttgcttagtttttttgtacttatcccaatttttttctttcgaatacaacaatagatttattaaatttccagcagtaattttactttttcaatgctgatgcatatcaaacaatccacccattctgtataatttttttcctggagcgctgctactctggactggtcccatctaggtctgatgcatgaccatcctccttgggctgtccttgactttctcctgggtctgttttcctggatccattgttactttttctctgaatttactccctagtttcactggagcacatttttcagtagcttcctgagaaagacgcttggtaggtaaatatctgaaaatgtctttaatctctcactggatggataatttgaatatgatatcctaaattagctgttgctttccttcagcactttccagagttactggtgagaaattgtatggcattttcattctcttttaataaccttttattaaatcactaattgtctaggttatataaagttggcgtggggcttttgttaatcaatttgctaagcatgtgataggtactaataagctaaagccatgactcttaacctatgtttggaggttcccctgggtacatagggtgccccaaggaacttgccaggatgccagggaatgttttacaatttcaaggaagatgtagtaacatcttttggacaccagataaatcataacttgagtttcaacataagattgctacattccttcaataatgtgatatcttttaagtgagttttctgcagtagctgtgatttttcaaaaagtcatgaaaattagtatggaacaggaaatgagagtggtaatatctattatagtataatttcaagttttgaaaagttgcataatgcccagtaggtgtcaagtttttaggacataaatacttactgttgtttgggcctcattacttaataaatagatttgttaggtatttctttggtccccaagtgtgtcatgaaaaaatcactaagtcactaaggacaccgtttacccagaaaattgggacctctgaactgaagactcttacactatctgcatgcggaaatcctattaactgaacattggactctccccatattgacccactaataaactgatttttgttgctatttctccacttttccttcatttttattcatttttttttcattctggagaactagatttttatgtacaactcttgtattgatttttcattccatctatcatatctctaagttcccaaaccattttcttgttctttgattgttccttttttatatagcatcctcttgttgttttgtagacacattatctttgcttgtctgtctgagcatattataatagttttttgaagactattttgcaccagtattgactcagatgtctccaagttcctttttctctactttgtttttgagtgtgctatgcatatctgataatttcatctattttgagatttgttccatctttgtgtaccccaagagacagaatctgaaatgaggatctaagtgcaagaagtttatttgggatgtaattctagaaaacactggcagtaaagtgcagacatgagacagtgaagggaatgaaccaataaaggccgtactgttagttgctcagtccctctagagctcagcatgtcccaattgaaagtgagtgagaaagccggtaaaatggatttaccaactctccagccatctttgcgttaagggttgcttctgggacattaactccctggtcagcatctctatgagggctgtgtgtactcccaacaaaaagatgccttcagggagagaactgaaggtattttctgtaagcaacctgcagcctgtggagttgaatgcagaggagacataatatactaacattaggcttcatcataatcacattccttattctaaaagagttcagaagaaatcatggtggaaggtgtattgcacgcagccctagacacattttcatctcaaatcttttataaaaagctggttcagacacaatcaagattgaatatattatccttgggaagacttgcaagacaatattttgggccacctataccagatttttaaaaacttcttggaatgcatggctagcagagtgtttgtgaaatccagccgattgctgattgcacagttcctgtgagtagattatgtacaagttagattcattgaactaaaaagggatattgtgtacatcaaggtttctcaacttcagagatagtgacattttggttcagatagttcttcattgtggaggctgtcctttgtattataggatgtttagcagcatctctagcctctactcacttggtgcaagtagcattatcttcttctagttgtattaaaccaaagtgtcttcagacattgacaagtgttttctggagggcaaaaagtccccagttgagaggcactggtgtacagcctacagctctggttctcatgcttgaccacatattatggtcacttgggaagcttttaaagccctcatgattggatccttccccaagaggtcctgattttattagtctggggccttagaaggtttaaaagttccccaggtggttctaatctacaatcaaggctggtcattaactgtagggcagcaaattgctgagtgtaagacaatcagatatggtgaggcctgtgttaaactgggcatcttgttgccatatagaagagatcttctcttcttacggatttatttctcttttttcgtgctttgtagcaaacataagacatttttagcacacctctcttttaatagtactattcttgtgtggcaagtactattcttgtgtgacaagagaactactgagccacagagtgacgatcaaaagctaggcgtggaataaaggtgtacaaaccagctttgtgaccttgtgcaatcactgcacctgcctggcctcaactttctcattgataacataagaatagcaatgatgctttctttatagggctgaggtgatgattaagagttaatacagaacttagtacagtatctggcgcatagaggtcagcatgtgttgactcttattacgaactgtttgtcttcctccacttgagtgtatgctcctaagagatcaggtcttatccatcttaaaacttcagtgaactgagcaaaattaacccattctctgtttgtcattagccatggccttcacatagaaggatttggacaacaaaaaaaataaaaaaaaaaaaaaaggagaaacaagttgctttggttaatgatatttactggctgtaaaataatgtgcattagtttgggtcaacaactactcaaaaatgttgccaggccatgggcttttgttatgtcaactcctgattgaatatcaacccctgaataacaaagtcatatgtgctgtcccgatccttacttctaaagtagaaaaataaaattttgaaatggatttactgcttttcaaatattataaacacttcacaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaatcgtatattccttgaaaatggccataggcctgggagaactatctgaaagaaactttttaaagaaggaatcttagaaaatggtttgtaaaattccattctcagctactgtatttttaaaaaatgtatacctctttatatattaatatttgtgtgcatataatgtaaaacatgcacacaaaatatactttgggaaggttgaaactttttcttttataggtgtacagaaagagcatacatataaaacacacataatactatatgacagctttgccacgtgagtgttcaaatagaaatgctatacacatagaccgagggaagaatcctgagacttaggaatgggaaggaatgctctcttgcagagccagggcggaaagtggatgcaaaataattcattcctgtctgcccctgcctattttcatgctgtgtgaaaacagcatgctttccctaaaagaagctttaatataagtctcctcatcagcactttcccaccagttcggattagttagactctcaggagcacgtcccaggcactgggaacctcccacttcaaatgtgctttctttcagtttttaactccagacctgtgttgttgatttatggctctcctctccaggctttctacttttgcattttttaatctctattttttggattgactgtgtcaccccaaaattcataggttgaagtcctaactgccagtacctcacatgcgatcttatttcgagatagggtctttatagaagtaatcaagtgtattagtccactctcgcactgctataaacaaatacctgaaactgggtaatttataaagaaaagaggtttaattggctcatgattctgcaggctgtacaggaatcctggctggagatgccttgggaaactcacaattatggcagaaggagaaggggaaacaggcatgtcttaccacggtggcaggagagagagctaagggggaggtgctacacactttgaaatgacctcttgaaaactcactcactatcatgagaacagcaaggggaaatctacccccattatccagtcacttcccaccaggaccctagtccaacctgggggattacaaattgacatgagatttaggcggcgacacagattcaaactatgtcatcaagttaaagtgaggtcattagggtgggccctaatccagtaagactggtggctttataaaaaagggggaaatttggaaacattcatgcacatagggaggggccatatgaacatgaaggcagggatggggatgatgcatctacaagccaaggaacaccaaggattgccaacaaacaccagaaactaggagcaaggcacagaagagtctccctcacagtcttcagaaggaaccaaacctgctgacacctggatcttgaacttttagccttcagaactgcgagacaatgaactcctgttgtctaagccatccagttggtggtactttgttatagcaggcctaggaaaccaacacccactgtaggaggatttagaataaatttcattagaagttaatagggagtgtatgaaatgagtaaatagtaactaaattctagcattctagatattttttctctttgtcaaatatctaatgacaccacctgtctttactaagtgttcagatgaattcttgatcacctctaggtgtgtggtcaggacagagagagctgggcaatggcgaaggttgttcagattaatttgtgtttattaaataggtgggaccaggtcccctggtacatacagcaccactaaattttgctctcatgcatgccagccttgctatgtgtacagttaccagagagcaacttctccattttctttttgttttgttttttgtttttttttttaacttctccacttgctaaaagagtcaaaatctgatacctatgcaactgaactaattaatagatttgctaaaatctttacacgtatcattgctgaataaaatagttatttgatacaaataaattttaaatgtataagtatttcccaaatattgcatgggacatacttatgatgaaaaatatttgtcattcatctgaaagttaaattcaactgcgtttttctttgctgaatctggcaattttatttatgtgactttcaaaattatagcctttcagccagtctgagactctggtttgcagcaaaccaggagtcactagagatagactgaccagaaagtagatggttttaaaatggtttgtaaagataatggtaaaccaagaagctcttgggaaggtatggccatggtccttctcagaagactgaagaacagctgatggaaggtgtggttccttctctgaagccctggctcctctcaccaattttagaggaaccagagcttagagcagcaactaagaaatggggcaaaaggataaggaatgagatggcagtaaatcttcaatcagtactgactgaattactaataaaaactaatattaccaaataacctaaagcacttaccaagtgaaaatcaaagaatcggtctcttgatgctgttgtaacattaataacagcccctctttatatatttaccttgcacctcatagtacatatttttatatacttgagtgtgtgtgtgtgtatatatatatataaaatagtacatacactactgatatattgaatagctttctctaagtaacacagactttacagaagtccctctagttagtcatttgaaagaagtgaaggaaggggcttaccttctgagttttgtatgtgaaggtctgagaaatttaatgctgtcataaattaacttgagctgatgggagctgggaatgctggtacgggaagtttagagagggaaatacacttaaaaaaatttcagtgctccattccaagttactggattgtgtcatccttcagaatattgtatggtctaaaggacttctcgaagtctctccagtttcttgctgactggtattgaagcttaccttcttaatactgaattcaccatctctgcccattccttcagtttgttcatgaaggggaagggagccatgtggaaagaaagcctgattttcctgatctcaccctattattgtcataactaaaccaattgcaggatttttttccttctacagtataaaaacatttattcacacttgatctatattaaaaataagctgagacatattttaccattgagaaagacactgtgagctagtcacactataaaagttctttcatatgcttcagataacaaatatatgaacatttcaaaaactcttaataattttggggggttttggcagcaacattaaaattcagattaattctttaattgttaatgtgttctagaatcttgtattaaataaataggatttttaaaatcactttaggaagacctgtatttgactagttagaacaatgtagagttttaagtttaataggctgatctgcagttacacaactccttagaccctaagcacccaaatcttcataattccggttctcagaaacccaggacaccggaagaaaaaaagattttgaactggagctggttccttgagtggaatacttcatagattgtatcctgatagatcacatttgggaacagcatttcttcacgggcagcctgtgtcctctctcttacatctcaacttgctttatctttttagcagcatgattagaagtggttactgcaactgctgtggaaaaatccaccaggaggttatcgtatttaatgtttcagaaaacttgcttttgaaggcgataacagtatttcttcatcactgtgcctttgggcaagcacagatgtgttgcataccgttaaatcactctcttcttagggtgcaatgttgttctttgaaagtatttggttctccttccacctctctttcccccaccctctccttatgccaaataaggcacatttcccagacttactctccacacccagcaaggtattgcttcagaaatcctgagtgatttttttttaactcattccatcccagttgcatctccaagctcatgatacatgtttcttattcatttcaggtttgcacacattgagcacctcttagtatggagccctaaagtagattccagagatagaaacgtgttaacaaagcaccaacacacagacctatagagaggccaccttcttttcttttcttccagtggagtttgccttgaattagagtcagggagaaccatagtgtaatagacacttcaatcttagtaacaaaaagggttgaaattatatttcaggcaatgttgattccattaaaagtatgagtcttgagagggaaatgatggagaagcagaggacttcttatgtgaatcaggtagtgtacaacatcctgtacaaccagctaccttttcgtaaaataaaatcccaaacctttgaaataccatcaaaacttgctacaattttagcttcaaaccaattttcccatttcccaggttaacgctatactttagctaaattattcaatttaccatctaaaaacactgtaaaatataggacttgccacggtacttggctagcagcaagcaactagtttatatttggagaagaatgagtgaatgaattaacatgaattatttcttcttccattgcaattaaaaaagatttaaaagctttagggataaagtagatttttgttatatggatgaattttatagtggtgaagtctgggattttagtgcacccatcacacaactagtgtacattgtacccaatagacaggttttcatcacttacccccacccaccctccccttttctgagtctccaatatccattatccctctctgtatgcatttatgtacctgtagcttagcccccacttatgagaacatacagtatttagttttcagttcctgagttacttcacttagaataatggcctctcgtctcatccaagttgctgcaaatgacattattttgttcttttttatggctgagtagtattccatggtgtgtgtgggtgtatgtatgtgtgtgtgggtgtgtgtgtgtgtgtgcttctttagtactcatatatatatgagtggtacccactcatcggttgatgagcatttcagtcatttccatatctttacaattgtgaatcatgctgtaataaacatacccacgcaggtgtcattttaatatagttaatgttttcctttgggtaaatactcagtagtgggattgctggatcgaatggtagatctattttgagaaatctccataccattttccatagaggtgtactaatttacattcccaccagcagtgtataagtgttccattttcatgacatccacaccaccatctgttgtgtgggttttaaaaaatttttaataatgtttattctgattggggtaaggtagtatctcattgtaattttaattcgcatttccctgataattgatgttgagcattttttcatgtttgttggaatttgtatatcttcttttgagaaattcatagcttcaagtattcatgatatttgcccacattttaatgggattatttggattttttcttgatgatttgtttgagttccttgtagattctggatattagtcttttgtcagatgcatattttgcaaatatgttctcccattctgtaagttatctgtttactctgatgagtatttcttttgctgtgcagaagcttttcagttgaattaggtctcatttacttggtaaagttttatttgctttcggggttttagtcataaattctttgcctaggctgatgtccagaagagttttccttagttttccttctagaattattatggtttcaggccttagattgaagtctttgatccatcttgagttaatttttgtatatggtgagaaataggatccggattcattcttctacatgtggccattcaattttcctatcaacatttattgcctcctttccccaatttatgtttttgtatgctttgttgaagcccagttggttgtatttgactttatttatgggttctgtagtctgttccaatggtctatgtgtctactttcataccagcaccatgctgttttggttgctatagtatacatgtttggttacaaaacatgtaaccaaaactatatatagtatatagtatatagtactatatactatagtagtataatttgaagtcaggtaatatgttgcctccaaatttgttctttttgcttaggattgccttggctatttgggctctttttaagttccataggaatttgaggatgatttttttcgaattctttaaaaaatgatgttgacattttgatagaaattgaattgaatctgtagtattgctttgggcagtatgtccattttcatgataccgattcttccaatccatgagcacaagatgtatttccatttgtttgtatcatctatgatttctttctgtagtgttttgtagttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagatttagaactccttttagtatttcttgtagggctggtctagaattgacaaattcccccagcatttgctcacctaaaaaagactatatttcttcttcatttataaaatttagttttgctggatgcagaattcttggctgacagttattctatttaaggagactaaagataggaccccaatcccttctagatgtcaggtttctactcagaagtctcctgttagtctgatagattttcctttacaggttacctgatgcttttgtctcactgctgttagaattgtttctttcaggttgagtttagatagcctgatgactatatgtcttgatgattttctttgtgcaatgaatcttccaggaattatttgatcatcttttatttggatgtctaaatctctagcaaggccagggaagttttccttcatcattccctcaaataggtttcccaaactttttgctttttcttctcctcaggaacacctatgattcataggtttggccattttacataatcccatatttcttagagactttattcatttcttttaatttttttgtaatttttgtctaatttggttaattcaaaagccttgtcctcaggctctgaaattcttctacttgatctagtctattgttaaagctttcttctgcattttatagttacctaaatatgtctttcatttccagtaattctgatggtttttctttaaaatatgtacctctttagaaaatttttcattcatatcctgaattgtttttgaaatttatttatgttgttttttttacctttcttctgtatctccattagtgacttaataatcaaccttttgaattttttatctggttatttcaaagattgcatttgggtttgaatccactgctgtagagttagtatactcttctagggatattagagaatgctgttttcttttcatattgcgtgaattgtttttctcatttttttcttttttaggtaaactatttcatctaattattttaaaatttatttttgattcaactttttttaaaaattatttttctcttgaggatgtgactttaatgtttataggttattgtcacctagcttcagctctgggtattttccatggtgaatactctgtatgagtttcttgtttatagagaatccttgtgtaatggctttctcagatgctgtttgtaatagtgatgtgttaggtatgtgagcaggttcactgtctcctgttgggctggaatggcagaggtctcatgaagcttatcttattccccagtggtatgcatttaaaaaacgttttttccctagtactttcttcattgggttgaacagttcaggcttcaggcgagtgggagatggctatgggtaaaatctggcagtggctaaagcgggtggacaaacacattaccctaacagtgtgccaaggtcccagacttgacagaggtaggtggggaagctttcagtgaaatgcaatgaggtatttcagggggaagggaaggagccacaacagcctccattgcaagccagcaggaaagcagtcctccttccagtcacactcttgacctggtattctggctattcagatcagaccagtacctcttttcatctgtaggaatgctgatgttctgtgtagggagggattgtgactctacctctcatgcaagcctgaacctggagggtactcctcctacaggggatgcagtcaccctgaagtgttccagaaaggctgtctacagatgttcccatgctgaactcctgtggtaaaagccccagctgtgtctgcagtggtgggcaagggggagaagtcccttctctaagacccttcatgagcaccagggctgcctgatcgttgggctagagcgccagactcttctcactgaacccagcactgcacctgtatctctgctgaaacagacttcccacaagtagaaagtgcaggggtgcaaggcctgcagcctgatttcctttgcctcacagggtgctcccttaatgtggtgcatgccttcttccctaggagtagcaatccctgagggccagactactggaaatccctctgctcctcttagtctagccacccagtggggcttccgcaccccagactgttgctggggaatatctgcagacggttcagtggtataacctgtcctctagtctcccagcagcaggtactgcgtcagctctgatgggagtaggagggaagtcacgtagattgtgtgagatttccttggttataaatagccttagtgtgttggctttctcaaatttctcaaatgccagcagtagtagtaatgtactgggcacatggacagactcaagacctcctggttagccagcgtaatgcaggcaatggcaatagctgaggttgtgcaagtttttccttcctgagtgctgtgttattgtgcctgcagatgttgtaatgggctgggatggctggcttccagccaggaggtgatgcttgcaaaagagcgccagctgtggtagtaacagtgggatttgtgtttgccttgtgtttcccagagtaggtactctggggtctcaggcagtgggcggggccatggagcacccaaaattccctgttaattgtgtttcactaccagagtgggtggaggagcaaagccacatgggggccaggtcagacaagtccatgcactggcttctcatgtgcgggctcaagcagcagccccaatggggatcagagggcagttctctggctgctgcagtaatgttccagtgaggagcacagctgcctccactgcacaaaatgatctgcgtggggatcggggagtagcaggtggcagtaagctgcactcagctcccacgcatttggcaagggaggtctgacacccacagtgttctgctagcagcagctagctgggttccaggcagcctgtactcagaacccaaaactgccccgggccataacccttcttgactgagacagaaatcatggtttccaggccatacccctcctggtccacccaggaaacagaaatgccaactcctgtgcccatggctgtagcacacttcctgctctctcaatggttctggtcatagggtttcattcctactcaagattatatcatgaatctcagctgggggtttctctaaacccgtgaccactgcctgaattagctgacagacttctgcaaggtcccctgtgaggtggaatgaagaacggtttccctccatccctgctggagtctgagggtgcactcagatgacatcctgatgccactccttctcatatattccccagcactcactaaattagttccagcacttagtagggttgaggccttcccccttgtcctggactccccagtgtggggttgtgtcatagaggcagtctctcccctccttaaactctgcagactcagtttttctcctggttcacagtgtaggctgctgcccactgcttctttccaagagtcagcaatttctttccgtttttcttttaaattcctgtgttgcttcttggaaaactgtttacagcatgaatctcaatacactattttgtcttttcaagtggaagaggcatgcttacaatgcctccaatccaccatcttggaaagaaaaagctatcattgccatttttaacatcatttttccacagcattccacaccaagaatattccaattccaaattctggagagagaagggatctgattagtgtggctcgggtcaggtgtctctcctttgtccggacagctgtgtccaggaaatcaggccatgtggctagatgcccactcagccaggactctgagcacactttctgagaagtggctcatggttatgacctgccacatcgtggagtagcttatgaaatgcgatttattgagatattataggagatctagtatagtcatccctctgtatctgaggtggattggttccaagactcccttggataccataatcattggatactcaaatccctttaaaaaaaatggtgcaggctgggcacagtacctcacacctataatcccagcactttgggaggccgaggcaggcggatcatttgaggtcaggagttcaaaaccagcctggccaacatggtgaaaccctgtctctactaaaaatacaaaaattagctgggtgtgatcgtgggtgcctgtaatcccagctacttgggaagctgaggcaggagaattgcttgaacccaggaggtggaggttgcagtgagcagaaatcgtgccattgcactccagcctgggcaacagagcaagactctgtctcaaaaaaaacaaaacaaaacaaaacaaaactggagtatttgcatgtaacctacacacattttcccatatactttcaatcatttctagattacttataatacctagtacaatctaaatgctatgtaaattgttcttatactgtattattatttacttgcgttattttaaaataattttattggtaaaaaaatttttgttttatctatttcgaatattttccatctgtggttggttgaatcctcggatgcagaacctacggataggaaggaccaactggatctggaaggggcagtagggaacaaagagtttactgattgttcttctttgcccttgaagttggacagagattgaagcagcagtgtctagaattggaaaggactaaaaggggttacaaagtggtattttcaggggaaagccaggactctatcagggcaagttggaggaagaggagggagaatttgaaaaaagatgaaaaataaggagaaaactttttccataagaaaacatttcatattattttaggttttggttaggggtattgacattattttttttcatctcatgattaaatatgcatttattgaatgcacatgtgtattcagtataatattcagtgcatattctacatgtataacataactttcattttaaacaatgcattccaagtccaagcagcaatattataaattttaaaaaagcaacccacatttagattgagattttcccacaattgttgaatgattcagtaaaagtgagtgagtaggtgaaatgagttagtgaaaaccaaccaactgagagtgagaagtagtgtatttggaaaatatcagtgatatataatttatataatttacttccatgagaaatacttgctattctgttagattgctagcagaacttgtgttcaaaattaaccagaatagttaagccaagttagataaacatatttgcagaagctttttaggttaggatacaattgcatattatagaccaactattgattagacacactcattaagagaaactttttctctcttaaacttcctgtgaagagatatattcttagtataaagaccagtgcatgaagagttgactggaaatcaaagagaaacttgttttccttgtttttctttctgagtgaaaaagcaaaaggtaaatatcatggtcaaatggaaaagtaaattggattttaaattttcatgtgtgttttcccagtttgaggtgctcagatttcatttagtggttcagttataattgacaagacctcttaaaacgtgacgtatccacttgagggtagaactttttcgtgtatctgttaggtgaatgtttttacattattggatggtaactctgttatataacatttgttacgtttatactataacattttacatatatatgtgtgtgtgtgtaggtatgtatgtatacatatttatgcctaatttaaattattattacattctgggagataatgtggtttctgttctccattttatttaatagagtttttaaaaataggtaaatgtgcaggaaatctctaaccaataaatgttgtatttcagttgattttaacttttaaaaaactttttttaaaaaaaggtttcttttaaaaaagaaactctaaatgttcgagggaaggcttcaaggattttgttttctcctggtttcatgggttgaattgtgtctcctcaaaattcatatattgaaatcttaactccagtatctcaaaaggtgactgcatttgaaaataggattgttgcaaatatgattagctaaaacgaggttatattggagtaggattagcccctagtccagtatcactggtattcttataaaaaggggaaatttgaacacacagacatgcatggagggaagaccatgtaaagagacacagcaagaaggtgatctaccagcaagccatggagagaggcccaggacagttccttctctcacagccccttagagggaaccaaccctgctcacactgtgattttggacttcttgtctccagaataatgagacagtaaaattccattgtttaagccacttggcttgtgatactttgttatgacagccctagcaaactaatacacctggctatatgtcagtagtggctgccacacagaatgatatggtctctcccatgctagagacagactttatgttagaaattccaactccatgccccagcttctaggacttttcttgttcttctctttaacattagacatttctaatgtccactgaggttgagctgtgatataattttccaggaggacctatagaatcatctgaaaattcctgaataagaatgagtccattctctgttttgtgaaattcataaaaagaggtaggttggccacacacgtataatacacagacctagtaggaatgctgggctcttgctttgactctatgctccatggccttgggtcacccacttaacttatctgagtctcagtctttttatttgtaagatagaagttagtctttttgtgactttgtgagtctaaattcaaatatctttattacataagccaaagtaagtgaatatgtagtaataacacttaatagttttcatggttctttttctcaccattttcatacattatccaagtgaaaaatatctttggttaaaaaaaaatggcaaaatacaggatgtcttataatgcaaagcacagtgtctgcttcagccatccccatcctcctcaatgcctagcttacttcccagaggaaaccacttttaacagtttccatatttagctcttttagtggttaccaccctaactttaaaaatatgcttatgttacatttccttgatgatcaactctagacattatctctttgctccccaccacttactactagaatcactgattcagcagacattccccatagcctgtaggtccacagacctcttttggagtctcattctctatggatctaatttgagcaaagagcttttgcttcactctaaggaaaccagggattagatgatcacggggcatagcacaggatgagaaggtgtttggcttaattactcaaggtcaaattgggcctgagttgtaatgagtttactcttatatttttctgtctgaccacatttattttaaataaaattaaaacaaaaggtgaacttaaaatattgtatgttacttttataaaaagggaaattatctaccctgatagctcatttctttaagaagtaccacttattaagagatagttaacaggtatggtgctttattcttcaattttaaacatgaactaaactgctatgaagatgtcagttgatcatttgtggtgccagtttgatttggttttgcagctttccccttccagaaatttgctattggttatccaaagagtaagacataagagagaaaacagagttgaaaccattactgtttcttggaaacatggcatttctgcaattcagatttttctggaaatgctataaagtaaatggctttgacttataatttagaaaacctcattatcatccataatgtcaggaaaacatattttagaaaagtttacatgttgaccattttgggtttctttgagcactgctcaaagaatgtgacacatctgttgctcatttctaagtcctgattacgttgaatgactcaccaaagtggagtcagaaaacactgatgttaatggagtttcatatttagctactgtatatgcaatagtcacagataaatattaaagcatagcttaagaagagatattcaaggatatgtctgcaaatgaggcaagccaatttggtggtggggtgaaaagaaatgtagaaggagttgtgttttcagcactttctgctgcataccagccctctttctggaaattctttcttgccttgttggctttgtgatagcactctttcctggttctcctgctctgacacggatcttttttttttttttttaactagatcatcattccttatatgtcatcaataggcttttaatcaggtgtcatccactgttacttttttgcaacacatccaccacttttccatcagcccccaccggtctctactcaatgtaatatatctagagccctacgtggatatattatattgttttttgcagacaaccctcaaatccctttctctagcctttgcctctatcccgaacttcaggcatgtccactggatgttcctacatggacgacccagaaatttctcaaacgtgacatacctcaaaccaaaactatcatctttcactctcctgtcaaactcccttctaggtaacagacgaatgttttatctattaacacaagccagaaaactaacgctccggctctgtccctgcctatctctcaaagttcgttttacccacagcttgcaaatttttattcctctttttatgccctcttcctttgtcctagtcagatcttatcctgtttctagattacagcaatatcttctacagttgggctctcagtcatcagcttctaactctccactttacaattttattttattttattttatttcattttattttgagacagagtctcactctgttgccaggctggaatgcagtggcacaatctgggctcactgcagcctctgcctcccaggttcaagcgattctcctgcctcagcctcccaagtagctgggactacaggcacacaacaccacgctcagctaatttttgtatttttagcagaaatggggtttcaccatgttggccagtatggtctcaatctcctgaccttgtgatctgcctacctcgacctcccaaagtgctgggattacaggcatgagccaccacgcccagccttacagtttatttttggccagagctattttacttaatagaggtggtgatcatgtcatttgcctgctcaaaaatccttgattagatcctatgactatcaggatatgactgaaacttcatagcctgacatccaatactttttcatctgtgcccactgctctttactcaatataatatatccagggccccacgtggagcctaacatactgcagaggcctgataaataaatgaataaataaacaaatgaatgatggagtggataaatgaataaatgactcactaggcattgagcctgccaaacagatgcatgcatcatgctgccaagaaagctatttccctccttctgatataggtgaaatcctattcaatatgtcattgttttttcagtttttttagactattccagtctcaatcaattgcttctcaacttgtgattctgagacattttattcatgctacagttgtagcagttaatatatgtcaaggttatttatatgtgtgttgggtgttcacagagacagggactcttgatggcaatgaagactcagctactagcaaaaagcctgatgctcttcggaaatcaatccatgtttgaattcccaccaccactaatttctttcagtcatattatgtctttcctgaagtcctgcaatagctttataagtgttttccctacctccattctcatcctaaaatctcctcctcattgtcctactagacaaatccttttgttctgaaaatgaaaagtttgcagaaatgccagagcactgatgaaattagaggtcaggattcctgatttagaggtcattgccttcctaaatgcatctgaagtttccaccttttttggtgactaaagttgttttagagttttaggcaccctgggttgcgaaataaatagaatatcattttgtgggggtagtagagatctttctgtaagtttttagctgcttagccatttcacattatttgtactttgtgagtaaatatagattcaggaagaaatgttcctgggaacaggaaggagacatatctaagcccgaagtgaacttaatgactttgtgttttccctgctaacaggagtcttggaacccacctgggttgtatcaaataaatacaattattgcagttcaactaggtcatgtttgtgcacacacaaagtttggatgtggcagaagtaaatgactggacattgttaacagagctgtggtttgcaaaacagcaaaggttttcagactggagaaagggagtgagttcagagaaacatcagtctaaccaaagtgtttctgctgctgctgcagatgccactgttaattggaattgcttattacttcagttactttcaacagtgctttgggggatactcttgccctcatattgtctaaatctgtccctgtcactagtgactggataacccagggcattttaacaggcatcctattacctgacagtaggcatccagcttcctgtattaaaagtagatatttctcctgggatttaaccttctgttcaaagcttgaaccactttgttaggaaaaatgtggtcctaataatgttttccagtcacctgtggcttgcaaagtacttaatgcttatgaactcattaatcctcttcatgaagccagtgaggaaggtagatgtcaagttatgttttcctctttctaagggctgtgaatctgaagcacagacttgcacagactgtttgggacatatccatggcaaattgggagaaaggggcctatcgttttgagatgttcaaacccaaaatctagcggctgattttttaaaaattgtaacttcaaggtggctctcctctctatagctatcaatcagaaatcctcagtgggtaaatctagcaggaggcattggctgaaaaatggagctttgagagcaataacatctgctcagttgggtggggaacagatacttgtagtgtcaagattgtgatgcatggtcttgggatttttccaagttcaacatgtttgtcagtcttttgaggcccctatttatccatggtgtaaggatttgtttaaccaactatttcctcctaatccttgcaaaaacatgtatgaagtacacaacagcagttgaaaccatagtagcaattctttcaaaggacccagtctatggctcctggaaagttctgtccttccccgttctaaatctagtggtagaaatgtatcctagttgaagattggtattagatgcttactattaaaactggaatgttaattcttacttctaattaaaaggcctcatttctgttccttagatctattggtgaggtgattttttgggttctggccaaccatagaggggaactttaatctgcacgcttcttagagaaccctgttgccaccttattattttcccaatgaagtatgcagagcccaaggacatgtagattgtttattcatccatgtgtgcacttattcatttaggaagtactttttcattattcaccatgtgaaaaccatgtgccaagctcctgggggtactgatatgaccaggcttatgagggggaagcaggtgggccatttagcaggaggccttgtattcataaaaggcctcacattaagactcttgacattgttcccaaacgaagttttattttggttgtaaataagggtcatttgcaaaatacaagcatttacaaatatgtgagagttttggtaatcctgctctggcatttcataacatcataacgtgtccacaggtctcaaaagtggaagtgacctgggctggttagaacctcttggagtctgtagaaatggctcaggcaccctccttgtgtctcattactctgtaggagtcaggcatccttctccccaagaaacaatgtaggtggtaacccaggataagaaaacatctggaagcagccatggaatataaatgttagatagctggaagaagccacagagagccttcagtgtttatgtgtcagtcaaggaaactgacctgaaagaggtgcagggggacatccctaagacccactggcagttcacggcacagtgagactagaatggaggattggtaatctgaggagctctgctgtttcttccatagaattgggcccttgataaacacacatgtgcatgtgtctttatagcagcatgatttataatcctttgggtatatacccagtaatgggatggctgggtcaaatggaatttctagttctagatctttgaggaattgccacactgtcttccacaatggttgaactagtttacagttaatgggtgcagcacaccaacatggcacatgtatacatttttatgtagcaaacctgcacgttgtgcacatgtaccctagaacttaaagtataataataataataaaaaaagaaccgggcccttgacaaaagaatggcacttagactgtgctttaccctgttacatggtcctctgcaccactccctaggcatgggctgatgtcagcttctttctgttccttccttctttccttctttccttccttccttccttccttccttccttccttccttccttccttgtctccttccctccctccttccttccttcctccctccctccttacttccttcctttctttccttccttccttctttcattctttctttcgttcttcctttctctgtctacccccatcctcatcgctctctttttttctttctctgtcttttaaattgagtgcatcctggttttatacttactgctagtatctttttgctatactcctcctttgttcctaccagcaatggaggttggcccacatcaaaagcagaaagtttggttttaatcagcacaatatttgcagtgtgagctttgatcttgacttctgcctggggccagagcaggacttcaccgcaacagtgaactcaagtccccgtgttctcctctctgaagctgggatcaccaggatgtggttagtatgttgcggaatgaatgtcgctgggattcaaagcctgcaatgagttttttcggtaagtcccaactatatgagaaagagagcgagagggaaaaaacccatacaaagcaagcatctcccttctcccctcaaaacacaaagaagacaaactaggccagattgactattttcctgtttcatcctgttcttattcctcttctttgagttttagacaagtatgttatgacaaaaatttaactccatattttccctgaagtctctaaattctttgagccgcctcatagatagtacttctcaatgtgccaaagacttcaaacaagcccgaacttaacattttcccctagaaacctgctcttctggccgggcgtggtggctcatgcctgtaatctcagcacttggggaggctgaggcaggtggatcacttgaggtcaggagtttgagaccagcctggccaacatggtgaaaccccatctctaccaaaaatacaaaaattagcagggcgtggtggtgggtgcctgtagttccagctacttgggaggttgaggcaggagaatggtttgaacccagaggcagaggtcacagtgagccgaggttgtgccactgtactccagcctgggtgacagagcgagacccatctcaaaacaaacaaacaaacaaacaaacaagcaaacaaaccaacaaaccctcctcttctttggtttttgtaatctgccaccaggctcccaagctagaaaccttgaattcaccttacactcctctctcattcaccacattctgtcaattctgccacctaaacgaatccaattactgccttccctccactccgtatgccacacagctgccagggagatctgtctaaaatgcaaatctgatagtaccatcctcctccttaaaaagctctgtgcattccctagactcagagtcacacatgcacactcttaagcatgagatagccacatggccctggctgcagctcagtgaggtagccctgctgcagccacactggatgtctgaccacaccttcatggggtgtgctcatgaatgcctctgcatcttttctccagttaatcacaccacctgcaatattctttctcaactggtcacattctgttctttcttctagattcagctcactctctccacatttaagtcttccaaggcctctcaggtagttggttgcatcatcctcccacttggatttgatttactggaaggaacatcggctttggagtttcacaaacaaaacttaagaacctgttccactctgaatgtcattgcttcaaccataacacagacacagtgccagcttcacagaactattgagggaattaaacaaagaagcacttggtttccgataaatattagtttcctttctatagcaaattttacatagaaaattgcatggtggttaaaagtctatagccctgaatccagaagatgtggctttaaagcctagctccaccacatacttatgtgagtgaccttgaacgattacatttgcttgagcaaattattctcctttcaatgtccttatctctataataatagtacctacttgatagggtgcttgggaatattaaatgagataaatataaggttattgtatttggcacacaataatcacacagtgggtttgggcggtaatcttttttttcccatacttgccctgctgtatcataattatttgtttacacatttttttccctattaacttagggattcctaaaaggaccagatggtgccttactcatacttgtatcctcaggggctaccatggaacacagtgtaaatgttcggaagttacttcttcaaatggataaggcctggtacgtttcatctgaagtttcacttctggactgtggtcagccacacaatctggaattcttccagggtactgctccatgctcacatccatgccaatctctctttatttttattatttatgtatttatttgtaatagagatggggtctcactgtgttgctcaggctggtcccaaactctgggcttaaacaatttttcctacctcagctttccaaagtgctgagattacagacatgaaccatcatgcccggcctcaatctctctttaaaacccacttcaaaataggcttctctaagaagatttcctccatattaccccaagttcattcagagctctcttttaaatctcagttccagttgccttgctgattttttaaaattattatttcacacgtatgtcctcagtgggcttttttttcagttcttaaattatttcatttgtttatttttaattttaattttgggggctacatagttgacatgtaaatgataggggactggactacctccctcctgtgatctgtgagtgatcttgctgccaccaacagtagcacacttgttgtgggggctttcattgaatagtgtgttacctggtcgggttgcctctcatggcagcatcttttttccccatcttcttttctttttcttctctttctgttctctccaagggcccctccagccttgaatgagtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagaagaaaactgaggctcggaatagattcaccacgtttccagagtaacaagctgataaggacttgaagcacattcacaggacgtcatcctctctctctttcaacatctcaaaaatcaaacaaatatatgtgtggcaaatcttactacctccccaacacactactcccaagacccacccctacttatttctctccatatcccttattacattagcatcttgcatagtgtatgtgtactcgttcatgtgtttgctgtctgcccctcctcccactgtaattggatcaaatataaatgatatcattggaatatggaagaggtaccaatgtagctagtgttatttgcacacacgatttaccattgtgtaccaaataatactcagttaatacctgctgcctttagaatgtcccctttataaagctctgaagatatgggctgccatgcaccaatcactactggctgtagggtactcgcacatggctgaagttctagtgctggtgttgattcgctgggacttgaacagcatgaggtcaatgcattccataggagactgcggtaacatcatgtacaggtgggataagtttcttttccaggtaagatgttcctggcttagctgctgttttctgtgacaagttttgtggacagaatcaactgcctgcctttccagcagtgcacttagaacctcaaaaaaactggctcttgggcagatcaacaaaccaattgaatgcagttgcaattttaaaatctgagccacagaaagatattgttgcttggctaggttgtgactatcttccctggataatccctgcaggacttttgagggaagtaaagaagtggcatctcccatttcatccatcagaatcatcatttaggaattatcaagaatgagagagggttagtcttggaatgtgcagaaaggtatacatggcagttaccagtatattaataaaaatgccactgtgctgaagaaacaaccgagcataataaaagactactatcgaaagaacttttgattgtggcactcttgcaatggctttaggtgtctgattgcatttaaggctcagaacaatcctctaaggaacgataatctccatttcacagatgaggaggaagaagaacaaagaggctaagtgatttgcccaaggtctcacagtaatgagtgtcagaatccagatttgaaccaagacagtctggctgtagagcctatgttctaaacagctataccactagatccttctactacctttttggtgttttgttgttaacattttcaaggtctaaagagtgtataagcaagccaactaacttgcaagttctttgtgttattgaaatatatatgcatggtgtgtgtatgaacactttatatacactgttgtacaattataaagtactttggagtgggagggggtttagaagtttatttcagcttcccacccaatgcaggggtccccagagaatcatcattcagctttccttgaactttaaaatcagatgaataaaaatactaagggtcaacataagcgctgatgctaataattgctgtaactatggaaacaaactagaatacagaggacaaaaaaaggttcttacgagagaattaaaaaaagacaactgaaattcaccatacacacacaaggtagtgactaggcttgggaaccaaaataaattaataaagactggaaaatggaggagagtaggatgagagaagtgtaagcactagatttctggccatctgtaaaacatagttaaactctttgttttgattacataaatattttgtgtttgtgaaaaaaactctgggataatcattcatataattagaaataagatgcctggcttctaaatgggcatagaatataaaacatagcctatttaggaaaagaaatagtggaagagaaacagtaagaaaacaaatgaacaacagcaatgaaccccaatgtgtaagctccatggcaaatacatagctttacatttttctattaaaacataaaatataccaaagtagatttaacaatgatatgcagtgatttgcattcattacctaatgactaaaaatattctagccaattatagcgctatacagtattttgtaggttaacatcttctctaattacttggaagatacactatgtcttattcaatttggtattgccaatatataattggcatatgattggtgctcagatttatgttaaatgacttaatgaatttttagaaagtgagtggataacaatataaggaaaatagtatttaaagaaaaaatattatatataggagagtgggtgattataaatgtataatcaatagtgaagacataatgaaatggaaactttatgtgccaaagagcattgctataaaccacttggggcaaaaactattggaaatacaaagataaattggtggtaagagtgtgggctttataatcggtcatacctggatttgaatcatggctctgatatttagtagtttggccaattatttatcctttctgaatcttattttcatcatctacaaaaatgagactaacctcattgtgaggattaagtgaggaaatgtaggtaaaagtgaaggagggagagatgtatcctgttctcagtggttatgcagcatttggtcaataaatatccccagagtgagaaccctcttcttgtcattttcacagttctttagtgccagtataatgccttgttctattaaacattcaaatggctgctgagtactgaataattttaaaaagaagagtgccgtaaactgtttccttgcttaaaaacagaaatctaactgtagtggctttacaaattaggggtttgttttcttacataaagctgagacataggtgatcaggtgtggctccatgaatttatgaaggacacaacccccttctctccttcagttcaaccaaccttagcactttctttccatgctccaggtcacagaatggcttctgaaactctagctatcatggccactgctgtgacttgaatgtgctccttaaaaaaagaaaaaaaatgtgttttgtaaacttaatacccagtgcaacagtgttgggaggtgggacctagtgggtagtgtttaggtcatgagggcttcatcctcataaatgcattaatgccaattattaaagggctcgaggctgtgagttccatttcttgctctcttgcatgcatgcattttttgcctgtctgcctcccaccataggatgatgcagcaaaaaggccctcaccagatgccagcaccttgatattggacttctcaacctccagaaccatgaaaaataagtgtcctttcttaaaagtcacccagcgtgtgatatacttttacagaagcacaaaatggactcagacaaccacagtctacgttataggaagaggaagggcaacagtcaaggacatttcttccacttcacttatctctcttcaaaaactctcctggaatccctacccacaaattctacttatctcttataccatccattactccctataaggaagacagagaaatgtgagtttttcagtttttttggtttggttttgttttgtttttgagacagagtcttgatctgtcacccaggctggagtgccgtggcaggatcttggctcactgcaagctccgcctcccaggtccaagcaaatctcatgcctcagtttcctgagtagctgggactacaggtgcctgctgccatgcccggctaaatttttatttttagtagtgatggggtttcaccttgttggtcaggctggtctcaaactcctgacctcaggtgatccgcccacctcggcctcctggagtgctaggattacaggcatgagccactgcccccagctgtgagtttttttttaaactggaatataaaatagccactccatataaaatagagtttctaatgtttgtgaagaaagagagaattgatattagggaggcaacaaagaatctgtcaaaatgattgatggttttcttggatgggaacttcttgcatcacttattaaagtctacacttatgtatttaataattttatgtctagtgggtttacttcagctgagcagggcctggggtggggtcctaaagtaactgatggagctttcctttgtgagttttatctgttatatattctctgagaggttgaatttagaaagtagggcaattgaaaatggctagggattactgaagggtatttattaatttatttgactggtaatacaaacattagaaaaatcaacaggggcaaaagaaaaaacaactaaaaagtaattttttcttcacccttggctctcagttattcagcccctgtctttagaagtaaccactgtgactacccactatttaaattttgtgtagacttctggataaagtcactgcttataatgcatatatgggtatgtaatctagtttatttttttaagcaaatgagaccgtatcagacatacttctctgcacatggaatatttcacttaagagtatttcttggatatctttccaagtcatacttgagaagctgcctcattgtttttaacagctggctagtatatcattgcatggatataccattatttattctcttgatgaactgtatataccataatttatttggctgaacattttgtagagtccaatattttgcgctataagtaagactataatgaataaccttggaaatatgtcattttgtgtttgtgtaaaagtactccaagaattagaatttattctgagtcaaaaggcatttgaccttatgactttgagaacattgccaaattactctccataagtattatggcagtttttactccactaacagtgttctgatgatatatttttgctcattacattgtgtgaccaaacacttggtcttctttggaaggccaaggcaggagaatcgtttgaccccaggagttcaagaccagcctggacaacatagcaagaccccatctctataaaacaaacaaatattttggtgtttgctcacataataaacaaaaaaaaaatcataggttgagtatcatattgtaaatttaagagctaaaaaaaatttctatttatattctttgcccatttttctcttgggttggttaattcttataggttgtctttatagtttaaggaaattagcctcttattagttgcaaatgtttcccatttggtttttactttgtttatggtatttttcatgcagaaaaaattttttaactgttatgtagtcaagtttattgacttttaaatggcatgcagattttacgtcatatgtagaaagtttaatatctcacattaagattgttttaataggtcaattttttcctagttagttttgtttttccaaagggtagcacaaagaccagtgtaactacaagctacaaggaagccaatttcagcttctcctggaagaaagaacattttaacaattagtctaacaatgaaatcaaccccttgttgtagttttcttcagggtttggtaagctaaccatttttaagagtattccaggaagcctgtatttcttatttctgcagtcctctatctactttccaagaagaaatttacttttcacaatgggcatcattaccaggcagttcttggaaaataagcacatatagtaatgcgatatataagattcatgatatctattaataaatagcaaaagaaatttaatggaaatcatataaattgttctagaggaagaagttttttgagatagttcagtatagtggtgagagactgagcttgtgagtcagaaaggctagttcagatccaattctgtgcctggctatgaacctctgagcctcagcttccccatctttaaaatggagatagtaatactacctactacataggattcttgacaggcactcttaaaagtcttaaagttctatgcattttttgaaagtttaagttttcgataaatattagttattttgttgttactctatttggatgcaattccattgcctagtattttttttctttcggcaagcatttattgagtgcacactgtctactaaacactgtactggattctggggtataaacaagaataaacaaggtacctgttcccaaagaccatagccttaggttttacagaggtatggaggcaagatattaataaaatttacttgttaaatcaataaggccccaaagcaccatgcatttgtaatctagagtatgaatggcacatatggcaaagtaacatgttggcaacgagcctatgaatgaatagcagctggattgcaaaatcaaggagaagcttttcccctaccctccgaacccaaacaatccccttctttcatcaggtaacaagagatgacagcacagggatcaggtcctaatgcacagcctttcatggccccagtcctgcttttcattctgattagaggataaaggaaatgggtttcctggctggtctcatcctggtaaacattttgcctgctttgcagaaccgccaccctatttaagtgcaatttgctggacctgcagttggttgaaaacagcagggcctttgtcagtgaatagagctgtagtgacagggaggacatttataaaaatgctggtgtgtctcatgccccgtgccagctggtgctattagtgctcttttatgtgtgtcttgaaatatactgtaataaatctttaaaggaaagccaggacataatgagtaatcaaattcagtcctctggaattcattgcaatggtggcttctaaacgtgggtattgccccaccagaaatggaaaactgagaagttaagaaaaacaggttgttcttgaaaatgtatcagagacatttttggtaaagaatcatattggccctcttccagtggctttatttttattaagaactagaaatccatgagctgaaatacacagactgctggaacccagccttgatgtgaatcctgcatcttagtctgagttactattttaataaaaaagaaatacttctattaaaagtctctgggtgccccatcaagtatcctatatctattcaatgttataatcgtagaacttgtaccatagtgtaagaaaatgtctgggaagtgatgactgaaaaaagcagttttcttccagctggcatctacctgatgatcaccccatatgtatatggtcaaggtgcggaagagatctctcctattaaaaatacttgatacatttgggtaatacaatgtgttccaagttttctctttttctttttcaattttatgtgctatagaataattttaaatgatcaaaaataaaagaactgtggttaggtatgtatgtctacagaccacccattattctcccttctgggcaaagtctagatcaatttttccatttgagccggagcttcctatttgcaactatagagattagtgttgaatgctcggagctgctaacataggagttaactatggcttgtgggtcaattccagcttaccatctcttgtttgtttatttgcctagaagttagtctgtgtttattgtttgctgtaactgtaggtgtcagaggctaaaatttctgctggtgtccttgtttttagggggtccctgttgtcttgggtttccctggagactcctttataaatagaatctgagccttgcagttcttttcagctatcatcctctgttatacgggaatcctattgatatggcgctaaaatggaggtggtggtaatggggaagcacccaataaccctatgatttgctctcagtctttaatgactccatcattatagatttaagaaccttttaattcctttccttgtttatagtctttgctcatttttctgtcggactgcttaacttttgcgtgtgttctttatagttttaagaaattagcctcttgttagttgtaaatctgtttcctatttgtcttttgactttgtttacggtattttttcatgcagaaaaaattttaaatatcaataaattttactatataaaattattcacaaggtcttcagggtttttttcaccccttagtaaatgagacaggaaggctagatggggctggagttgggtatttccctttttccaggtcagatgggctctttctgataaaatcttactaggttaggctctggtaaaatagtctccctcaaagacaggtcgtgttaaggagaacagaacagtctgggtgtatttaaaaatggttacttttcccctcccctgcaggaaggatgaggggatttttctttgacctttacagtgcaaacctggttaagcttcagcaggtaaaactcatacaaatgtgcctcacccacctccctcaggctgggtctccaggagtttttaatttctgaagctaggccaggctcggtctccagtaattagtaaattatcctttaaatatgtctacccaatgttggctccagtgagatttctgccccaagtaagatataattctttgtatctaccccctcttcggttttagcagtggtgatttgatctgtaacctcacttctctgatagacctaagaattgttgattttcagggttttttttttttttttggcttgtttcttattgtgaggacaggagtgacaaataccatgatctttatttacagaaccagaaaccaaagtctaccacctgtgtttgtatagcttgtgagctaagcatgttttcaggcattaccaaatgattgaaaaaattttaaataattttttgtgacatgtaaaaattatatcaaattcaatatcaaacttcaatactgtgttcataaaattctgttaaaacatggccattctcatttgtttatgtagtctatggcagattgagtatttgtgacagagactgtatggccaacaaaacttaagttatttatcatctggccctttacagaaatggctgctttttagtacactctagacataggtcctggttaagtttgaatcccttgacactgtgcttgagttgaaaatcaaatgatgggcacctgtcaagggctggagaggatcctcacatttagagatgagtgaagacataggccttctctcaaggagactctaggcttgtggggaacactagagggccaaccaaataagaatttaacggagtggttcagaatgaaaggctatgaagttcgtcttgggccacaggaagtcattggagctcatcctatttggtagaacaggaacttcttgatgatgatccaagggctggatctttttaggagtgccaggctcaggtggacattgatgtattgcgcttcctgagaactgagaagtttcagctccaatccttccaacagttatggctgctgtggccacttcagtactgtaatgccactttcaaacacgcatactttgttcattgtgattttttttattcttcagttatcaagaagtatgctaatttaaggaaagagtggactcatgtatcagaaaagtattcaaagcaaaccatcaacctaatttcagaaagtagagaccagtgagagtttcctaaacatttataaagggtagaatgcttggacatttctaggttgatcgtgaactctgccagcagtgttcacccacttgctttgccctctgaaggtatttcaagtaaaaggaaagataaaccacaaactgtttagctcatgtatgtcctataatacatgtatgttattatctctgtggagaataggagaacttcagaactttgtctctggcctggatggaaattctttcagtccttgttgttattaacaacagctataagatgtcagaaatgcctccttagctaaagtgggttggggctgggcaaggtggctcatgcctgtaatccttgcactttgggaggctgagggtggaggattgcttgagcccaggagttcaagaccagcctaggcaacatggcaagacactgtctctataaaataataataaataaataaataagtgggttgctgccaaggagggtccatgctggacttagatgataggatggatgcagacaacaaggaaatatacaatatggagttctttattaattaatcacaacttccctgaggtccagattccttaggaaagttaggtgaccactcttgggccccctgtgtaggccacagtatattaaggtttgcctagtctgcaattgagtagtgtccttgagtctctctggctgtgtccccaaattgcaattctgactgtacactatgttgtggtttggcctggaaacaggtatattcccttgccaccttatattttttatcagagtgattgtgaaatccacccagcagatcttgtccatgggccatcagtatattacattgcatattaatggagctggagaaatagtgaagcaaataacccatgcaaaagtaactaaagcacaaataaggaacatgatattgactctcttgaatctctcacagagtatagatttgatgaggacctctaactcaatgtaaagtcaccttaatgaaatctgtctcttattatcatcatccaggcccttattgaatatgtctggaggtgagaaactcatatcctcccctcaacccatgtgtgtcagtgttagacactgcattagtcagggatcttgggtttgcaagtgacacaatcaatttgtttaagcaaaaacaatatttattagctctcttgacaaaatttgagaagtgcaaatttcaagagtgaatataaataagatttaaatattggaaatcaataattaatttttcatctttttccctccttccttttctctatgtaaagctattacaacatcacctggaacatagtaagtgcccaatatgtgttacttgtttttacgtttattacttcatagggttagcagaagcgataaatgagataatgcatttagcatggttcctggtatcaccaccaataccactgctgttactacttttctttccagttttctctgttcttctcctttaatctttcagagtgtctttcccacttagcgaaaaacatggccatcactaacttccaagctcacatgtccctgcttcacaattagaaaacatttgggatgtcttctttctgtttcttaagttccccatggtagggagaaatctgattagcttaactttaatccagtgtctatacctctgtggtcacagtggccaggaaggaaagataccctcactagaacattacagttggaatagagggaagtttttcacagaagaagggaagacttgttaagctgacacaactagaaactgctagagacatctggggtgattaggagtgctttcataaatttaaactgaatactcgtgcttcctactttgatcttctcctgaaacacgaaatgaatcagttctttctcatttgtgacctttcagatgtttaaatgcagctgtcatgtctgactacttggcacattacaacattctactgacccaggtctcctgtctctgagttaccttttattccagttttcagctctaacaggacccttgtagacttcttatttcctccttttctttaacctctgtaatcaccttgccatctctcaccctgctttagtccacagagttccccttaatcattgctcagctggcctggttactgcagaccaatcacccagtatcatgtaggaatgcagtcctttcagcagcaaacaggtttgggaaacccgatagatctgttttgattcatgtgtctctcctactgagtaaaagtatgaccttgagaaattgactcagcctctttcagtgttgttgtaaggattagggattagttatgcacagtccttagcccaaggcctggcgtatagtagatgtacaataaacagtaactgtggttactgtcattattattcttatatcaattcctggcaccccaaaggaaaggaaaatgtggttagagaatttatattccatcccatgcccatggagcaaaagatcaggttcttcctatcctggcaaagccagcatgaagaggtgacttgaccacatgggcaaaaattggaccttgggacttcaatttctttttcttgcaagcctcagatgtcaatcccagcacttaggccactgggaatgtagcagtggcttttctcttgttttctacctccagttttaagccaattgtcttgagggatataaaaagccccattatcccaagctagggaattagaacgttaattccatccaggtcagctattagagggtataaaggcagagatgactcttctctgggggctttactgcaagtggtagctcaactcattcaactccattgaagaaacatagtttttatattcttactctggctaaatgtcttggcatttgaggttccccaaattttggctgtagtctacttttccttactctgttgtactcaccttctacccatccagatcaggttaattccccctcccaaagcccactctgtgaataagcacttctgaatattttatcacatcgttaccccagtgagtgtcctgcatcaaactaaatcctacccatctttaccaccttagctgtccatccatcgctttacacctgtccatccatccattgaaaaaaattgctattttaggcattgatacagatgtaaacaagaccaagtcccctggcctcatggaatgtacattccagtgtaagaaacagacaacaaatatnnnnnnnnnnnnnnnnnnnntgactatgttggatatgctcattatggttcacagaagggaaggtcatcttgtccagaatgctccaatgtaggcatctctttcacagtacctctgaaagatagcaatccatggagatgatgcaccgttgatcttaagagtacagaccctggagctgtattgaccttggtttgaattctagctcaaccacttgctggaattcagctcaacaatgtgaccttggttgacttatttaccatcttcgagacttcttatcctttatctggcaaatgggggttataatagcactatttcttccagttattggttgttgggagaattaaatgaagttatgtctgtaaagctattagaacataacttggaacatagtacttactatgtgttacctgttgttacctttattacctcatagagttagcgtaagtaataggtgagaaaatgcatttggcatagttcctggtatcactaccaccaccaccactactactattataattgttatttttattattgttttctagtgacagaagacttttaagatgggaagttcctcgtcttatgagtttccttttttgacagtctgttcattaaattgccccttttcacattgaactcaaatgtacttcacataaatatttagtttgtggtcccagatggacctgtctaccataacctccagagctaagcatccagcccaatatagtttggctctccctgatcatgacagcccatggcacaccctcctcctctgaaatccccaagccacttctgttaataccactcacttggcccttaccatttattgttctgatagctattgccttattatgttagtgtttagttcaatctacacccagaacataagtgctctagggcaggatattgtcctaccttttctttttataatccccttggatggaaccctctctctctctttcttctctctctctcgctctctctctctctctcacacacacacacacacacacacacacacaacaccacagcatagcttagactcaacatttacgcactgtgtcaaggccactgtgtcactactgtgtgaaggccactgcaaccacactgggtgacatgagaaccaacaccattgcctcggatacaaaggttgcttgtatttcactggagcatcttttattataccagtttcttccatgtgcaagtcaaaattgtgtcttttttaaatgttcctgctgactcataatcttgcttgtcgtcttttcctcctcatttacaactctacagtccataatgtattaaatgatgcaagttcccagcctaatattagggaaggaaagtagtaattgaattcttaaactcatgtacctttctgtagcctttgcttatgatcttgtttgtgccctgggcacagacagtacactgaaggactggccttcaaaccagcttctcccattgcttttctcatgataatagtgagtaacatttattacacattcgctttgccttcatatactctctacatctacacttcacatgcatgatgtcatttaatcttcagaatcaccctctgaatttggaacaattcttatccccactttagggataagaaaattgagacttagacaaggaatctcaatcccagaactagatttctttttcttcttcttctttcttttttgatacagggtctcactctgttgcccaggttggagtgcagtggcacaatcacagctcactatagctcaagcaattctcctacctcagcctccccaggagctggtactacaggcatacaccaccacacccagctaatgtttttcttgattttttttgtagacacttgttttcaccatgttgcccaggctggtctccaactcctggactcaagcaatccacctgcctcagtctcctaaagtgctgggagaactttatttcttaactatatttcttaactattcccccatatgattccatcaggacctgagtgagagtgagataatttttcaggttctattctctgtgatgcagcctctggccatgtatttatagtttcaaatagaaagtgagttactatcagcaggccagaagtagaagactttgggaaatttcttttatccatggtattagtttacaaactttagtccctgatgtaagtaggcatcatactcccaaatttagattgatgagacaaattagaatgaatgtatctatgattgcaggatcagtcacagggtttccttgatagaataattcgctcctatcttttgatatttcagcttgattaggaaaaattcattgtatacacaaatttttaggcacatatctaaggcataagataagacacatgtgtggatccactggttaaaatgttaaatgtgtggcttgtttcatcattaaagtccctctagtatgcatttatttgcttcccagaagaatttgatctgatcgttgttctgctgaccgcacacacctgatgcttctctgatcttatctgctgctactctctgccttgcttattctccccttactgttcacagggaaaatgtaccaagcactgtgggaccgaagttctgttcctgccctcagggaacttcccattttgttgaggtgacaagattatacacatgggattatttgacagtttggagctacacagtagtgctattgagaaatagggcaggtcttaagaggaggatttagcgtagatttttcagagaaggtgaaggacttgaactggagattggattttgttggtggagtaaagagatggggttacaagtctgggaggtggagtgggcattggaagaccaaagacagcataaaggaagaactttttaaagttacgcaattatatcattaccatgtttcaaaccatcttgaaggcatgatgctggaaggaacctagcatgtgggtggactggtctgatacacttaaccatttttccttggtgtgtattatatgagtttcaaacagtagtttaatgtggtgcctcaggattgacacaggtgatttctatgcccaaactgcctgtgatggcccaactgtgatgttcctccagggcctctgaaacaccctgtgccatcaggcttagcaaccccaaggaaaatcttggaaaggagcacatattgcttcttttccagtaaaaacaagtctttttttttttttttttttttcttccagcttttgttttaggctcagggagtgcatatccaggtttgttacatgggtaaattgcatgttgctggggtttggtgtacaaattatttcattacccaggtagcgagtatagtacccaataggtagtttaccaatcctcaccctcctcccaccctccatcctcaagtaggcccctgtgcctattgttcctttacttatgtccatgtgtgctcagtgtttagctccctcttataagtgagaacttgtggtatttggttttctgttcctgcattaattaacttaggatatcctaattaacttaggataatggcctccagctgcatccatgttgctacaaagaacatgatttcattcttttttatggctgtgtagtattctgtagtgtgtatggaataacattgtatcacagttttcttgtccagttttccattgatgagtttctaggttgatttcatttctttgttactgtgaatggtgctacaatgaacatagttgtgagtgtgtctttttcctagaatgattgattttcctttagatatatactcaataatgagattgatggatcaaattcttatgagggtggtcagggaagttattctcactttactgaagaggaaattgatgttcatgtgctaagacacaaaaatgtgattttttaaatattacatatataataggtatgaaacaatatatatgatatatgcatatatacatatacacagatatattataatgtgctaacttcagcatttctgtgagctttaacttagccaaggtgcctgatctgagatccaattggattttcattcccttttggcctaatgaaccacatacacctgcccttctcttaggcttggctcttgctaattatctctctcaatttgatgttcttctcttctcactgtgtatgtcatttttaatgagacaaaccagtgtttgggagaggtttatgggcaagaagaaaaataagacgatcactaacaactggcagcaggttataatgccaagatcgtctacaacattttaaatgacatgctgagctgtgtgctgagttgcaccattttccattaactgctttcagccagaacaagatgaacaagtgagaatgggttgaaaaagcgacctgatcataatgactgctatttattgggcacccattgtgtgcagacactgtactcagtccttgcatattttttttcatttaaacctcatactattgttatcaccattttgcagagaaataaatggaagcctatagaggttaagtaggtgactcgagaagatataactagtaagtgatggagctggtggtcaggaatttctatatataaatgtatatataatagttcattagaaggaagctttcaacataagtcaaatgcttatgggtaaagaaaaattgggggccagttgtaagaccagacatttacttccagtgccaataacaatattgtcaccatagcaggtgcagaaatgatcatggggacagatttcttgcacaaaaaaaaagtatcctttaagatttaattcgtatggctatttgaatgtgcagtaataaaaagaagtaggaatagacacatagaataagtaacttcagagccttcacaaaaccctcctgtctgaaaggatatcctctacccagttgtcgtgtcagaaattccttccttagtaattaatatccttgcatagtttttttaggtgtcatcttaatgtggacaacatccatcacatatcagatttccatcaaaattcagtttgtcttttcacatttactcccccttcttccctctcctgagataacttagcgtcctcactccactttttacttaagcactgaatctcacttcatcatctctcctccatcagaacttctccattctgtgactctctgttccttgataccttgttctctaaagctgacagtgggtgatcataggtcagttattagatggaatcctttagccatagataataggatttttctgcttcttagaagacaacgtcataatagttaagtagcaggctgattgtatgtgttttcaacatctgaattgtaatatatccagatggggggtagcttggggaagggggattcttttagattctgcaggagcttttccccatacttaaattccttcctaatgcataaagctgattctgcttggaagagggaagccagcctttcattttccacctgacacctcatgatagatggaaatgtcccttcctcttctctttcttatctctcagcatccttcttctctgaacaaatgagcattcatgacccttggtgagtcaatttcatttaaacagaaggccagatacaccccagtgtattcaattattttataatcaattcccttttcggcagcatctttctcccaagagtcagaggtccctttacaaactgtattggcaacattattacaagtcagagcacagtgacctgcatctgaggacagcgatttaagagacagtgaatatgaaaagacaaatttgattttgatgaatgataagaattttgtgtgttatcaacataaggtgaaacctagagaaaccagttcaacaaataaatcaccaatgaaggaatttcaggcaaatcaatcggtgttggggcagttaggagctcagcaattcatttcacattgtagacactctccataaaatgattaattgtataaatacactaattcaagatacttgttgagcttttgctatcaccagaccctgggcacagggtgctggagatacaaaggtttaagggaataagtaaaggaagcgggcaatggtgaaaaggaaggaatgaatgaaggaaggaagggagggagggaaggagggacggagggaaggagggagggagggagggattattcactttagtaattgaataatttgtctctgacaggaagggctggccttgcaagctcaaccaagctttcttagtacttcttaataattaaaataattgggctatatgactaaaaatttgcaggtggaaatttctgttcatgttctgtgattgctagaggtttataaagcaaaaactttaaaacttagaaagaaccatgttatggctttgagtcaaagacttggacagtttttgcacctgaaaaagaaacagaatctagactcatgaggagttaggtaagttcacaggaattagcagacaggaattccaagagcagcacagacctttccgtactaatgtttcaagccaacccacatattgcagttgctgagccacacctagacttgcagcggaaatgtaaagacaagaaagatatttggcttctaacttcccctgagtctgtttcagtttccttttttgcaaacctttatcaacagttgttcataagactttctcaataaccaaaaaactcaacaggcaaccacaagagagggcctcttcacagcatacagacagccacaagatactaccagaaaaaaatagaataagatacatcacgtagatacatagagaggctgtagtggtttatgcagagtatattgatccaacttctagacatggaaaaatcaatatatttaagtagcctccttaaaataagttgacttttcagtaagcagtttggccaactgctagtgtacagtgaaaggaataatttaagatttagccttggccacaactagattctgcaaacatgtacagaagaaagagaatgctttccctttcctttttactacctcctgcaatcagtggtttgcccaagcaaattttaaaaattggagaaaacgggtctttggaagaactagctagaaataggctacagccgagacctcctaactaatctgttgaaggacgtcttctcgttcttttccaggctttcctttgattcaattttgaaaaatcaggcaaactagaagattattattataaccactgttataagtcattataattttttataatttagatttatatgattactgattcacttgtattatgttcttattgggtgccaggtgtcatactacccgttgcctgtataatcagtaacaataacaaaaatcactacaaggttggtagtattcttcctataatttgtagaagagaaaaatttagactcagacaagtgcaaatgacttactggaagtcccacagctgtgaagttgcatggccagggacttaaatgcttgagtctgcctggctgcaatgcctgggctatttcttactatgccatgtttaatgaaactagaatgctgccctacacaataaaacaaggatatgtctttagtgccattctagtcttttgctgggtaatgaagcattaacagcataacccctagaagaaatttccattttttattttcctttggaattatctgccttgaaggttcatagtaaattgaagggcttacacatttcttcttctatgggcagctttataacatacatattttgtatgttatgtactgtattatgggtcctgtgaagtcaaagtccccctgatccatgaatctgacttttccagacagcaaatcacttcaccatccctttccctctagtctttacaattcctgcgtgagccagatgcttcagaaaacagatcctttgtattgaatttccacactgcagttcccagactacggaaggatgacgaccaaattttttatattttgtcatctctatttatgtggatagatatatatttagaacaagttaaaaaggagggaggaaaaaaaacccactccaaaacaaacaacttcctgatctaatacagaggatacaggagactttaccatgagtagaatggacaggatgtccactgttgccacaacagagcttatttgagtagagtcaaactaatttatctgagaggatgcctggttgcacaagagaaagggaagtgaaaagtttgagttatttagaaaagcaaacagttattctttagcaggcatcaaacacttaaactctggcaaacaagtccattcaagagctcatcacacagaaaataactagcaatgcataatatatcttttctatggcgaaagagtaaagaaagaaagaagaaaaataataattttatatctacccagagacaaccatgtttaaaaattagtacattgttctagactattttgtgtgtatatacatatgtgtgtatgggtttgcctatttttttatattttaatttgaaatttatgttaagttcatgagtgcatgtgcaggtttgttatataggtaaacttgtgtcatggtgatttgttgtacagatttcttcacccaggtattaagcctagtaaccattagttattttttctgatcctctccttcctcccactctccaccctctgaaaggccccagtatgtgctgttctcctctatgtgtccatgtgttctcatcatttagttcccatttataagtgagaacatggacctggtgtgatggctcatgcctgtaatcctcgcactttcggaggctgaggcaggcggatcaatagaggtcaggagtttgagaccaccttggccaacatggcaaaaccccatctctactaaaaatacaaaaatgagccgggcatggtggtgcacgcctgtagtcctagctactcaggaggctgaggtatgagagtcgcttgaaccctggagatggtggttacaactagccaagattgtgccactgcactccagcctgggcgacagaccaagaccctgtcttaaaaataaatcaataaataagtgagaacatgtggtatttggttttctgttcctgcattaatttgctaaggataatggccttcaactccatccatgtccctgcaagggacatgatctcattcttttttatggctgcatagtattccatggtgtatatggggtatgcctatttaaacaaaaataataaataagaccatgtgatatattctgtattttaacctgcctttttttttcttttttacttaaaaatacaccatggacatttttctctgaaaaaacaattcattgcttccgagtattccgtgcctagatctacaacagttgttgctgtgcatgttgctccctattacaaactattcatgatgacatccttgtgactgactgaatccttgttcaatacttactgatttccttaggataaattaattaaagttgcatgaatggactaaacaccatgcacattttcaagatgattaaactgtccctggaaacatggtttcagtctatagcctgaatataggaaatgccatttctcccatgtccagtaatactgaatgtttattatactgaataacggaaagaaatcattattttgaaagctgcctgtctattcatcttgatatcatagtaaacggcacagttaatcttaaggaaagactgtaacttttatttagaaaaatgaccacttggtttatttagatgtgaaaagctaaagctggggtaggtaaattttttctgtaaagagccaaagagtaaatattttaggctttgtgggttataagatctctgttgcaaccacagttgacccttgaacaacacggggcttggggcagcaatctctgcgctattgaaaattcacatataacttttgactctgtactcacttaaccactaataccctactgttgaccaaagtcttaccaatagcataatcaattaacatatattatgtatgttatatatatattatgtactgtatttttacaatgaagtaagctagagaaaaaaatgttattaagaaaatcatacggaagagaaaatatatttactatcattaaatgaaagtagatcatcatacaggtcttcatcctcatcatcttcatgttgagtaggctgaggaggaggaggaagaagaggggttggtgttgctgcattggggtggcagagatgaaagaaagtccaagtataagtgaacctatgcagttcaaacctatgttgttcaaggctcaactctgctcaactctgcagtggcaccaaactgtcgtggataatgagtgtgactgtgttccaataaaactttatttacaaacacaggtggattggacccacagagctggggtgaaccaacccctgggatagacccttgggcatggtctgtaaggattagattcagaccaaaacagagcaataatagggtgcatgacggagtaactcttgggaggagaggcagcagttagaggcagtaaagatacgggggcagtgggacaagactttggggtgagagagagtgtccagcgtcatggcagctgttaaggattacagagaaagccttccagagagaaattcactatggtttgggtgggtggctgaagaaattcagctgaggaattgcatcatgtctaaaattaattttaagatatttcctgttttgctccaaataagagttctcctccatgtttctaaagccttcagtaaaatgttactgacaaatgagggagctaggaagggctcctcccaaggagtaggtggaaaaagaaacatccccaggaggtgtcatggtgaatggagtgtctgagaattaatctaggtgagggaatccagacaaactgtgacagcagaatgtaattctgcttctcttctggaattttcagaagtcccctggggaatgctggcttctctccgtctgtaggatggggctatatcgggcaaggtcctggcaggaaatggatggaatgctggagtagaggtgtgacccaggttatgtaaccaaccacgatggggatgatgtcagggactagtgacagtggggagccatcagcaccccaagcatgggaggctggagagggagatgcatcaacaggggctgatgaaagctgcagtcagggaagactctccactctgccccactgctaacacttgtggctctgtgcagccaagagcagagaggaacctagttgggcaggacagttaaaataaccaccgagacctctttttttccacatttgttcttctgcctatggtcctaatgtctgcaccaaatagaagtcagaggacaagcaagactggttaatgaagcccacagaggtcagtctctcaggacatcaagaaagacgatggatttgggggcaagaagttgtcatggagagtaaccagccattttatttggataataaaagaaagctgtggaacttgggatatctatatttttaaaatctaccaaattatggtattatattatttcatgtaatatatgattgtattattatttttaatgtgacaacaatattaggtgctttggacatagaagaagagacagcaatacaaatacaaatcatacaaatgtgatttgcagttgctgcttgttttggttttaggagtctgaaatattttccaacttaatccatgtttagtatctattcaaagtttcctttgtccagaaaaaacctaccaacactaaaaaataataaaatattaaaatagaaggaaaaattattcccactgagttcccctgcaatgatagcaatatattatatttactggtaaaaatgaagttgaatttatgccacttcaaacatactaagagtaactgaaaggtttgcatttgtattctgagggggtgagaatgatccatcttctgcagatgagtcagcttccagggttggtagaggggctaagacaaatgattgttttcttgtgtagctcaaggaatctttgtacgtttttctgttgcagcaaattgcattgctaacattgatcttcatttgcttaaatggatgcattagttcttagaaggaaaggagaggtgctagttaatttttagagtaagagatgtagatgtactcttccaagcattgatttaatcagcttctcttcccaatggaactggaaataaatcgaagtgaagacctgaatttccccatcccattaccttcttgtatgagggattcccttgcaaaaaaaaaaaaaaattgagacagggtcacccaggcttgagtgcagtggcacgatcttagctcactgcagcctcaaactcctaggctcaagcgatcctcctgcctcagcctcccaagtaactgggaccacaggcatatgccaccatggccggctaactaatttttattttgtgtagagacaaagtatactatgtcacccaggctggtcttgaactcctggcttcaagcgatcctcctgccttgtcttcccaaactgttaggattacaggcatgggccactgcacccagacccaaattaaatttttataaagaaatgacattttattgtattggaccctgtgatataatagtagtgggctccgtactttagtgtgagatacacaagtttaggaacagattttggctatttcattgccacctgccaacgttgtaatgatgacacccagaaaaaccccacacctctaaaagtgcctctgtcattagaccacctgctttttattgaatgtttcattcatagattgaaagggggttttactttatcaggaaacagggaattactacttctacctttgctgcaaatcaaactccattagaatttcatcttccttcactgaggcacaaccctttaaacacaggtctttgcatgaccccttatgcaactttccattaatacagtccgatcactcctgcctgcattgcggatatcagttaacatgagtaatgctggccagatatcaagaatgtcaatcaagaaacaaaggaaagggtgttttataattacaaaacccgtgttttataattacctctgtgctacgtgcaatttcctgaccccaaatgataataaaacacagtcatccaattacacagtcagccagtctatgagatctgtgtcctttgaagattaaacttcactaggattgtcctcacatatttggtctctactaatcagaagtttccttgtggaacaattgagcagaaaaacccataaagaagaatttctgttctatagtacagtcactgacttgctttcagagaaatggtagtccctgtggtgacctctaaagatcctccagagagctccctgcagtagactcctacctcactttacttttttctaaatatcttacttctgcacacttgaaagtctctgtacctctcctcttctcattttcaaaaatatgaatttttgaaattcgtatctggctttatgctggtccccagagatcactgttggtttcacttgttcctcaccaacactcccaaggtgtgagttgatctgtcctccccactctctgcaagacccagaagagagccctagtttagtgtttagagatgcatgcagtgtttagcaccttctttgtgtaaagttccctatctaaaagatacctatcagtctgttaatttctggaaaaaggaaggaaatgtcttactgtaagaggcaaattcattactccagtctgtaaaggcaccatttaaataaagctcctgaaaagaacagctgaatgaaacactgcccatatgacttagaagagttcaccaatgtgagaaaggtggagaacttatgctgtaccttcagctgtaggaggaagctcagcaaggagtcctgagctgagacagggatgctcaggtgccatcctgtgactcgatccctttgcttcctgtaagaaataaatcagaaataaatcacctcagacaaatgtgatgctttcagttgcttacatcctccagaacaggcgagccagtcacctgcctcagtaacttatcccttagtcattctgggttggtacacttttactgatatctcatgaaaattctttttattgcttttagaatcaatggaacacaacatccaagagaatcaagaaaatcttttttaaaggcacagctttctaactcaaaatggttttacttaagccaggggccataagatggcaggcagtgctttgcttggctgtcagaggaattgatttttctttttaagttgaatgtctttgcttctgttctcctgttttcagaggccctattatttcctacagttgttcatccagcccattcacctgtgtattctacctgcccatcccctatggattaaacttttacttcctcaactttgtttataaaacacaatatttatatggctacttctgtatctcttacacataccctaactcaatactgaccctggaatactttggagaatagagttgaaggctttgcatgtcacatacagtctttatggcatactccacctcctccttctccccactttctcctcttccttctctatttctccttcttctccttctttttcttttttacaacctttaaaaatgtaaaaactattcttagcatgtaggtcctacaaaaatagaccaagagccagattggctatagtttgctgaccactgatatagaaaaatgaaagtggagaagacacttagattcatgtttttaaaaattaggagggggtaaaataccatacttcttgggtgtttgtttctttgtttgtgtgtttgtttgtttggagagggactctggctctgtcacatcacccaggtgggagtgcagtggcgtgacctcggctcactgcaacctccgcctcccaagttcaagcaatcctcccacttcaaccacccgagtagctgggactacaggggctcaccaccagacccagctaatttttgtatttttagtagagacagcattttgccatgttggccaggctggtctcaaactcccaaccccaggtgatctgcccacctcggcctcccaaagtgttgggattacaggtgtgagccaccgtgcctggccgtaaaacactatacttctaaccacatgtatctgagtctgaattcgtagaacatgaatcaaaattgcctagaaatgcttaaaacaaagaaagaaaatcaatgactcgttgccatgaagacttagtaaatttggacatgaatctctaatatgatcatgtgaggttaatgtctcatccaaaaggaagagagctgtataaagtagaagtggatacactggacaccaagaagatgcatccttctgtgcaaacgcactgcctgacattagcgtgtggacaggactgatgtgatgttattgtgctagtgattaaagtcacaggctgtgggatcaaatccttgctcaaccactgactagctgggaggtaaccagtcttaagctctctgggcttcagtttccacatctgtgaaatggctgtcatcattgtaaccacttcctagtggttgtgtgctgttgagaagattaaaaatgcttgatacatttgggtaatagaatgtgttaaagttttttctttttctttttcaattttatgtgctgcaaaaaataataacaaaaagtgattaaaaaaaaaagaagaagaaaagaaaataactgtgtttggatgtgcctacaggccgcccatcattctctcttccggacaaagtctaaatcagtttttccatttgggccagagcttcctatttgctgctatggagactgttgtggaatgcctggagctgcttaacataaggcttaattacccatggcctgtaagccagttccagttccccacctcttttttctttatttgcctaggagttaggttgtgttgattgtttgctgtaactgtagatgtcagagctaaaatttcttctggcatcctctttccttctacctcaagtccttaaaatatgtctgacacatggaaatgctccgtaaatattagttattattattgtgattactctttttgttttactgcaaaatcaatgaaaggaaatggataattttcttctgagagatcatactctagacgaaagatgccaaggtgatggaggatctgaacctggatgcttcattctatataaaatataacatgtgccaagttcttgactgtgacagcttcatggctcagaaggtggaggaagtgatgagggcagcagctgctatggaccatcttgtcttcagccaaatatataagaggtgcatcacttttcttccagctctcctcctgtcactaaatttaaagaatctaagtatccaccctctggcaaaaacagatcatggaaaagaagcaagtaactgctttcctgctgaatttctcttagggccattgactgatttcccctgggtatagacaggttactctaggaacatggggtcatgtatggctgtgccatttttaatcatgccagctctgactcttccattaactttgtaatttgaatatgtcacatggtagttatgatcctccacttcctcaccaataaaatgggagtaatagcgacacttccccacctgtgcagaaggcaaaaatgtaaagaagagttaaaaagcactcgacaagcccaagtgctttgtaaatatttaatacttagtagttgaggtaaatgtcaggagaatgtggagcccaacatgaatctttttgttatgacagctctttagatgtgtttaattccccagtccaaacacagagaaccctgaacttttctgaccctttctccttgtcttatttttcttcttctactatgcccaaatatttcccatctaccattaaatgacagttcattcgaattcctctacaaaagataattttagtttattaggatcctgcatgggctgctctccactttgagttcctaaatgcttgtacagaaaaacttaggtttcttgggaaattcccttttttgacaaaaacacctctttgtgtttgaaaaggactgaatgccattgtctgagaacaacccccattgttggaagtcctcacttctcattaggctagctcgtttccacagaaaggctcaaataattttctttcaacttcacaaccctactgggcccttgaaactaagcagattttgcacctgttcccctgaggaaggtttgctgattgataggaggggtctaggtaaattgagtataaataaacaggtaaaaaagagaaggcttttaaataatgcattggggtttttccagagcaactctgttttctcttgaaattactagagattttcagtaaacatttgcctggatacattttcacagaggagtttgccgcattctgaggacctcattggctcccactgttcattgctatgcccatctcacacccacttcaactgtcaaacagaagaacaattcttattaacagtgatttgctttgcagttttagtttatttctaaattgcagacatggttgatgagtgaagttgttttagtgactgtttattggaacagagcagagaatagagtcaggaattcttgaggctgccatgtgtatggtgaaaaatagaaataaaaaccatgccattttgcttaaaaagaaaaatccccagaaaccttaatggtgatacatgcaatctgaggctagatagcttgtatttgtagtgtgctttgcaattttcataggacttttatgtgcattttcttctcagctttaaagtacttgttttgaggtttttggttgataacctccagtaacagctgtagaagatagtgctaggatggatgattgtgagttatagggaggaacattgttacactaagaaggaaggaaggaaggaaggaaggaaggaaggaaagaaggaaggaagggaggtaggtaggtagaaaaggtcaatgagcctctctaagacttgctttccttttctaaaacatgaagataataataactcttaccctatctgtcccgtaaggtcttcgatcacctgcagtagactgactctacattaaagtattgcttcatccaaagagtactttagaagctttagtgggtgttattggttacattattatgacttaggaaaagttgatatcttcatctgttcaggctgccctaacaaaatatcataaactgtgtagcttatatacaacaaaaatttgtttctcatgattctggaggctgtgaagtccaaggcagatttggtgtctggtgagggcccacttatggttcatagaaggtgtcttcttgctgtgtcctcatagtagaagggggaagcactctctctcaggcctcttttacaagaatactaatctcattcatgaggtccttatgacctagtcaaccctccaaggaccccatctcctactgctatcaccctgggagttaggatttcaatatgtgaatttggggaggatacaaacattcagaccatagcagttggtccacccaaaattgtttcattcactggcctactgtgctataaagttctcactttgggaaaataacacactaactctatagcatttatggacatatcaactggattggctcagccacttatatgttgccttcttaggagacctaagaagagtgaaaaatgggattatacattatgacaattgaaaggggtggataaaagctctgaattggaggataacagaaaagaaatgaggtttgcattgcaaggtaggtggagagcatgctgaagccagacttcaccaagacataccttgacatggctggccccaggtttgccctcagccatacaaatcaacagctgctgtgttctcctaagtgactcctgaactctaatctctgcatattgcttgtgattagatctctctgagcttgttttggttttcattttcttctatcaaaaattgctagttcataagatatgtcagagttggacacaaattacttttcttcctctcttagaaatgacaaatgacttttcttcctctcttagtatgttccttagaagtaacatacactatacagtcatgagatttctttgaactgagaacaaatatctagctgtctttcatttctttggtgcttcatagtcgacaaagtgttttttcatgctgtatataatttatttagtgcagtaactctatgaagtaggtaaccccaatacttttaggaaaattaaggtaatacatacctaccttgcaaggttgagaggattaaatgggacaacatttgtaaataacttttcacaaccccctgggcatagagaaaagtcttatttttaatacccatattttatggatgaagaaacaatttcaaaggatgtgtgatatgctcaaggtcacacaacaagttgaagatggatctatcacttggactgccgctccatcatgctaatatatcacgttgatgaacagtcaaaccatttgatatttaggtttaaattccatgttacaaacttttgaggaagaaagtgagacacagaaagaaggaaagagagagagatggagagagaggagtttaagaacactgatgggctaagacacaggtaagacatgttgaatacctcccccaggtgtgattaggatatcacgtaaaaatgatgtgtgcctgtggctcaggtgtggttatgtaatcaaaacggctgtgggaatgaaatgcatttaattttcctccagcttcctgtttctaaggcttcagtgtttgagttctgccacaccagcctttgcatattaatagacggttggcaatccctggggagcccagggtgagggagaggtcctctgcaataaaatccaagctggttcagttgaaggtatttgtgaagcctttttatatccactttgcttcttgacctcccagcatacatcacggaaatgttatttccagcacctgaagctttggtctccagcaaaaccagctcttgatagaattcggcagtaagcaggttcatggtcattggctccttgttattctttttggcctccttgccatacttttagttctcttcactgatacctgcctgttgcagagtcttacgtttgtctaaggtctcttcagaatatcaacttttgtcctgggccttagctattatctctccaattttccatgattcaccagttgaggggtaatatgggtaggctttgtgtccccacccaaatcgcatcttgaatggtaatccccataatccccacgtgtcaagggagaggcaaggtaggggtaattgaatcatggggacagttctgttctcatgatagtgagttctcataagatctgatggtttttataagaggttcttcccactgtcactcggcacttctccttcctgccgccttgtgaagaaggtgccttgcttcccctttgccttccaccatgattgaaaatttcctgaggcctctccagccatgctgaactgtgagtcaattaaacctctttcctttataaattacccagtctcggggaattctttatagcagtatgaaaacagactaatagaaggggatactttcaaaagaacagagtttacaataaaaatacttggtgaactattgtgagccacccatggtgctgcttgaaccaacctcttcctgcctcctgcctgttcttcctccttcctaggagaatccaaagatggctcatttgttccctggtgtattagtttgccaaggctaccaaaacaaaataccacagtctgtatggcttggccagcagacatttattttctcatggttctggaggctagaagtccaaggtcaagatttggtttcttctgtggcctctctccttggctgcagacggctgccttcttcctgggtcttcacatggcctttctctgtgtacatataaccttggtgtttcttttatgtgtgtcctaataacactttataataaggacaccaaccacgcagattagattagggaccaccctaatgacctcgttttaacttaatcacctctttaaagaggctgtctatctccaaatacagtacagttctgtggtcctggggggttagggcttcaacatataaattgtgtaagaggtggcacaactcagcccacaacatcttgtcaccttgctcccttcatgccttgctgcctccctttttggtttctttggtgtcttgttttccattcatctggtctcacttcagggctccaggtccccttatggaagtcccttgtgtcatcctccaagccactctcctattctcctgcaaaaatttgctgacattcaagctgcctttggggtttgtgtaaactttgtggcattgacctcgggttgtcacatgcccatagcctcatctgctgacttgtgctacagccctcttgcaccagagcaatgacacttttcataagacacaaaatgtacagacttgtattctctttcttaagtgcccctaagtagtttgactgcttttcctgactcattcttcctattttatgtcctctccttcttagaacttcacaagttcttttatgggctggtttgaaaaacagttgagatgtgttcacttccaaagctttctcatccacttatagccagtcatcctttaaccatctggaccctctcagaaatctctaagccggagggctctttttcctctcaagactttgcagacagttaaaaggcagccatcatccagtttagtgctggccacatgacatagatgctgcaattttgctctctttctggaggaggttccaccaagctgtgtttcagcatgcatcatagggcttcatccttctggttctggggtaaaccctagattgaaccctagaattgccatctaattgttcgataacccaggagcattatttccatcggtcttatcctcttcatctataaaatggtgataatgacacctacttcttagtcttgctgtcagacatgaagtaaggtggcataaagcctggcgcatagcaagcattcaataaatgttagctttcgtgacaattttgcaaataaagctttttttttttttttgagacagaatctcgctctgtcacacaggctggagtgcaatggtgcaatcttggctcactgcaacctctgactcccgggttcaagcaatcctcctgcctcagcttcctgagtagctgggattacaggtgcctgccaccatgcctggctataattttttgtatttttagtagagacagattttcaccatattggccaggctggtctccacctcctgacctcaggtgatctgcccacctcggcctcccaaagtgctgggattacaggcatgaaccatcgcgcctggcctgcaaataaaactttgtgacaggcaggaacttcttcggtcataagctttccttctcctgtttgtgctcctctataatttgcattaaacaaaatatttattgaatatctgttatcttctaagcactgcgttaagttctttacatttgttgatcttatttaattcctcaccataagccttaaggctgatattattactaacaaaactttacaatcctgagaatttagccttgaacaagacagatattatacactcctgtcagatcttacaataccgtgagaaagtcttatgttaaactaataattataatacaataattatagcagcctactcttccttgaggcagtacctactttcctatagttattactggatcttggaatttaaatagagtttccttactattgctaagcactacatgttgtgaaattatataatcaacttttgcattccttaagagtcttatcaatgaaaaccctgaaatcttagagatggaaacaaatggaagggatatggttgtttgttatgtcagagctaattatttgtaattactttgtaagcaggagataaatattcatgcttcattccttcttttagaagggaccaagtagtttggaaatctcagacaacatcctgataaaaggcagttgaagaaagacaaatattacttggttggcttaattggagtttggaaaagatctattgcttggagctccagaatcattgagcctgggccctgtaattccacagagcagtgtgctgaacacaaaaccaatgttgtatggaggaaaatgacacagacgcctatgcgtggaccaccaattgccagccaaggataccttttggtgccctcaatttaaaaccacagccagatttttaacatggatagaccttctcattcatacaaagtgatacctcaagtgtgatgactcactctaggaggaggaaagaaacagactactcaatgcttctgaaataaattattgtaatattttaccatttcgtgtttgttagaaaggctatttgtctacctcatacttggcatatacacgatttgtactcccagtcagggcctgttgaatgaaattagtttcctctatcaatcatccctgtgatgtctgttacatggactagcattctggatactacctaatagcaacagttctaatgaaaatggtctaataatattgctccttgcaacagatgtgttttatcccaaagtataaactccttaaagcatagacaggcagagttggctcatgcctgttatgtaagctatcatgtcctttctttcttttctttctttttgttttttagatggtgtctcattctgtcacccaggctgggctggagtgcacagcgtgatctcagctcactgcaacctccacctcgtgggttcaaatgattctcctgcctcagcttcccaagtagctgggattacaggcatgcgccaacatgcccagctaaatttttgtacgtttaatagagacgaggtttccccatgttggccaggctggtcttaaactcctggtctcaagtgacttgcctactttggcctcccaaagtctatcatgccctttctattgagtggccgcctgcaagtgtctcaaagaaatgtttattacctatttatagaatatttctttgttcaaaatagaaatgattaactcttaactgaagtaaatgatataattacctgaagaacagaaaggaaacttttcatgctcaagaaggcagaacccacatcctcagagtgaggtttctgcttttctggttaaacatgagtattaactggaaaagtctactttaaagcatgagctctggtaggcacagctaacattattttggacaccttcactttattttaatcataaactgtaatgctggcttcctcttggttgttcaatattgcagaaatgagtcgagttaacctacaagttgtaggaagcatttgatgacagaaagagacttgaaaaagtagccgatttacccgcaagtcatatcagcactttgaagaaacaaacactgccacagtaccctgttaaaagtgtcagtcataaagctctttacaaaggtattgtgcctccaacttttaattttcataccctcatggagagataagcatcctcaaaagagcccaattgccttatagggctttcaaaggaagctccagttttgaaacactgctcactgcttatacactacccccattcccatgaaataaaattgtcatactagtcccctttgcagaagttatatagcattcgggaatactgaatgttttctgttgaagttcatcttagagagcttaaaaattcaacaagtcataatcataacccagaattaagcccatggtatacagcaacagctggggtctgggtgatagagaggaacgagttctgccgtagacatctgcaggtttggctactggttctgggtctggtactcacttgctaggtgattcagggccagtcttctctcagtgagccccagttttctgcccctgccatgtaaaatgagcctgatatctgcatgatcaccaagatgttttcctgcactgacttcctatgactctgggcaaggcaggggagctaaccttttctaatgaaatattaagcaatcaggactagacgccttggaagtcatctcttcaagcccagtccttccaggctttcatcagctgacccagagaggtgatattgttcctattgatcctgtttctaatgctccgccattgactagctttcacatctttcactctctctgaaagtaaagagctgctgcccctttttacagaacacgtgtgtttcctgtatattgtggttgtatactttctttgctctgacttgtgaaaagaaagaaaaaacaagagagctaagaattctttttcttttctttcctcttgagcaagctgaaatgggcagggtataatttaacttggatttataaaacggcagtttattcatttaactgaaaatacttgtactttttcttcttagctattatttattatttgtttaattttttattattatacttttttgagacaaagtctcactctgttgcccaggctggagtgcagtggtgctatcttgactcatggcaacctccaccttctgaattcaagcaattctcctgcctcagcctcccaagtagctggaattacaggtgcttgccaccacacccggctaatttttgtatttttagtagagaccggggtttcaccatgttggccacggtagtctcaaactcctgacctcaactgatccacatgtctcggcctcccaaagtgctgggattataggtgtgagccactgcacccggccactattatttattaagcaaacccatggcaggcactgtgctaaactctctccctaaagatacactatttaaaaggttcaaatcaccatgaaaaataggtgttattgttcccactttacagaagatgagattaaagttcaaaaatattaagtgacttgcttagggttactaagcgatggacctgagattccgattcatcccaaagatcctaatcacaatatgtttaaatcattttgaagagacgtaagaaggtgtaatgctttcatttgtaaaacagtttgttgtaaaatcaaactcattttgaggtatgttttaagcttaccacttgaatatttaaatttcattagaactgggcctggcacagtggctcatacctgtaatcccagcactttgggaggccgaggagggtggatcacctgaggtcaggagtttgataccagcctggccaacatggcgaaaccctactctactaaaaatacaaaatactctacaaaaatactaaaaatgcaaaaattagccgggcatggtggcgtgcacctgaaatcccagctactcgggaggctgagacagaagaatcacttgaacccaggaggctgacgttgcagtgagctgagatttgtgccactgcactccagcctaggcgacagagcaagactctgtctcaaaaaaataatcataataaaaataaaaaataaataaaatttcattagaactgttcctggcataggataggtgggtacttaatttggttgaacagatacttggatttataaaaatgagatttatgtgtgggacatcactaacgggttgttggcagaattatcagtgcacctgttgtatgttgagtgagacaactgctttcgcaggctctgtgtttgcagttgacctgatgccacagtcatgtgcatggtggctttaggagcggcagttctggtaaagtcttggtacactaactcacactctgtccttaaaaatatgttagtggaaagactgcatctaacaaactgagtgtcccttttggcatgtttttcagtggcatcactatcctgtgaggtcgatggtaaattaggcatagtccttcttctgctctatcagctgctctgaaagcaacaggactctcattttcaggctcttagacaaacttggattcttgtaggcagagcatagagctattaatcaaaatgacagcaattgtaattatagctacatagggaaatattatttttaaagttaattttgaataatcaatgcatgcatggagtagagaattcaacaagtaccaaaactctcaccctcagccctcacttccattcacccagacagtctcttccagaatatttcagagatatctagacatatacaagcacatatatattcgtacattattttttctcacaaggagtaataacatatttgaacaattctgtacattgcttggaaaataagattttctttaaagagtgtccagcacatacagacctgttaataaatattttgtcaaaaccacagtgaaataccatctcacatctgtcagaatgactattattaaaacgtcaggccaggtgcagtggctcacgcctgtaatcccagcactttgagaggccaaggtgggcggatcacttgagaccaggagttagagagcagcctgggcaacatggctgtagaaaccacgcctctgaaacaaaatacaaaaattagccgggcctaatggcttgtgtctgaagtcccagctacttgtaaggctgaggtgggaggatcacttgagcccatgaggcagagttgcagtgaggcaagatagcaccagtgcactccagcctggggacagggtgagaccccatttcaaaaaaaaaaaaaggtcagtaaacaacagatgctggagaggctatggagaaaaggtaacatttatacacggtttgtgggaatgtaaattagttcagctgctgtgggaagtagtttggagatttcttaaataacttaaaatagaactaccacttgacctagaaaacaaaatgttctaccaaaaagacacatgcactcatatgttcattgcagcattattcacgataactaagacatggaatcaacctaggtgcctatgaacggtggacaggataaagaaaatgtggtacatatacatcatggaatactatgcagtcataaaaaagaatgaaatcatgtcctttgcagcaacatggatgcagccagaggccattatcctaagtgaattaatgcaggaacagaaaaccaaatgctgcatgttctcacttataagcgggagctaaacattgggtgattttggacataaagatggcaacaatagacaatggggactactagccgtgggagggagggagtggggacaagggttgagaaatcaactgttgggtactatgctcagtacctgggtgacaggatcatttatatcccaaacctcagcgtcacacaatatacccaggtaacaagcctgcctgtgtaccccctgaatataaaacaaattttgaaaaaggagaaaaaataataaatattttgtttaaaaaatacttcacagccggacacagtggctcatgcctgtaatcccagcactttggaaagcagaggcgggcagatgacttgagctcaggagttcaaaaccagcccgtggtgaaaccccatctctatcaaaaatacacccctgtagtcccagctactcagaaggctggggtgggagaatcacttgagcctgggaggtggaggttgcagtgagccaagatcgtgccactgcactccaggctgagcgacagagcaagaccctatctcaggaaaaaaagaaaaaataataaataaatgaaaaatacaaaataaatcacaaaggcaacgtgcaagagggaaagggtgggagaaggaatatctgcatagtaataccgtaccacagttacactcagaaagacttgcctaggaagccagggttctaatcttgtgtgaattcttccggtctaggataggaagctatatggtatagcaaaaagaccatagggcttggagtcaaactcacacagaatgtgttccatatttattagcccagcaatcaatgaactgaaaattctcataggcaaccacacagcctggtgctgagcacatggtaaattttacacaggaatgataaaaacttctgctctttcatgaatcttctctacagtagtttggctaaatttcaacttgggtcttgttgcaatagtctacatatgatgaaaaaacacctggtggtagttttcctcttctctgaaagcaatggctagcatttatggagtattactattgctaggcactgtacgaagcactgcgccaatgtgatcacatttaatactcatcacgacccttcaaggtagtgactattcttgctattatctttaggccagaaactgaagagaaacataagatgacttgctcactgttccctcaagtaaatagactctcatctggctgaccccaacgtgtctgctcctcacagtccttgcctgcctcttgtctgcatcaaatggtcttattctctgtagacataacccttggacaccccagaagagaaacggagttattaccacctcagctcagttctggcacacaccccctaaagctttaggcagctttttaatgcatgacaactacaaataacaggacaaggcagcctttgaccccacatgtcagagatcctgtattattctttactgcattggccagcaggcaagagtttttactgaggtgcattttctggtttctcttacttctgtctcccaaccaacctatcctggagaacatccttgccttctaatctcttgccatcacagcaggcttcctataattcctgcagcataatgcaaaaagaaaggagggaaaaaaagtgttgactgagatttctggcaaacattatttaagctgaagaggagcactgcagattgactattagacactactagactattagtgctagtaatgccaggatgctttcttgtcagcattccagtttcagatttttgtgactgtttaattaccaacactctcccacattgccaggatgtgcctcttcaaaaccctactggaagttcagtgtcgattacaaccagctacatgcacttcctacattgtagatctctaatagctttctgtattctatggcactagcagaaatagtccagataatggctctaaatttcccttttaaatcttgtatttttttcccatgtaccatgaaaacagaactgttttctttctgctgaagagtaattttcctggtaatgatatttaaacaggagtctatttcaaaatgtccacattcatctcacatgttatctgaagattcattcataattttgtttagccatttgaaaaattgtgggaattacatatttgatgtcaatgttgaaagaggagtttaatccacagagggttgagtttgtcaagaaaatagcattgctacagaaataggcggttcttttgtggagaaacaaatttaatccttatcccaaaaaaaaaatgtatcctctccagtcagcaatgtctctgagaatgtctaggaaactggagaagataatcttagtgctaaaataatattcaggtttttaaatggtatctaaggatttcttcagaaatgtatgtgtacaaaaatagatttttcaaaactgaataaacatagttcttaaacaatgatgaggaaaatagttttgcttatacggcaccagcaaatggggaaaaatttatttcctgttgaatacatgggagaaacagaaatcctcattgaggtgggaagggagagaggcagtcgtttcaatatattgagcactgaacacccaggcttacctcccacatggttatctgtcagattgatcagattggtttgtaacaagtcaacagtgataactttatgtttatggtggcagtgttctaatttattatcagtactaatgataattatcaacttcatacattttgctaatgatattgagaaattttcaaatagcaactcttaagaaagctctcctgtctggggagatgaaggagttgccttaaggtaagaatacagattagacagtatcttaaaagtcctttcggccctatgttacgatgaggaatattgtgtatggtggaacacttccacgggcataatttaatctgtcctttctctgttgtagatactgctgccaccaactcatttccttcaatcctcttttattaggttggtgcaaaattaattaattgtggtttttgccattactttcaaaaacaaacaaacaaagaaagtggcttccaaagctgaaatctcacaggagattagagctttgtacacaacattgtgagctaatttgcagctgaatctttaaaacctcgtgcttcctttccatcaaattactcaaagtttgggttcccctaaaagcagagtctatttgagacaaggacctaggtgcaggtagttgatttcggaggtgatctcaagaagtggaatgaagggcagagagattgatacagggaagaatggagagtccttaaagaatgaatactgagctggttaccactttgggcaactggggtggaatctgactggggacaatttgaagaattgttcagaatgcacttagaataatgatgccccccacctcccataggtttgaaggctggagcattatccaacaacccctcacctcgcccatcctctttccacttacctccttcttcccagcctcacattaattcctccatacttggccaagtgggttctgcagttttgcagaaagttctgaagcagaggagctgaggagccttaagacaggaagtcctcactggttaaaggaactgctcatcacatctgcagctaaaataagatgtggttcaagtcaggagtggtcaaaggcatgggccatggaatcccatgagcagctgccacatttttaattgcttgtactcccctaccctgcatctccacctcctagcctacttccctcctgttcacactctgccttgtgcatttcacccacagtcttccatggcccctctaagtcagcttgcctctctcctcatccccagctccatctccctcctgcatgcctagttcaacggtgcaattctgccaccctggcttttcttccttcctctctagctaaaatcatctttgtttagaagcctcatctttcttatctggctttccatttcattaaaacaacaaaaacaaatgtagtttccaaaggtcaaatgttacattagattagagatttgtacacaaccttgtgggctaatttgcagctgaatctttaaaatctggtgcttcctttccatcaaactactcaacccttcttccccactccatgttccctaaaagggaatctcaactaaaaatagctttcagtgtttgaaagcagtaatgtggtgtgggctgaggagctcaacttgtgcatgcgtggagacaactttattctgacagtctcaggagacacataccccttacctggcaggtgacacaagatgaagggctctgtgttctcttgcagcactgaaggcatgtaatggaactaattaaagcaggcaggcctgggcccatggctctcactcatctcaaagcccaaactttgtcagagtgtacaagagctgggactggccatattacccatgtgttgggcaaggtcccctgaaacagggctcctttgcagagtacccagtttgaacctacagcaaaaaggctggcacacctccaaagccttctgctctcttccataggtttcttctgtagcttcagagaccgaaaagatcttggcagagcctgaagtaatctttttctttcatggagctgagtttcagactctctagctctaactccattaagcatgcctcccttgagttcccaacacagtctttgcttcaatagcattgctaattgggatgtagtataattcatctgttcaaatgtctgctgccttccccactagactggaaacaccctgtggcaagagccacttcctagcaataacaatagctgccgtttactggacatttaatatgtgctaggtattgtcctggggttctaaacacatttcatgttctttatggtagtcttgctaggcagatattatcatccccttttgtaaatcagaaaatttgagagaggtcaagtatgcccagggatatacagcttttgaaggacagaagaggaatttgggcccagtcgcctatctatctgaaccagtgcacctaactggtgagctgtacagccccttcactgcttcagtatatgtgtctcctggccaagaaaccaactagcagtgaatgaagggatatacagagtgggcttagcaaactctaggctcatctcacacatttatttactttgtgcatttggaaataatgccaatcacactcatccatctacactgaagaaatgccacgttttttgccttcaaaaaataattttaattggctttttgtatagtttgtagcattggcatatttacttttagtcttttctaagtataaatcgtatgtagtatatatgtgtatatgtacgtatgaatatgcaatatatatataatatgtcatatacagctcctttaaacctgctttgttcatatagcaacaacataacaccatgagtattcttccaataaaagtatcattgctgcaatatagtcagaacaagtgttgtgattagataatcagattggaagggaattttgaagtcattacacacctttatctaaactaatggtctccattggaacagaacagaggactcagaaataacaccgcacatctacaaccatctgatctttgacaaacctgacaaaaacaagaaatgaggaaagtattccctattaaataaatgatgctgggaaaactgtctagccatatgtagaaacctgaaacctgaaagaaagccatatgtagaaacccttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagccaaaattgacaaatgggatctaattaaactaaagagctcctgcacagcaaaagaaactactgtcagagtgaacaggtaacctacagaatgggagaaaatttttgcaatctactcatctgacaaagggctaatatccagaatctacaaagaacttaaacaaacttacaagaaaaaaacaaccccatcaaaaagtgagcaacggatatgaacagacacttctcaaaagaagacatttatgcagccgaaagacacatgaaaaaatgctcatcgtcactggtcatcagagaaatgcaaatcaaaaccacactgagataccatctcacaccagttagaatggcaatcattaaaaagtcaggaaacaacaggtgctggagaggatgtggagaaataggaacacttttacactgttgatgggagtgtaaactagttcaaccattgtggaagacagtgtggcgattcctcaaggatctagagctagaaatatcatttgacccagcaatcccattactgggtatataccgaaaggattataaatcatgctactataaagacacatgtgcacgtatgtttattgtggcactattcacagttcactattcactattcacagaaccaacccaaatgtccagcaatgatagactggattaagaaaatgtggcacatatacaccatggaatactatgcagccataaaaaaggatgagttcatgtcctttgcagggacatggatgaagctggaaaccatcattctcagcaaactatcacaaggacaggaaaccaaacactgcatgttctcactcataggtgggaattgaaaaatgagaacacttggtcacagggtggggaacatcacacactggggcatgtcatggggtggggggcagggggagggatagcattgggagaaatacctaatgtaaatgacgggtcgatgggtgcagcaggccagcatggcacatgtatacctatgtaacgagcctgcacattgtgcacatgtaccctagaacttaaagtataataaataaataatttaaaaatgaaaaaaataaactaatggtctcaaagttatttttaactatgactcattttttttccctaaggaaacctatataaaacatcaatagctagcataaataaaaaatggcattatggttatatttatatgaatttattttgtaagtacagctttgtcacatttactcattaaaaagccagccaattagagtagtaaggctcattcaactaggcagcaatttttaactggaagttaggataacagttgaagttttatgtaagcctcagtatcttgttttcattgtgtaggagtcaggggatcatggtccacacaggtatttgtaacatcattgtttaacagatgcccctgcaattagctaaatacatgccacaggagaagcttgatttcaagtctgcacaaaaatgagttaaccttgtagcagcacccaaactttggtgttccaacatatccaagttttatataagacacatttaaatgcatgggtgccactttttcttaccattttttaaatagtcaaaagtaaattctcattaaaaagtgaaatcttaaccaaatatgtgtataatcccttaaagcatactttatagaagtctagggttccatgacaccctagggttttctgaaattcagctaggaaatcactgatttagctttccctaaaagtctaacacattaataaaagctgcaaaacagggaggctacccaggctgtctcaggaatacgcccaagtatttaaatcccctaatgatagtcagaaaattccttctcatgcctgagttgagtttcctaagctggtgcctaagcttagcatagtatatagaaggctcttggaaaagacttgttgactgacagatggaggctcctgtggaagggtaaggtaggtggttggccactcttcttctcaccaaataaatatgatctagtctcccactcactcctgacttggtactgtgattactacgattaggcagcatcattttctgattagcccaacatcctgccaaaacagtaatgacttctgcaagtcacctctgcatagaaaacatttggcttgatacatttttacagtgtgggtttgcaaaagatactgatcaatgctcttcatagcacttatgtgaagctctaatacttctcgccataagtcagtataggatagaggtctttgcactgggtcaggcagaaagggaaagccggtaatttgagttgtccacttgagccagtaattgaatgttcaatagttgtctggggagttggattcatttgcggcagatgaaaacaggagatggtaggcagatctgaggcatacggaaaagactcagttgtcagaatagggtcatagggccagagagtcaggaggacttgatactcactggccatgcattgtgctgaaggcacgtaaatctatcctttctggcccacattagactcgtgtgagaacagggaggatactgggccttcagacaggggccaaggagggagctggagggagaggacagcctcaccatctggggtgccagggaaggtctaatatgctcaggattgggctgccccaaagtgcatatgggaattttctccacagtcttatgacataggttatttatgttagatagtgagcttttcctcatcttgctgccagcccctttgccctaacccatgtatttactgcatcaccgatcactggaaggtttgatggctgcccaggcatttaagagaatttggaagctgtgttctaatcctggaaggaagtataaaattttaattgaactatgtagacagtttgaagtcattttacaaataggaaggcgaggctttttgagccttgcccgccattcatgtaagtggaattcttcatgagagacagaaaggttaggttcattccatggcatgaggactgatgtgagcaaaggtgaaatctgggagagtaagtgtagtgagtagagcagacaccagcacaccatgttggcttttctgtcttccctgtctctctttccctacatcctggtttgtgcttcctggattcacctctcaaataaaccacctgcactcaagtccttgtctcgggttctgcttttgggggaagccaaactaagacagcgagttcaaccttcttcagctgaacgtcatagctttgggggagaattacatggagcaatgatggatggcaaggatacccatcagatcagccatctcaacctgggcaagctagacagactcagaccaaccacttgtccatgcttctaagaaactaggagtgtgcctgaatagaaaatggagtttattcaatagtattaactcactcaatcacaaggtcccacaacaggtcatctgcaagatgaggagcaaggaagccagtccaagtcccaaagctgaagaacttgaagtccaatgttttagggcaggaagcatccagcactggagatagatgtaagctgggaggctaagccagtctgaccttttcatgtttctctggctgctttatattctagcgacactggcagctgattagatggtgcccacccagattaagggtgggtctgcctttctcagcccactgactcaaatgttaaccttctttggcaacaccctcacagacacacccaggatcaatactttgcatccttcaatcccatcaaattgacactcaatattagccatcacaccaggttaatgagttccttctctattcagtccctctgctgttggacaaaacttttaccttgctgtttgcttctgagatagtgagagtttgggtttgaagcagatgctgatcagtgaccttcaccacactttcctagtcacagtatcacagtcgctctgaacctaccaagtcaagccaagagacagcatctttcctttttgtgtgtgtgtagaattgacactcttgccttagtgtttgtaacatttggagtttatagggaaccacagagagaaaacatactctattttgatttcttcctggtagttttactttctctaaactttttgtttggttcagtagcagcaaagtacctcctactcagccccccaacaccctcacttcccacctgtcaaaccaccccaagtccttatttcccttccccttccggaagcagttaggaggaagggggtgtggtcagaaccagacccacttctaatattttcagagcccaaaacatgagtatgaatggaggtccatatactataggtctaaatatgttaacattatcaatcaaatttacaaacatgtaataaaatatatttggccaccttctttgccagagcctaatgaagagaagttggtaggagaccagggggagaagtggccctggcctgaagcccatcccctcttctcttcccacccctggttccataggcactgaaacatgaatcctgctcacatgtgtggacagctcagctcgcaagctctatccttgccctgcccctgtaaacgtggctccctttgccctcctggagcctagaggttttctgaaagcagtggcacagtgaccctcaggaggacagacagggaggacagatgctcacaggccctgggcccaagcttggagcctttgcatccttcaatccaatcaaatcaacactcagtattagccatcacaccaattagacaattccagggtgcagaaggggaaggtaggctccaattgggcctatccccttggcctggaggactctcccttacatgggaagaaagacagccagcaaaataccagagcacagccctctaagaataaaagggacaaaggcctccctagcctggttcaaagggcaggactgctcagggctgatggacgagacacatctagtacctcttttcttccatctcaagcctgtccgtggcactactgtatggctcttttttgaggaaagagggctttgtttttcattttatttttgctttctctaaacatgccctgcagatccttcctttaacagtgtggggactgaacaaacagcttctgaccctggccctgtttctgtatctggagcaacacaatagaacatctgccttgacctggactgccttccactctgcacatcattcttggccatttcccatctgtgccaggagaggggtgaagctgtcaatacaaatcaactgtatggactcctgcccgttctctgctgcaagggctggaagcttccccgtgatgaagaaaggcaacctcagtgcttcggaggcttagcactatttgcccaccccagaatccatcaggaaaactgaaattatagagtacattgtggcaaagttggaacaaaacaacaactgatgagcatgagtttttgtcacattccctaggccactggagtcacccaagcattccttcagcttgggctgtctctctgcaaagggctctgtgttctagctctcgactcgtgcagtgggagaagagtcttaatatacagcggcccatttgagtggtgttcaatgggctgcaccacagactctgggatagcaggtgatatttcatatcgcctaggcagcactgaaaggaacattaagctgcatttccattatcagtgaggtccgtagtggcctgaggatcagaatccgagcattctaatcagtctgcctaatattttcctgggcagcctcctacaagcctatgattagtttgcagaggaagtctgaaccacctttcttaagggaaaagtgatctgcaagaatgcctggagcgtgatgagccaaggagagattcagtgacaagttaaagggccttgtgctatgaataaaaggatcacttctggggaacttaaggatttctgcagagaggagtagctcatttggctggagtactaaaatccatgaaaactgctgaaagaccagtaaggaaatttctgttcagagagaccaagattctagtcttagcctttgccctcatgtgaattattttgcagatcccaaaccacctaatactgctagaaaaaaatcttctatttcccatgttaaatcatgaaatttgataagtttaggttgaagagaaaagcaaggacatctaaactgaataccagtgtgatgcttagttcctctgcaaggcaccgccaagctgactttcatcctccatgggacaccttcaaggagagggaactcactgcttgtagctgtggacatttctgattactaaaagttctcattagtatcaaaatcctgaacatcaagtgtctaaaaacagagacctatatcttaacctctagcatcctccccaagtgagggaggatgtgtatttgcaaagtcagctgctggaatagatgtcatactgcaagaattgaccttcacaaaaatagaatattttgcctagaatgttggctaaggaatcagttttgttttgtgtgtggctgtgtgaagaaaataacattttattatgtgaatagtttcaatagggataaaaatttcaggttactaatgcatgaaaacactttgaagtatatttcaagtgaaaattgtcaataatcatgataataataatggaactctgcacagaatatattcttctcaggcagtcagtctgtggcagacatgcttgaggtagaaaaatttatgcctgcattcattcattcatttatgtatacattcatcaaatatttattgactaccaactatgggctcagccctaaaacgaccgggatgaaagactggagtttcttcccctaagaaggagcccagaatctagtgggaaagatgatgatgtaaaccactcattatgacactgagaaaagatgccaagggttctgtggaactcaggatgtgcacctggattaactcagaaggaatttcccagggtaaatgggacatcgcagnnnnnnnnnnnnnnnnnnnnnnnnnnnnnncagttccctgatgagttagaggtttggcttttttactaaccttcactcggattactttctcaaaacagtctctccactgctgtgtgagtgggacggcatcacgaataaagggcgcactcaataaatgaaacaaggagggggaaaaaaaggaaaggagaagaataccacctcttctaattgcctgtcactttaacctctggcaattggaccctttggtctgtgctaagtaactgtctcagtgttgacatcacatgaaatcgtcacagaaactttatcgagtctcccaccctttcacccactttgtttgtttataataccttctaggcatcctcttttatttattgcttctttcaaagagacctttaaattatgaaacccaagtttgttttttttgtttttaaccatttatgctccccagataaacaactcatgtgatgtcaactaaaatttgctatcgttttctgggctctgttgagtaaccagcctcactttttgatgagaaccaagaaacctgagcattgtataaaaataaaatataaattccactgaaatacaagcaagttatccttcattcacaggtaggctaatgaaccaaatttccttcttctctcacaaggatactgtgagcttaatgagaccaaaaaacgcatgttttgactttcactcatttaggctaaatttgctttggacaagtgaatgggttaaagtcaagactgaatgacctggaatgcatctttttgaaggaaatggagctgtgcatgtagaggagaatgaaaataaggggaagttacaagacaaaggttggctataacttctacagttgtgtattgaaagggaattcgactgtgatggagatttatgtcttttagataaatgaaatttctccaatttgtgctattatgtagctcgtcttttcacagaaatccaagactactgacagatcaagaggtttcacatttcagatcctttcagcattcagcaaatgcaataaatatcagaggtggcctgtgttgaatgtaagaacagatgttgtttctgcaggaagcaggatggaaacttacacccactggcttgctgcaactttgaggagactttcttctataccttcctctaaatgtgacttgaaaccttccgccgtgatattttaataaactttctatatcttgatatttcctttaagggtatcattcttgcccaagttaccaccttgacaagagactgtctccatagcccatctgttagttcaattaacaggcttctgagatttttgcttggggactcagcatttatatttatatctcatcctctagagtaattcttgcaaataatctttgggaatggtgcctgcttcctgtctagatttgaagatcctgcttctaatgaagaatgtttttgccagaaaaaaaaaaaaggactttatatatctccatgattccatttctttctggagtatggatttattttttgtggccaaatcaccttctgtgaaatggagtatttgtatcctactcatgagggccagcctcaagttctcttgggaaaactgaatttcacagctggctggaattgtcaccacaagttttgactgtttctgaagacagcattatggatggcttgcacgcactgctttcttaaatgtaatctaacagaggaggggttctgtctctgtggtgggcaaaagagagtgtttcagaaatacaggtggaaggcactcttggtgtctgtgctgagcagaaaaataaattctggtctggtagactaaatccaactcagcttgaccaaacaagccaaatttacatgtttctggtatgggatgaccttaaacatacaaagaatgtgatatggcagacactaattaatgaaccccttactccaaatacactctagcctatgacagtcttagatattcctcttcctggctctaacactctcttgttcctgggcttcctcttttaaataataattgtgagtatttttatagagccctttacaggtaataatgtacattatctcttttaatgcctacatccaattattattaatgggaatgaactgtaattacacaccacaacataagtgaatcttaaacatgttacacagtgtgaaagaagcagccagacatacacaaaaaagtacatattgtatgattcaatttttttctttttgagatggagtctctctctgttgcccaggctggagtgcagtggcacagtcttggctcactgcaagcttcgcctcccaggttcaagcgattcttctgcctcagcctcccaagtagctgggactacaggcacatgccactgtgcccagctaatttttgtatttttagtagagatggggtttcaccatattggccaggctggtcttgaactcctgacctcgcaatccacccaccttgacctcccaaagtcctgggattacaggcatgagccaccatgcccagcctgtatgattcaatttatagaaaaatatagaaaaagcaaatcagaaaacagatcagcagctacttttctgcggggtgggggtgactgaaaaggtgcatgagggtaatgtctagacagatgaaaatgaaacctatgaaatgcatgtaatatgtgttcatccagactgaaagatgcatgtaaggtctgagtacttcactctgtgaagttttagattatgcctgaatttttaaaaatattctatcaggtgtatctatagatgaggaggctgaactttagaaagatgaaatgagttgtccattctcatgcagctgaaagagaactgaacctcaacccagatgatcgtaactctttagctcaggtttttccactctaaaacaatttccaagaatgacaatatttatattactccactatggagtcaatgcattttagatgcttttcttcctgggaatagagatgggtctctgaaaccacatgacggggtactggcaatagtaacgaggagaagacggtgtcacaggtgtgcggcatgtgtaatgggtaatgctagggctggatcataaagcctgacttcagattcccgctctgccacttactgtgcagcataagaagttgggtgagtctacctgcctgagattcagcttcttcatatggaaaataaactgtagtgaggcataaatctgatcattcatggacagttcatagttgcctatgaactatcactgaatgagtgctatgatgcttcttcacagttttggttaaagggtaaataaaagcccctgtggtattaataagtttaccatgttattacagtggcttacaatgtgacattttcgtctgcactgagcttttctaagttgctacataattaatttatcatcatataaaaaatgcatataaaattaggacttaatagtgcttctatccttgacctccttgtttggtaacaggaattgttgaaaaatttaggatggtgtgtacctcattcactatatgaataatgtcatatatttcttctttttttttttttttttttgagatggagtctcacactgtcaccagggctggagtgcagtggtgtgatctcggctcactgcaagctgcgcctcccaggttcatgccattctcctgcctcagcctcctgagtagccgggactacaggcacccgccaccacgcctggctaatttttttatatttttagtagagatggggtttcaccgtgttagccaggatggtctcgatctcctgacctcattgatccgcctggcttatcctcccaaagtgctgggattacaggcgtgagccaccacgccgggcctgtcatatatttctaagttctgaaagaaaatttattccaagtgtaattcacttataaatctacaattccatgaattctcagtgtgattcactgaagtatgtcttaatgtttgtaaatgattgcaaacttggaaggaagcatttcttggaagtaattagaatattatagtgtgtataatgtgggtggactttcttaaagcagaagcttccatttaaaacatatttgaatattactaaggatttaaaaaagaaaagaaaatgaatgttttcttttttatattgacaaacaatatatactactctaaagataaaagtttgttttttgggttctgctcctgttataattgatagcatgttagactacaagtactttattatgttttagggtcctcagagcctgcttgaatcagaaatcctgcatgacttgtaggcttgtctaatgaggtcatatacttaaatatgaattatccgttgaacagaaaagaaaaaggagtgaagagtttagactctgacagaaagtaaaacacttgtattttttcatggagaaatatgttgaattctttggtgcaaaacacctgacggcctgcacagctactgtttgtttacacagtaaacagtcttgcatggagggaagcgaggaggcccaggacaatggataataagagtgttcatctgtaacacacagccaggatttcccatttagctaacctagagctttgatctcagggagctgtgaggccttgaaatgtggagtatactttaccttagggcaacacaatttagagtgtataaagattttttttaatgattttttaaattatgtaatatttaaaggtgttatttacattgaaatacttcaagtccactttcaacctggaggaaacttaagtttcatacctagattcagttaaccatatcaccatttaaacaacaaaatgaatcatgaagtgatttgagattttttcaggctacttgtcccaggcttgttaaaactctcgttttgtttcctgccagtgaatacctgggtttcaatgttctaccacagacaacaccaaaaagtagggttttgttttgttttggtttttggtttttgcacaagccaaaaagattttgttctggattcttctccaagtgcaggtcaatatgccctaaaatattttctggtgattgttttgagattcatatcagtacccaggaagagttgcgttttaacacatttcagaatgtgtgttaaatatcctttaatattttttattgttttagtctatttgtactgctgtaacagaataccagagcctgggtaatttataaagaaaaaaaaatttatttcttatggttctggaggctgggaagtccaagactgagccagcaataggtttggtgtctggggaggatctcattccctgctgtcaagagagcaccttgctttgtcctccagagggaatgaatgctgtgttctcacatggcagaaggcagaagggcaaaaagggcctaagctagttccctcctgccctttggtaaggcactaatccattcatgagggcagaaccctcgtgacctaatcacttcccaaaaggttccacctcaatactatcataatgaggatgaaatttcaacatgaattttggaggggacgcattctaaccacagcaagtgttacctaatttaatagcaaatttgtgcgttacatgttaacaggccctgtgaggcttagagaggtcaggaaatgttcctcatagccatttgtgcagctatcagccacataagctggattgatctgactcaaagtctgtgatcttttagctcaactatactggtactcaaataagccaataagcttcctgttgtttagtttgagttttcccttcacaacacccacaacctccgcccccttcttccctgctccaagattagatcagggaacatagatagtgttttagaataggaggaagggtttaagtcatctgttcagttcaacatctatttcccttttgagctttgatgtctgccttttgcccttttgcttgcccctgggctgtctgcggaaacggaggggggatagtgaggatatggataacttggaacataagaaaatggctctagggtgttacatacctgctatctccctctgtccttgttctctagtttgcttctgggaggtttgccttgggcagaaagggtaaagggaactactatttatggcatacctttttttttttaaataccagacactttacatatatcatctggtaaaatatacacaacaaccccatgcttttagtattattttcttctttttcaagagaagaaatctcaggcttagagaactgtagcaagttgtccagatctcaaggctctttggggagaaaagattctaaatcagatctgattccaaaaggcagactttcccaacacagtgggaaagaggaaaagctttggaatcaggcttgaatcacaactttgaggctgtagggtcttaggtaagttatttgacttctgtgtcttcatctgtaaactgttaatgataacagtatgatctcacaaggtggttgtgaaaattaaaagatgtaatctatgtaaaaccctggacatttagttagtgctcaataagtgctaaccattacaattgtcatgaaacatctccttccactggaactgagatgaacctctgaccatttctcaaagcttcagactcataattctgctgtctgttgacctttatctcttcatggatgttctgtccacagctcaaacctcacatctccaaaactgaaatagttcactctcatcccagaagcctgtatttcttcccatattttctatcctttttaatggaattaattaaccaaggtagtttccctgattttatagaataggaaatttaagaacactagaggattaaatgatttgctaacaactactcagaaaattaggaccccagccatgatggaaattcaggtataacaagttctaggtgctttatcctacactttcttgccttcctccttccctccctctctttctccctccctccttcctttcctcccttccttccattttttcactctctcacttattcattcatgcattcatttgtttaacatttttaaccttccaatccttatacattgaattgcttcttcttgtcatttagcacagcttaggacttccagtgcaacattatatagaggggtaatgggagggtattgttaattccatcctgattttcaaggagatgcttacagcatttccttattcagaatgcttgatgtcaatttggttttatttctagtggatagtctttaggaagttaaggaagttaccttctatttctggtttactaagggcttcttttgtttcctataactgtctattaaagtttataaaatataaaatgtattttcctcacttaagtagtcatatacttttctccttttatctgttaatatattgaatgccaataatacattttctaatattgaatcaatcttggattattcaccagtccaaacttggtcatgctgtactactgtcttctatatatattgttggacttggtttactgacattttgtttggcatttgggatttatgtttatatttaggaaaatggatgggcaattttccttttaaaaattttccatgacttcttttgttattaaagttatattagcttcgtggaataatttggggagactctttttgtgtctagtctctggaatagtttgattaagatttgaatgagctgttctttaacgatttggtagaattcactaataagctctggttctagtattttctttttaaaaattttctttaaaattaaagaataaattttaaaattatttttaaagaattttcccattcctttaagagttacaagactaaccatgctctctattttcttaggtcagttttgttaagtttatttttttctaggaatttgtgcactccaggttttcaaacttattaccataaaactgtcaaaagtattcttttatgttttagagattatttattattttaatatatattatatctgatgtcatttccccttttgtttataatacaaattttatgtcaatttttttattttcatcaaatgtgacagtttgtatgtttttttaggatttcctatatgacctttagattttttcttatggcacatgtggaatattttgataacatcaattctgatgtaattgtcacagagtatgtttattaatttagtccccttttccaatatccatagattttcccagcatcagtagcaattcattgctcattaactgcaataatctagctcatgtcttcatgttacttgaagtagatgtattattacatctgtgattatggtgaaagggattttcaaattagatttataagatgtgggatcaaattccaggtctggtgcttggaatatctattgcagtaagatatttaaactctatgaacctcgatttgcctacctttttattgttaaatttttctatgggtttatttattgaaagagttgtatccattcactgatgctcaccatcattcctttcctacctttttaaaaaacaacaaaggcccaactatcttgactggtatgcctcaagtgaaccttctagaggtttagccttaaatcttgtgaggttttattcttctgactctgatagaaccttaaagcttgcttaggcctttcctctgtcatcctgatgtaattcttaggaattactctcctgagagagtatgaagcaaggccaagctaagtttggcctcttgaagaaaatccagtgcagaagcgcagtgaagtcccattgagctgagtcctaaaggcattagttctacggagcaagatgtgtttgtgtgtgcacatatgtttgggggaggaggtaaaatttgatggggaaagttgttaggctttcactctctgggtcatggaagtctcaaaaaaatagatgcatagtcagattctaaaaggccctgcaacttatgcatatttcagatgagggtgacaataagcatgcaatgaggctgtgtgcaaggaggtgctataaagcactttcaaaataggaggtatccatagcattgtctagtctgccagactctgatgtttcaaagaacccgtcaccatctaccttaccttcagatgcctctacaagtactttagatttgcagcatattcggagtaaggtggaaaaatgtcattcctttcctgactctacccttggtaatgatatttagtttacttaatgtggtttccctttggaaaagctttatgactctgggcttctgtcactgaaaaataactgcaaatttactgagccccaagtttgatttgcaggatgttattatgaagctacacctggaataatagagttttatcttccagagatacctgtaaggggcaagagagagacacacttcctgcttttgacgtaaagtttcattcacatgtgatcttctgtctagcaaagagtaaaaacaatatttggagttgagcattcagacatcctttctgcctgttactcacttcctgtcttcagatgttagagtatagctgttaaaatagttactttattttcccagggaagagaaattattattatttttggtggtgagggcaaattgctggcaaattaatccaggtcctctcagtacttattaatatctgatgaataaactttagactacttttcgtgtgtattgaatcatattctgtagaaattttggtattttaggtttctatgccttttctgcctggcatgattataaaattctcagaagcagtaactcgtatatccggttgattatctatcctgcaatgtctagtcccacacaatgcacagagtaagtgcttaatttatgcgcaagaaatgaatgaaagaaatgatattttcaagcactttttattttgacagttctgagagtccgaaaagagacatccttgcaatgcattttctcactgaaatttcatagcaacaataacagcaatgacataatagtaatatttaaatttgagtgataagcttgtgctagatgctgttctaagggctttgtatacattttttgaaattatttaatccttgtaacaatcctaagagataggtgctgttattattaggtaaggaaactgaggcacagaggttacataccttcttaaagaagtccaccttgtaaatggaagatttgggattccaacccagatgctctgactctagagctcatattttaaaccactacattgtattgcctatctaaggaagacattgttttccgcattatacagatgaggattctaagacccagatagcttaacagattgtctcattgtcacactactaatatgtagctaataagcatataataatgaagaaatgtacagcacaattttatgcttggtaatgtatctgtgaatcgatctcactatattggagtctttggattaggcatctcaattaaccacattccagaaatcacagaatatggcaacttgaagagattttagaaacaatctactcttccacaaagtagaattattttctgcaatgtgactgggagatagctcatccagtttctgcttgaaacgtcactagcatagggaagtcaccacctcccagtcttttcttatattgaacccaaatcttacccctgttgattgtattcactgatcatggctgtattctgcagacatacacaaagtgaagttaaccaaatccccagttattaagtcctgtacattgtttttctaggttgaataacttctaataattgtagtgtacctttcagtgtttactatcccgtttcttgtagatttttacttacattnnnnnnnnnnnnnnnnnnnnattggaccccagggtcagactccaaagtttatgcacgtcactcttttgtgctaatgtctgtcatttaatgtatggtttaattatttcctgagcctttcaacaagctgatcatttgctttaccctcatttaaacatcgtctaacctgttagaacttcaggtataggctgatcgaggaggcaaagagaaggacttctctctccttttctgaacggcatacttctatcagtggagcctaatatcctattactttcttatgggaatcatagccatgaaaatccctagaatctgtattcttatcaacagcttttaacacagttctccctgtcctacatgttacagagatttttattttgaatatgcaatgacagaactttctactttatccctattatatttcatctttttatttagtgcctgtgtgaaactcttaaaatctcaattttgtcatcataagcattaggtgtccctcctagaagctatctagtaagttgaagtaataaaaccaacacctattatgtacctcatctattagattcagccattgccaccttcaggctttgaaggagtgtgggccagctgctttgtaatatctggatgtcaaatgagcaagatctcggtagttccagcctctttttaccctggcttatcttttttctttatgaaaacacaaacactgatattttatcagtttatgagatgatgaaaagaaaacactgcagattaaacgttttttgttttttctcttttttttttgacacaaagtctcgttcttttgcacaggctggagtgcagtggcatgatcatagctcactgcagcctcaacttactgagctcaagtgatcctcctgcttcagcctcctgagcaggtagggctacaggtgtgcaccaccatgcctggataattttttaatttttatttttgtagaaatgaggtcatgctgtattgctcaggctagtcactaactcctggcctcaagcaattctcccacctcatactcccaaagttcaggaattacaggtgtgagccaccatgctcagccaaaagatgtttttagaaacatgacttcgaaaatttttgtcgttgtacaaacaggtttcagacatgaacatttgcatatgtttagaggcagcatccaggatgcaagaaaaaagcatggtaaagtgattggaagttgaggctgtagagctagacaccctcgattcaaatctcagcactgccaattgctactgtgtgactgtgggcaagtcacttcagttctccatgccacaattttctttcttataaggtaggcgtaatagtatgcctacttcatagaattgctccctaatgagcatactttacacatttagagccaggttcaacacgtggtaagtaatcaataattgctagttgttgttattgttttaaagctggagttggcagactacagcccgtgggtccaccctggccttctgcctgtttttgtgaatgaagtgttgttggaatgctgccagactggtgtatttgtatacagcctgtgacctctttgtgcaacgatggcaaaatgaagttatgacagagactctaaggtccacaaagccctcagcattttttctctggctttttaaggaaaaatcttgcctacctccattttacaggatagagtgcagggttcctgaccctcatctgtgactctttggtcttgtaaccttaggcaagtgactgatactctctggcctctgctacttgatctgtaataaagattggttatgagactgctcctagagaacaactctgagaaactggccacacacggtggctcatgcctgtaatcccagcactttgggaggccaaggcggatggatcacttgaggtcaggagttcgagaccagcctggccaacatggtgcaacctcgtatctactaaaaatacaaaaatcagccaggtgtggtgctgcgcacctataatcccagctactcaggagactgaggcaggagaatcgcttgaacccaggaggcggaggttgcagtgagccaagatcatgccactgcactccagcctgggcgacaaagccagactccatctctcaaaaaaaattaaaaaatatgagaaactatgttgtggagattctatttgttgttcatttgctcacaattccatgttttgtagccagacagttgtgctaattgcatgtccctgagtttttattttttctgacagtaatgagtactttctatgtactaaacactcttccaagccctttgtgtgtattaagtcatttaatcctcataaccttataacaattctctgaggtaagaatggctatgcatcctcatttttcacatggaaaagtgaaggtatcaaaagggtaaggaaattttcccaagcttacatagttggcaggtgacagagctgggatgtgaactgtatagtctggctccggagtccagagtttgtaaagtagtcattcaactttgaggaccttatggttttactagaaagacttattatgcaaacaattgcatataaatataagggttcttttaaatatttgtaagctgatcagcccagtgcctggcgtggaataagccatcatcacgatgtttatggtcctgatgctgttgatatcagtggaagctgctacaaagcacagctggtgtttaagggaggcatgcctgaggtgtcaggagcactttgaaaaggaggtcttacccagcatgaggtttaaaggatgtagggagttttccagaaaggtttccacgtggaggaaaccacatgtgcaaagaacagaggcaggagagaacatggcatgttcagcgaattaaacagtacttctctgtggcttgcatgtgaactgtgcagaacaagtcagctaagattaggtcaggaagtaggcaggtgccagatggtgagtggctctgtgtgaaaggggacgggctcctgtcctctagtgcatgtcactttctgagcaatgccctatattgtctgcttgtttaatgtctccaccctgtgccgcaacaggcacatgtgtactggaatgcaagcaccttaagggtagggagccagtcggtcttattcactgtgactattccaatactcagggccctccctacagaaagagctcattaaacatttgttgaattaattaataactaaaccaatcagtgtgctctggatggataggattactcatgagataggatactttctgtgggtccattgccttactttggcatcaattatcttgctttgttgaagaatcaaggtaggtcacattgaatgagtggattagtctaaaataggacaattttgagataatcttttctttggaggcggaagattacttaacaaattcatacctagtttattttactctcaactccacattttaaaactcaatcccctctccaagaacgtcctatgacttcttcagaacattttggccatccttcaaatgcttcttcccttccagatgtatttatgccaggattcagctggcagaatggaagtaaaataaatattggtaactgaatgaaaataatgattcttctagataatgctgccaaacctaagaaaaagtaacttgagaacataatctcaatgtgggcttatattcctatttgtcaggtgcctgtaggttttggttaaaaagtgagaagacacatctgcttaaggcctctgtctagaatgtggcacacatttgaacagggctatttcttggtgatgacataagtagcaagatgaggtaaaacacattctttttttaatgttgtcagaaaaggcagcttcccaaggaatcagagaatgtttgaagggtagggaccttatttccctcctttgacaggcgaagaaaatgagatccaggcaagggaagtgacttgcccagggctggagagctagttagtggcagagctggaactgtaatccaggtctcagactcccagggccaattctccttcctctgcatcattcagcctctcgagacattagctataacttctgagaaacatagtacctctttcatcatttcttggtctttttgaaaatattgatgatctctctctgcatctttcctccctaagatgacctgggaaaatgccattgagggtaaatcttatattgcattttgttggcaattcccactgtcaccaacctgtccccagcttgaacatttcaccagaagtctgaatacccaggtttcttgcctccagctaatcccctttctccttaatcacatttttaaaactccacatttgtgtttacatcctctaaagcaatgaattttttttccttcctgtaatctggaaattctttttttgttgttgtgtttgttgttatttttaagaaaacttgaacacatcagacggactttccggctccttagaaaccagtctggtaggagagttgattggatttgcctaaagcatttcctcattagtagcctgtgtgctttttctttcaaatgtcatctggccaacccaacaaagatttagttgtggcaacttggagccttagcaaatttgtactttactgaatgctcttttggaatattcacaactgcctgtccttcaaatgaaaaacacaaacatattgaaagtggcttggtggattattggtttgaagagcacctctgactcctctccgccccttttcttacaactgaagattggaattttaatttctaaagcacagcttttaaatcatgatgcccaaaaaggacatggtttattaattagttctgattactaggcaccctgaacctgggcctggctgcttcaaatcagtttcaacagctctttgcctgaaattactgccggtaagcacatggaagtataattatgcagacactagtggttcagttctgccaggttaaaccctctattatgaatacatattatagtgtcttaaaaggcatttattgaaatgccatagtttaatagttcaagcttacaaaatcaaactctctcatgttacaggcaatagcctcttaattggatgttttctcacagcacataaaaatattgacttaaatacacgcacacacacacaaacacacacacacacacacacacgcaattttttttcagagcgagaatcagtattgcttcctggttgaacctaaggactgtagagccagtctacccggattcacctcatgcttctgccattttccaacactgactttgggcgaatgaccaaagggggatgattataatgcctatattgttgtgaggttcaaatgagttagtacacaaaaaacacttggcaaagtatatggaacatagtcatgtttttttaattgattgttctaacacatttctttgtatttatgtgttgtaaaatctatttatgctaagtcctgagagaataagtcctgagagaattcctctgttgtctccagatatttattctcttcattttccccagtaatagccacctctccctaccatttttagctaggtggacatagagctgtcaagaataaagaaaaaatttattttccacctagaagtggccatgtgagtaagttctggccaatgggttgtgtgttaatccattttgcatcgctataaaggaatacctgggcttgggtaatttataaaggaaagaggtttaattggctcacggtgctgcaggctggacaggaagcatggcgccaccatctgcttggcttctggtaatgccccagggagcttttactcatggtggaaagcaaagggagagcagcacatcatatggcaagaatgggacaaagggagagagaagggggaggtcccagactcttttaaacaaccagatctcaagtgaaccaactgggtgagaactcactcattaccaaggggatggcgctaagccattcatgagggatctgtcctcatgatccaatacctccactaggcccacctctaacaatggagattacatttcaacatgagatttggaggggctaaatattcaaaccatatcaggttgtaagcagaaatagcgtgtcaatatctgaaaagtggccttaaagcaagaaggatggtgtgtttttcacttcttcgtctttcctactaatgggaatttggttgtgatggctggaactcagcagccatattggatcattagacagcacaccagggatacagagcagtcaggaagcagaagcctgagtccctgacaacttcagggagcagagctgccctagcagcccttttctttcactctagacttttgacaaatgaataacaaactcctgtattgcttaatacactaatgttggctgcctattatagataaatctattcttaggcaacaccttcccttccctgaattagatgatatcctaactattttgattgccaggtatagaaatttcaggacactaatgaacagagaaccatgaagttttcacacactctatttccaattagagccactgctttaccacacccaagcatggctaccctgctttcactccctgcctggggctgcttagtctcagacctcaactggtgattggggacaggagtgcttggcagtacaattatgtctacaattgatagccaagccttgtaaaaatgacttggagtctcttccagcaagaaggaccatcttgaccattttattacttcctctgtaccagaaattatgggttcttgaagaaatccaatggcaatcttcttttgcttttttttttattatacacaataacaaacttcttcattttctatacatatcaaaaaaaatcaggactcctggatggacaaagggattttaagaacggatgtgtggatgttacttattctccctcaggatagatatgaaaaaaactaccagaacctcagtatatcttccttagggacagtgacgatagtcttttagcctcatttaattccttgaaattgaaaatttattttctggagatttcaagactcatttagggattttgctaagatttcctcccaatactagtgaaaagcagaggtgatatctaaagctctcagaagaaacacagaaaaacctaagccattaccccatccaaagtataaagaagaatcataccttatttctatttttcttggtggtgaagttcacaggcattgttcagcaaagccaaattaggtttcttgaatttttgggttggtgtcttggcatcgggaaaattcttcggctctgccatattcgctataccttacctttccaagggcccagttaaacatatttagattttcttactttatccttcacatctgttcatctctatcccatattttccatctttttgtatatttgtgctacattctgtaaaatttcttatctacagctccctaattccttcttctgacatgtctatctatggaagtttcaattctggtaatattactaaacattctgtttggttctttttatcactatgttaaatcacttttaaagaatttgtggaagattctctcaaggtttcatttgtctctgtaaacatactatagctttgtagtatgcgtgagacttactgcccttagtgctggttcttgcacatggtacgttgtttccttgtatgcaacatttcctttgatttttatgcctgctcattgcattttaaaatgattcatggggattctttgaagcttaggatgaagttgccttcctccagaaaggacttgcatttgattcttcaaggcctctagagatttgtcgagcttgagatttccttaatccagttttgagatttaacataagcactcatatcatttacatacttccctttttcctggcttaaacttctaatcatggaccatttcttattatacctcatggacagcactgttcttagcacatgaaaattgactgataagttttgaccgaatgagtgaaattttaaaattatcacacctaccttatttttttctgtctttatttgcaattggccagttaaaaggattactatatgcagaatattactcccaatgggatatcccttcttcaaggcagtgccatgtcttctgtcctttggaaattcccctagtgctgtgtcacataggaaagggttatttggcaaatatttgtttctaggctaagacttgctatactccccatgcttcttcccaggaatggctaaagccacacatttctgggattactcttcccttatgtggagatttagagtgttacttgggttatctctgacattaacccctatggccctggaaatggtggatctacttctaatcctttctcttaagtacacccagtctcaccttccaggagttctctctaaagctaacctttgattctgccactctctcactcacagatcaccacgactatcactactgcctgtagaataaagctcaaacctattagcttgtcatttgcatccttcatctaggtggtatggccagatctcatgagaaaatattatctctgggaaatcaaattctagctacaccacttactagccatataactttacataagctaaaattctgagcatcagtgtgctgatgtgtacaataatactaacctacaagggatcacctatgtcatgctgctagtgttcacttcaataagaatagccctacaaggcatttctttctagcaggtctgaaagagatagcaatatttttcttgtataactcgtggacacatggatgctcggtaaataaaagataccttatccataccttctctagaccttagtttccttgtatataaaatgagaccttaaatggtcatttgaaacttaatgtgggtagatatgtaaagcacctgattcaatacttggcacatcattaagtatattgtaaatgttctttctctatccttcttccaaattgagacctgacttaccttttctatggaattgcaataaaaattataaagcagagcatgttacgtaaaggaaggattattgttcttatctctactttttaaagtcctagctactctttaaggccaagttcaaatggcaccttccccatgaagcatccctggattctcactcctgcaacactcatccctactccactcagaaggataataatgcaatcaaatgaaaatcttcaattcatctcagctaatacttgaattttctatatttccatgagtataattctacaatatacaaagctaagcagtgtactagcttctactaaaatggtttcacagatgaaaaagtttaggatcttctaaagaagtatatttattccagcctcggacagcttcaatatgtccccctaaatttctgcatttgttcatgagtatgtctgtgttcctctttaaatattttgcccagaaataaataatagttattaaaatacacagtccatgaataatatttctccttctgtaactgcaacctgtgctaacaggtttggagcaaccatggagctcttttcttctaattgcacttatattcaactaaaaccctgaaatcttccttgaaaatatgtgttggtgttaaatgactgctcctctgtcttgtattaatatggctatttttgatatgattgagtccctcaataaaggtccatattacatgcatctgggtatatttgaactgctaattaaatttttgtgaacctgaactgtctttcgtgctcctagatcctttttttaatgggttcttccaaggtattttattccttttataaaacatagctcattctactttgtgccgtagtttgtgtactttgtcttatgtcctatcttaggtgggtttctgagaagcagagcatctgtctgggggattgggtagtgactttgcagcctcctgagcttagcggcttctgttgggccaagatttgtggggcagctatgagttgttctcacccaacacacagcaaccaggctataggaaaagggtcccagatgggacaccaacagcatacactgtagtcacccatgattttgtaactctgagtttggagtgtattgttcatctctgtagtctctataatcctgttgatgtcttgcacagggaaggcactagttggtggaaccgattcatcaaagatctggaggaaatgccccctagttggctctcattccaattcactgccatttgtaataacaaacacctgtgagggacttagcccaatctcctgaggcagcagtgaaccagagtatgtgggtgatagagagaagaatatgcaagtttacattgcatgttccaagaatctcgttgccctgttaacccaaaagctgcctaaagaccaaatgctcaaattcagaataggcaaaaatacttcttgataccaaggcaaatatatcaaagagcagaacttcagtctgcttcactgggctcttaagctatttttgttttcttaagttatttttgttttcttaagatttataaaagtaatacacacatatggttaaacatgaaaatgatatgaaagagtaataaataaatagtaaaagcctatttcttaatcattatggcttttatttccacttcccacagctaactagtgttaataatttcttatatttctacccagaaataattgtaggcatataagcacatatatttatgaatttatatacaaagatattatagtatatgctttgctttctccttttatccccactaataatagatcttacaggtctttccacatcaacacatctacatctatatatatagagagagagaaagagatatatatataaagaattaatgatatatattaagaattaatgatatatatatcattttttaaatgatataaatgtcttacaatttatttaatctgttcctttttaatggatatttacattgtttctacttttcagctcttacaaataattttttttgctattacacatttttgccactacaaaatgtgttcttatatatatttctttgtatgtgtttccttgacactattaaattgaaaaccctatgattgtttctcaacagaaaaatggcatcctgtgtaatgaatgtggctgccatattccttacatctatattgaataacgtatcttttagcctaagttatactttctcactctctgcccatgttttcagcctttttcccagaatgcaaaacttaaaatcagaaagtgcaaaagttgtcacagttgaaaaaagctagacacaattctcaactgtaggacatcataacagcaagttctaagatgcacagagctatataatttaaataataagataattaccttgagtggaacaaaaattcaaaatctcgttgagaatttaagaagttcagtattaagagcttatccaaagcaagtctatttcagaaacacaatcagacttcccagaaattcagccgtgatgtattaaaagcacttgttgtctttttccttgcagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggtaaatagggtcaaaactctccactgtatcaagcagctcctcggcctctcaggctaaatgggggctttcacgagattgccctcatgttctgaaaacacatcatggcttccaaagaaaagcatgaaagggccatgctgagaattgtgtgtgtctgtgtgtgaaagagagagagagacagaggagagagagaatctatacactgagcactggttctggaaagagttaaagaactggaatcagcatcctaaatgtctttagggctcattaccagtccatgtgacttaggccacatttcttaaaccgcttaacctcagttttgtcatctctaagatgggaataattgaaatagatgccttgtttggttgtgagaactaaattaggaaatccatgtgatatagttaggatgtttgtcccctccaaatctcatgttgaaatgtgatccccaatgttggagatgggggtccagtgagaggtgtttgggtcatgggggcagaaccctcatgaatggcttggtgcccgccccgaggtagtgagtgagttcttgctctattagttcaagtgagagctggttatttgaaagagcatgaaatacctccctgctctttcttgctccctctcttcccatgtaacttgtcggcaccccctgccccttccaccatgagtggaatctccctgaagccctcatcagaagcagatgccagtgccatgcttcctgtacaacttgcagaaccgtgagccaaataaacctctttccttaaattacctagcctcaggtattcctttagagcaacacaaaataaatcaatgcaccatgtaaggtgctcagtacaggaaaaccttccatgaatataagcaatagtaatatttcttattaatgttagatagtaataaacaaattcaccttactaggcctcagtgctgtcaactgtatacttggagggttagatgagagttgctttaaggctattttctactttaagcatctctttatgctcaagagagcaaaaggagtggctttggtccaagtctggaatgctgtttcccaaagtcggtacatgactttgcacgccacaggctagatatatcacccaacccatggcaattataaggaatgcagccaagaggaagtaaaattcagggtccctcatcccccagaattcttactttagttcagtagaagagaaaacatatattttaggaggaaaataagagaaataaagaaagcgagggatcgagccagcaaatggggaatcttagtgacctttgcatccacattaaagtgctaaaaataggaaccgctcgactggcccttatttagaatgtgtgtgggacagctgcaacccacccgaatagaaagtatttggctaggctcagagttgctcatggggaaaagccatcgggaataggggcagggagaaagttgcttccttggctcccagctcaatgtcttttttgttctcatctcagttagctcactctaaggacgctgccagggcccttctggctctggccagctgcaggatctttctaccccgctctccctactcctcctgtattagttatttctgtacagggattggccagttgtacaagaaagccagcaagtatcggcaagaggggtaagagcagacagactgggaaggacacagagctcatagctggtccactctcaccctgttctctgttttgttccccacaatttctgcagagttcctgggcctgcagtcgatatcctggttactctaagtctccttttccctgggcttttacccacccaatcaaacaagtcccatctcccaatgatctgatgtcaaagttttcagatgtgatgaattcatgatgtagtattgagtgcctatcatgtgcattatgctaattaatgtagaccacagactgcaaagtggcagcctatggtatacccagcctacagatatgtttttttttaaatagtctaagtgtttaaataaattggaattagttgccatgttcaataactgaaaaacttcacatttaaaaagccagtttctgcttttctagaaaagtgggaagaactggtgatgttattgggcccacattgttgcaggcagggcagttatataccagagctcagtagagttttctcctttgataagggaatgaactctcctcatcatttctattaccttctactatggaatacaattaattacctgcctaatctttgaatttgtaaccctgcttagtcctcttaacagctctctgagtttctttcattgtccccattctacagacaaaaaatttagacaaaaagtgtttatgtaagttctcaacattatatagctgttatatagtctagctgggcttcaaactcatgcctataaaatgggtgacagtgtcagttaatcatttccagaaaaatctaaactgagacaaaagcttactgagacattgtaggagcaattcatacactagggagaaaatttgaatagatgatttcttgggtttcttccagaagtagacttatatgctacaacagcactcccaggtcatttaattatattttaaagaatattttgggagacatcagaccttaatttagatattggaaacttcagtctgtatatcaagccagtagaggagaataagtttcaaacttttatattggtgctcgtcaagtccaccattgacgattatacatagggcttcccctgtgggagagggagagcctgttctgctgtggtgtgagaaccagcagggcagaatcaaacatgagaatccagctaagccagatggttccgaagggacttcaggtccagacaggtcccaaactgcttctaacaagaagattgggggcctaggtgaggcttgcccatggtagaagaagagaagaaaataaaaaggaaacaaatattttatgaaactccaggtacaggctgagcagggtatggtgtaccatcagaaatgtggaatctgcaaaacccaactctatgctgaatgcaagagacacatctaacagagtgattttaaaaggtgaaagatacaaggatgggcaaaagcttacaaggtaaatgcaaactattaaataacaacagaaagcattgattttgatcttgatataagacaaggtaaaatgcaggctgaaaaatgtccaaggtaaaatgtccataaagtagcacaaggaaggactgatttatgttgaaggcaagagttcacaagcaacatccagtagttatgaatacataccacataacaaaacagcaacttttatagcggaaactgcagaagatgcaagaagaaatagacagaaacatattcatattagatatttcaacatataccactttccatccaagtaagggcaagtagaggacacagataaatacagtaatccccccttattcatagaaggaatgtaacaggacccccaatagatgcctgaaaccatggatagtactgactcctctataactgtgtttttcctatacatacatactatgataaagtttaatttataaagtaggcacagtaagagattaacaacaatactaataaaatggaacaattataacaatatactgtaataaaagttatatgaatatggtctctctgtctctcaaaatattttattgtacttattttgggctgcagttgacctcagataactgaaaccatggaaagtggaaccataagtaagggtcgacttactataattatatggaagacccaaacaacaaaataaataaagtagatctgaatacattgcgaactctttactctgataatagagaatacacttacttttcaagtccacaaagaacactgacaaaattaaccacagatcaggtcacaaagaaaatgcaataagttccattaggtacaaataatacaaacaacagcctctgatgacagtggaataaaactagaaaatcaataacaaaaccaaaccacacaaagcctttttttcatgggttttttaaagctctctgtaaaataactcttgggtcaaaagggaactataaactgacattgttgcatttcttcaaaaataaataataatgaaaataatgcatccattaaatatgaagagaaggaatgataaagagagagtgtggagtgtgcagtcagctagacccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacacacactgcctctaacttcagcacctagcagagcagctcgcctgaactataagcaccttggccaggagttaatggtgtccctgggagctaaaacctgagaaccaatgacaaatgccacagcatcttggggctaatcccctcagttggtgacacacaggtgcctgtagtctgcattaaaaactctaatgttcaatttctcaaatacaacagccatagaacagcaggcaggattgctgctctttctgtgaaaaaggtcacccagcaggcattgaatccacaagaatatgtcaatgctagtggctgtcagtaattacaatatatttttattattctacctcttaaatatctcttgtttttcatattcagctctttgccttcacagccactgccctgagccaggcccacatccttagtccctgagagtatttgggtatgtttcttacagggtgttttgttgctggtttgctctttccccatttcccaccgtctactctacacctagctagccaagggaatctgaaatttactccttctgtcaaaatggctccctgtcacctgcactcatatctaaactcctcagtattacataaaaacccctttaggctttaaatagtccgtaattgtccagctcctctttacctcatcgtttctgttccagcatcccttaaataatttgtatacttcctacaattgccttcctgacaacttcctacttgccctttaagcctcagggtaaacagtcttctcagatatcaatgtcttgttataccttctgtgtcaaataattcattatagcatgcttcataataacttgtgatttttttcttacatgcctactcagttcctaagtcataaggtttttgagctctgagacactccatatttttattttattaccccagatatctagaactttggcattcaaaactattttcgttcataaatgataaatagtatatttatctgctcgcttttcatattcttctctaaaaatgtcttttgaaaaaatattccactaaatagtcttgggaataagggaataaataaaagcatagttctcttctgacagacataggaagcttaaagaaaccaggacaatccattaaccaagtgtgtcactggatcgtgagcagctgtgctacaatgggtagtttatgaggctttaagtcatgaccctgtactgctacgtaacagagtccactgtagattttcatggttaaattatggaaagatttacatcatctttcttgggaaacagtgtacatctctattaatggtgcacaaatgaaacattcacagaaagtgctgtcttggtttctaatggaaaacctgtgctaggctgcactgtgattcagagaggtgccatctgttaagtcctgtaagatgcctggatatgttgctacaaggtacccttagtgatgtcaccacaatccagtgcttgagtttcagccacagaagatcagaaacttgatttagtgggcatagtgttagcagatccatctctaaggggttgactcacattaaccaaataggcaaaatttgtttatgatgagcaacacagttgtcaagtagatggaaatgcccacgtgggaggatttatataccctctcattgtgagcaggctgtattggaagacaaatgtgaatatgagcagaatgccagaacactaagtattaataacccaaaacaatgtggactttcaaagaatagtgatgcactctttctgagtagataagctacacaagaaattaaattgtcatgaaagtgatttggtgagtgtggaatcaatagaaggtgtgctaatagaccttaggaaatatgttttaggcaagtaagctgaaaaccctcctttccaggatggggagagccttgccgaggtaacccttatgtaaatttctgctttgccaacactcccactcctttgagctgtacataaatagcctgaggtttcccatgtggcccttccctgccctttgatggctaatttatcctcttcagttaacatggttctttcttcctgtgagtacgaaacagtggatttgggttttgcttatcaaatttaatcacttttcattctaggctccttgaagttgttctcatagtaccctgttttgagttttagatgtttccaaatactttagttacacattcatagacagatggtctttggtggctacaaacaagggaggaatcattttaccagttcagcctttctcctctttttcccagtgtttgggggtacattattgccccctcatgttttatatagaactctcaaatttattaaactttgaatactattgaaacatttcctcctttagtgcatcgagaatgaagatttatgaggtactttttcctgtcttttctcctctgtaagtctttgtttgtgaaaagtacatctctttttaagaagcccacaaaatatgtattttctgaatgtagtttcttcattctttgttgggcacgtcatggtggcttcataatggaaactattgccagaattcatgattgtcattaaattttggaaacagaaaaaaatatatataaagtatatgtatatggtgctgtaataagtgggcatgttttacatatgtaaaaacaggtccagattaactgcatgcttgtatcagtgaataaaactctagagttgcagttattctggaaaatatgggtttaaatcccaagtctgttacttattccctttaactttaagtaaattatccaatctctctgattttcaggttccttctttgctatagtcttaatgtttgtgtccccccaccccccaaattcacatattgaaacctaatctttaacgtaataatgttaagagatgagacctttgggaggcagttaggtcatgaggttaatacttcatgaatgggattagtgcccttttataaaagaggctcaagggagcctgttttccccttagaccatgcaaggacatatagtaggtaccagccatgaggaacacaccttcaccagacatcaaatctgtggtgccttaatcttggactgtccagtctccagaattgtgagaaaaaaatttatattgtttgtaaactacccaatctaagatattttttatagcagcctgaatagactaagaaattgatacagaattggggtgttgctatagcaaatacctaaaaatgtagaagtggttttggaactgggtaatgggtagaggctggaagaattttgaggtacaatgctgtgaaaggagatttaaggagaattctggtgaggtctcagaagaggagagctgtagagaaagcctcagtcttcttcgaaattatcttatgtggccatggtcagaatattggtataaatatggtggtaaaggcagttctgattaggtctcagatggaaatgtggaacatggtattggacaatggaggaaaggccatcctcattataaagtggcaaagaactttgctaaattgtgttcatgtcctagagttttgtggagggtggaacttatgaacaataaaatagaatatttgacggaagaaatatctaagcaaagtgttgagggtgtggcatggcttctcctgactgcttacagtaaaaggcaagaagaaagaaatgattaaaaatggaatgtataatcaaaagagatgcaacacttaaagatctggaaaattcccagcctgttgtaaataatgaaaaaaatgtgttctggagagaatacaaagagtgtaacctttgataaagagattaggatgagtaggtgaaatcccaatgctatttattcatcaagacaatggaagaatgaccctgaaggcatttggagatttaaggctgccagggccttgggaacagaacaatttaatgactctgctctgtgccttgtgttatgttgatccttggctgccccagttgtggctcaagtggccccaggcatggcttaggctgccctctggaaggcacaggtagtaaaacttggcagtatctgcaaggtgccactacaccaatacacagggtgcacaagcagtgaggacatggctatctccacctagatttcaaaggacgccgtgtggggccttggggcccagaaagagaacagaggtgggaccaccaaagagaacccccactagggcaatgtccactagggctgtgaggccagcatcatcacagagagcccccactaaggcagtgcctagcagagccataagggcagagccacctcagggacaagacctcccaccagtagagccatcagtgtgcaactcctgcctgggagagttgcaggcatgcaacttcaacccataagaactgccacattggctgtgcccatcaaagccatgaagagcagggctacctggagcctggggagcccaacccccatcccagtgtgtctggaaggtgggactttgagtcaaagaaaattattctggagaattaagattcaatttttgctgggcatggtggctcacacctgtaatcccagcactttgggatgccaaggcgggtggagtaactgaggtcaggagttcaagaccagcctggccaacgtggtgaaactccatctctactaaaaatacaaaaaattagctgggtgtggtggcagatgcctgtaatcccagctactcgggaggctgaggcaggagaattgcttgaacccaggaggcagaggttgcagtgagccgagatcatgccattgcactccagcctgggcaacagaatgagactcagtctcaaaaaaaaaaaaaaaaattcaatttttgccctgttgggtatagatttggtcaagacctgttattcctttctttcttcctatttttccctttctctcctattctgtgcctgtcccaccattgcattttgaaatgcataacttgtctgatttcacaggcctacatctggagggaaatttgcttcaagatgaagcatatctttgagtctcacttacatgtgatttagacgacatttagagagacttcagattttagacttttgagttgatgctggaatgagttaagaattttgggggctattgtgatggaatgaatgtattttgcatgtgagaaagacatgaatttgggcatgctagggacagaatgttacggtctgaatgtttgtgtctccccaaaattcatatgttgaaaactcctctccattgtaatagtattaagagatggggcctgtggaagatgattaggtcataagggctccatcctcatgaacaggattagtgcctttataaaagagcccaagggtgcctatgtgcccctcctgctacataaggacacataataggcactgtgaggctctaaccagacaccaaatctgctagtgtcttgatcttggactttccagtccccagaactgtgatcaataaatgtatgttgtttataagtttcccagtcagaagtattttgttatagcagactaagacattacctaacagactaagacattatctataaaatgtggccaataatataatcatgtttgattattatgattagatgacttaatgttggcatcctctaattggtggcaggataactatggggtaaatgtagctttcagtcaaaatatcctcattgctgggtgcaagaaaaggggacttttttttctctctgtactcagagtccaggagagagaactggaaggtcaagctgtcaagcagagattattttgtaagacattctttcacagacatttttaagccctttgagatttctggctttttgtagggacctcagttccattttcccaactcatgggttctcaataccttaactatcttttatttgtcaaattccaagtcctcaactcacccaccactacctgacccactgcagtcaccacaccaccctacccactttcccagggatgctttatgattagcttaaatactcaccattctgatttgtaatgccgcccccaccccctttttttgacacctgggagtttccttttctttcttgtaagatcagcattacacaaacaagcacatttttcttattatactttatctagaaaacccaggtgtcagtggcagaagcattcctgaatttatgtagatcattgttttgctggaactggaaacctcctgaaacacagcagtggaattgcttgtaatcggctgtgtatatcatcaacaaaagtcaatattctattttttcaagtgtaatttaacataagaagttaaacatttaccattcaatttaaaactaaaaacaggccgggtgcggtggctcacgcctgtaatcccagcactttgggaggccgaggtgggtggatcacgaggtcaggagattgagaccatcctggctaacgcagtgaaaccccgtctctactaaaaatacaaaaaattagccaggcgcagtggcgggcgcctgtagtcccagctactcgggaggctgaggcaggagaatggcgtgaacccaggaggcggaggttgcagtgagccgagatagcgccactgcagtctggcctgggcgaaagagcgagtccccatctcaaaaaaaaaaaaaaaaaaactaaaaacaaacaaaaaactatgagtattatcttttggataatttacctccttcatttgaaattatggactgccctctaccaccagaaccaccattttggtcatgctttttcagctatctatgtatctacctatttgtctatctatctatctatcgtctatctacctacgtacccacccacctacatacatgtcagtatttgcttctcacttaggcaacccatgtgaaatactttgttatggtagaaagggtatacatacaaaaagaggtgatgttagccttagattcaacagtgtgggcactctgcatttgagaaatttaggaagtagaatacatactgacatttcagcaatcgttttaatggtggttgggaaggagaagttcagagaggttgggttgaattagtcagaaatttgaaataggaaacaagtactaaatggttgtattatttttaagcatatatagtgaattagactaagtaaagaagtactgcctggtggcactcataacagacctaacaaaatagatctcatacagtccctttttaaaattattttaagtgaaattttaaatgttatcaaaatgataagacagataatttaaaactcaaatagatctaaaagatttattttttaaagcaatgggaatttattaatcttataatgtcttcctctctttttttgttatctctcttcacatgtcttgttagaaggatgttgaggcttctagattgatgttgtaaggtttttttctctattgcttacattacctttttttttactttattttttaatccttctcgtgaatatattttgttcaccttttacctgtcatattttagctttttgttttctgaatttttttatagaattttgttcttttttggatgtcatattttccgttaattcttggagaatattctctctttttacttttctttgtgttcttttttcctccatttactgttttctgtttgtttgtttgtttgtttttatcttcatcttctttactggaggttttctcaaatgtctggtgatccattgctatctgttcatttcttgcactgagtaaaacatgttggaacctatgtggggagtggggagggggatgtcaactggtgagaattcacatagagttattgcttggtgaaccaagccttaccaagagatccttcccaattctgcaaatatcagtgtttagaagctttacctgggtctgtgcagttacttatgggagaatcattctgtctttttgagtgtggattgggggtagatagtgggagaatacccactttccactgttctgagagtcccaacactcagcatacagacttcatttagggccctcttttcagggccatatcaccccctaccctgtctctggaggttctgagcccatgcaggttgtgcagagccaagggactcacatctggatggaattctctttgtggccctttaggttatagcattttatactcttcctccactctgcagagtcagtaacccagctccatcgctgtctgtcctccaaacatgttgtgcctgtcttgttctcctgtgagtttagacctcctttactgtctttttactggatcttacaaaaggcaggagatcaacatgaatagccaaaccaccgtttttcccgaagagaatccttgcataatttgcatattggtatataacagagtacacaaaagattcattttaatgagcttaaaaaatatttttctagtcttgttatttttaagaaaatttgttttcttcctagataaacttcagcattcatcctaattatcatacatttttaatcagtgtgaatgaattaatgaggtttcactggcagtggtaagctagttaaaaaatgaatttaagtacctccagtttaccttaagaaagagttgaggagagggttcaccaagcatggttctatgacttcatcaatacacagctctttatgagttcattttagcccatgtccgtacctgtcagcaccattcctggaaaattttagtttccaaagtgcactctgagaggttaaacttgaccatctgggtgctgaaggatttttgctaatcttgactcactatataggtcttgatcctttgttcttgatacattaattgaactctattttgtttgcaaaaagctgcccaaggattttcaagcagagataatgatgcctctgaaaataactccaatgctatcatgcaggcatcctctattcaagcaggcatcacctagcctggagattctacagtggaaatgggggcatcacaaagacacccctgctctttcttcttttgacacatgtgaaatttggatttccttagtggagaatgagtttgggacacagcactgcagatacacttaaaacaagacctgtgtggacatataaggtgtgtatctattggctgatactccctttgatcctaaacaatactgtaacaggaattttgacattgctagtgtgttgaactagcaattgagatattgctccctttcttaaatttcaacttttcaatagatagtttcagtcgtcttggttctttgctggatgttgaggctgcatcaatcaatgacagagtccttgccctgacatagcttcccattaggtagggaatatctacaagtaagttggtaattaagcaaacaatatcatagaaagacaatgaggaaagtacaggatgctatggagtcttcctcgcaggaaggacactgcatccaaagttctgtttttaaagcaggctgggtgttgtcaacagggagtgatgtctatgcttagacttgaataataaagtaagtgttagccaggtcaaaggttgagataggaagacagggagggtattctcagcaaaggaactagtgtaagtacagacactaaggcaagaaaaaatatagttctatagttccttgaagaaagggaggtttagtttgtttggagcaattcataagaagaatgtgtctatacctactgtgtacccacaaacattaaaattcaaaagaaagcaaaaaaaaaaaatatctcaagagatgagtctggagaagtcatcatgatgagagctaagccactttataacttgaacttttttctaggaggggtctgaagccatggagtgatgtagcaaagatctctctggctgcatagatcaataggaggcaagactagaggctgggagactagctaggatgctgttgcagaaatttaggtgagaactaatcctggcttcttttataaggttagggcagtgattctgaagaatagttagatacatttgaaagacttaaacagatagaattggcaggagttggtgatgaaatgggcttggagggatgaggaaaaagaagtattccggaattaattttgctcagagccatagtcggccacacacttggccactattagttagcttactgcactggtcctgagtcaatgggactcaggtcaggtatgtcttgatggagggcagaggtaggtggaggaaaggtttaggcttttggagatattgcctaaattgagacttagcgtacgactgcattttgagagttttgtgttccttactggatttccaagcttgttaaggacagcagcatgtatggtttttcttttgtatttgccaatttttagaatggtatatagaaatcactcactaaacacagaaggataaatgagtggtatcagtcaggagacaggtgtcatccctgaaatgtcagctaaagagcataatgcaggaactatagacagaggaaggggctgtctcgggaaccaacaagtggtggggaagcacccaggacctagcacccagtgggaagctcttacccacccttgggtctgaggagcaaaaagagcaagttactaccacctggagaggactatagccctgggaggggaacagtggcccagctggggttggaggtaggtcagtaccccaacctttttcttccgccatggaatcccctttggggcttctggttggccatgcataattggaagccagaggtgagggaggagcctgagtgatgccatttagcccatagaggttgacctcttggagcacagagcaaggcaaagagtggcaaataatgaatctggaggcaaaaaaaaaaagtcacaaaattgtatttacattctgcctctttgaaaataggtctgatatgtataatacaagtgataactagttataagaaaatgtggttaatccacatacttcatttcctgaccctgttggagaaaaatgtcttgggcagccccaaatcagtatttatagcttcctgtttaataaaagttgtttaataaaagagttttgataaagatttcttttagccactgtgatatgagctggatagggaagtgacaattgagaggctcagaggaagacagagttggttttggtcaagctggaagttgcaaaagagccatgtatcagggagagaacagggcagcttagctctgaaatagggttggacattcgttttttactcttctcagaaagtggccaaggtctacagggaccatattcttccattatgacaaaactggagactagagaaggcaccagtaagaatgttgtcacaatgccaagctggttttaatagtgacatatccataaaaaggcagcagagagacagacgggatataaggagaggaagggggcacatttgagcagtaactgttctcagtggaagtcaaaactctaggctgcaaaaatgttttttaacattaatttactttcatttaaaatgccaaatcacttaccctttatgcgcacactttcacttataatgtggtgtttttttcaccctagaataaaaccctctcccagatctctgttatgaaacacacaataaaggccaagcagtgcaatttcttttcactgcctgtattattaaacattcagacaatcggaaaatgtttcttcatgttacctggaaaccaaaccctagatccagaagttagaattcttggagctattttctcaagcactccatcaatattttttaccaaatccgttgtgcagccttgaaaagataattgactttcagaccaggccaacctggatttcattaccatcttttctacttattatctgggtgacttttggcaatttacttaacttctttgaattttttgaatatatgaaatgaggatgatagtatctctatgaatatactatttttagaattaaataagttgacatctgcctaatgcctgggacatactagacacttagcaaatgtaaaatcctccaatttcccacttaaaaaaaaaatccagccctactaagattatcaaaggattctttcagtatcatgaagatgtgttaagaattttttagagggttttattaagtcctgggaaagtcgtattttcagttgaaaagtataaaacagccgtttgggtaaacgaaaaccacatcatgattttatatacttctgtctaatcctgcatctgtagtagctgacagtttgaagaactaggtcagtttgcaaatagcatccttagattaatttctccagaaaacacagagacaggccttgaatcactaagaaagtgtagaagctttccaaggccatatatggctttatagaaatattccaataaatttatatggcacagttctctggcctgctgtcagatatgtagaaaaggagagtgacaaataaaacaaggtgcatgagccagagtggaaatttggaccaaaatatttctgtggataccagagcaatcccaaggttctgttgacttccatatgcatcaggtttccagcctttacaaatctattattatctctgtgtataaagtttttttttttttttttgagatagggtctcactctgtcacccagactggagtgcagtggcatgatcatagctcactgcaaccttgacctcctgggctccagcgattctcccacttcagcctcctgagtagctgggactgcaggtgcacaaaacccaccgtgcccagctaatttttgaaattatttgtagtagagacagggtctcactatgttgcccaggctgctcttgaactcctggcctcaggcaattctcctacctcagcctcccaaaatgctgatattacagatgtgagccaccatgcccagctgtttagttttaattgtgccaccagcaatttagaacatgtaccttggtcatttttttcctagttatccagctatttctgttgtgctctgtccaccttttcttttggaatccttcatagggtgagaagtacaccattttgagcttttttcagctgtggaagagaaaactaactgctatataccagcatttagctaaatgaactaatgaaaacttcattaaaaaccaatgctcatagcagctgagaactaatgaattgctgctctcatagcagtctgcaagttgtagtggaaagagcatgtggctttgtaatcagatggacctaggtttgaatcctgtctctttgtgatctcgaatactttacctctctatgccccagttattccatatgtaaaatgggcataataagatctacttttcagaattgccagtttacatgcctctcaagtgcataacttcttgaataagatgagttttaccagggaatatataaagcactgaatgaaaaggtataccttctaggaacatgaattttactctgaattttggaaggatagaatttattgtagagttcattttatgacaaagtacaacatgagacttcaaacaaatttatgcttgtagttatttaaggtcaaacttaaactacccatagtcacaagcttacttatttcaacaatcaagagttctcagaaagttgttaaaagaacttatgtatataacaatatttagcaagtgttatcacagtcagattcagtgaaagatttactgcaagggaatctgggaaggtggatatatctttaagcattctatcctctgtagtacagcaaggtacatcacaaagaagatgcaatgaggttgagtaagttcacagtatccattgcacaaagtgttggctacatggtagaagctcaagaaatgctaattctcatctcttctaaagactcaaaataagattttaaaggaaactctgtgccctgactatggtttggggaattgtggcaaagatagtttacctcctgtgatcagttttgtggaattctggaaagaggttcttgtggcagagagagtagtgctcaccaaatagtccctttgttcccctgcatttccaggccttcccacaattatgttgggtcttgtggctaattttggctaatgaaatatgactggaagtgatgtgtgcacttctgggctgagacaatgataagtatgtgtgttcctggaagtgcaagtacaaaatgacagagcttccctttagcctggcttctccagtgatctaatggagcatgtatccactctgacacataggaccctttgtggacatacagcatattattttcataaacttttgttgtactaagtgactgagatttcaggagcattttataccacagtataaatctatcctattgtaactaataggatcatcatgtaaatgtactaagagttcatcaagctgattaatattttctgagaaacaccagtaattctcaggaagcttagcctgttttgtaaatgaaattttttctttctcttcctcactttatatagttcttaatacagagccccaaaggctgccatgttactttctttttacttgaagccatccaagtgaatgattgtaacccagaggtcccagatgaagaccactgggccttttcacacttaaaacatgtgaaaagtgttatttgttactgcaattttagctgttgcttttagagacctttactatttgcagctgactttctttccttctgggtctaaagatacctttgttcgaaaaggaacctttgtctctgtttgcctcagcaaaactaagtgtaactgtagcataaccaaattctgccacagctaaaatgctagaatgtaagtttgtgacattccttctgccttcctagcttataattactaggattttttttagacaaggccgctaatttttgaaaaataaagaatagagacttgaaaacactttgttctctttttgccctcacttctgtaccctttctgtcatattttcatctgaattaacttctgctacagtaattctcaaccttctttttttctccaatcttgccattacagcattggtgtgaaagtccaatgaggcaatatgtgttaaagcatttcataaactatgatgctataagaatgtaaggaaaaaaaacaaaccgcattgaagacgtccttgccccatcactaggcccataagaaacccacagcctattgctgttcagcaactgtgtgctatgagctttgccaacttgagtctcaatgcctcaactccttatatctgttaccatgtagtggtttcacatttcattttatcttttctttttagtaacatctgtcttcctcaccagctccatgagtaaagcagccttgtttgcttttgctcttcattccatctcccagtgtccaacccagtgactggctcagagtagacagtgaataaatactccctgaaggaatggatagatggctggatgaactgatgagtggataaagcaaagggaacacaagggtgacccaggaaatagagatgagcttctcagttttcccattcagcattcctgcagtctacatgttgctatgggccaggtcaaacagatgtttagaatttcttcagcaatgattttttaatggtgccttggatattccccaagaactcccaagtcctggtccctaaatgaaaaaaactctcctttacaatgattgcctcggtcagtataacagtttgccaaacccatgaggctctgcttatgagggaaaatattctccaactatggccactgtacagcatatttgtttttttcacgataaccagaactgtgacttctgtaggcctacttgtaagagttgcatagctttaagattatcttaggtcgactccctacttccatgtggcagatattttaaattgcagttgcagcctttcagcttagaactgcttgtcctgaagacccttaaattctaaaccagaggggctgttggggaggagaggttggcatgggggttggccttgggagggacattgtccctcccccatccaggaggccctggtgccaaccagtcatagtagagcaagaggccctgaaacaggcacttctgggaatctgacagtttttgctgctccgttgtccatcatagcccaagcagagagggtggcttaaaagcacaggaaatcagcttggtgcagcagcttacgcctgtaatcccagcatattgggaagctgaggtgggcagatcacctgaggtcaggagcttgagaccagcctggccaacatggtgaaaccctgcctctactaaaactacaaaaattaactgggcatggtgatgcatgcttgtaatcccagctactcgggaggctaaggcaggagaaccgcttgaacccaggagacggaggttgcagtgagccgagaccacaccactacactccagcctgggcgacagagtgagatttggtctcaaaaaaaaaaaaaagaaagaaaaaagcatgggaaaacaaagtctgcagaggcctttcagggtccagactactttggggcattttagcagagaattgaatgcaggcaattggttcactgttgatgaaggacctgagaatccagcaggaaatgatgaggccacttagaagttagcaataacaggaagctccacctctcttaggctacaggggcaaagtaagagggaagatgctaccagcatccagggtgcagagccactttgcaaaagccagaaccacagtggacctggccagctagtggagccacagagaagacactgttgctgctggagattccacactaggtcaagtgggggacctgaggtactatggttttcccttcctcctgccctccagtctccttcagtgcctcctatttggcagaagccatgtgacacagaagcctcagggaatcatccccctgtgataactgaccaaactcaggaaaagtgcaaggaatggatttgatggcaaactgtcccaggacagcaacaggaaggcatctgattcttccctatgtctttacttcctagtacacaatacgttctcaataaatattacactgaatggattgaatggctctgatacttaactctctcagttatgtgaaataagtcacttcgtgcctttgagtgtatttctggacataaactagagataaaaatgtgttccccattcttatcctaactagtagaggattctgatctttggtgtctttcaggagctctgtgccatcttgcagaggttttattatcattgtacaagattctgatcagtgagttaaatcatcctcacccccaggattgaccttgaaagtcattctttggaatgggaccataatgtttaatggctttaatgtgatttgtttatttctttggtggagtgcaagaaacatacagatttctggtcccaagtaacttacatgttgctctagggtatcactttaaaatatttcatgatttattcgtttatattttcaataagtaacacagatgctcctcaacttacatggggttacatcctgataagcccatcataagttgacaacatcatgagtcaaaaatgcatttaatacacctaccctactgaacgtcatagcttagcttagcctgtattaaacatgctcagaacacttacattagcctacagttgagcaaaatcatctaacacagactatttcataataaagtattgaatatctcatgtaatttattgaatgctgtactgaaagtgaaaaagcagggaggttgtacgggtacttgaagtacagtttctactgaatgcacattgcttttgcaccatcataagttgaaaaatcctaagtcgaaccactataagttggggaccatctgtacatgcacttggtttaatattcaaaaggtacagaggacttgcagtgaaaaataagtctatctttaagtcctacatccaggccacttggttctcctctcaaagaagcaatactgttgccagctttttatgttaaaatgtcaatttaagacagtaattatttccccaatcttccaaatggcaggtatattagttttctagacttccataacaaattactacaaaccaggtgtcttaaacaatagaaatgtattctctcatagttctggacactaggagttcaaaatcaaggcattggtagggccaatgtcttgatggccaaaaccgcaaggtaccacttcgaagcctctagagaagaatcctccttccttgcctttgccttcttctagtgtccttggtatttcttggcttggtattttaatccttggtatttcttggcttgtagctgcatccctgcaatctccgcttcagtctttactggccttctctgtatgtgtatatcattgtgtgtcctctcctcttcttataagaacacagtcattagatttagagtccacctaatctattataatatgatttcatctcaactaattacattgcaaagatcttttttccaaataaggttgcattctgaggttctgggtagaaatgaactttgagaggacactattcaacccattattgcaggccatgctgcttctcaaattcctctaaaaataagacttatatagggagatgggggtaatatcagggataaaaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaacccctaacatctacttcacaagcctgtggtcatccttcagtcctcatacggatattacctactctgagtagtcgtttctgtctgcttccttcaagaccagagttgttgatattgttcttctgagaaaccctggctatcaattttccagcccttgccgtatgaagacgaaggtattaagtgacagaattgggtttgagctagccctttctgacttcaaagcccatgtgtcatggaaccatcgtattacactgtcttcaaaccccttccaaagctaccctaaccacattgtatggcttatgggaaagaaagcctatttcctccaccaaactatgaatccttcttgttatccatgctgaagcacaatcccatatttcgtttgtgtcctaaagcacataataggtgctcaacaaatgtctgacaatagactagaggaatgtatggataacaagaaagctagacctatactttctaggacatgatacatttttatgagttgaaaggaaccttagagaaaaatttatactaaagtcaaattgagaaggtattccaggctacaacagtgacttagcatcaaaatgagacaatgaatgatgtcttgtcgttttctagcttcttgctactcaaagtgtattacagggacaccagcagcatcacatcacctggggatttgtaagaaatgctgagtttcagaccccactccaggcctgtggaatcagaatctgcattttaatatgattcatcccattacagtttaacaagcattttcattttgaatagatcactgagctttcaccaaactaatctctcatcctttagttgaatgtcctttttttgttattttctagagatgaaattcaatttgttagtgaatccacatgtgtgaggaatttactaaggaggggatggtgctagtgaaattaattaaattcactcagtgccttggaaataaagcttgaacaaaggatcagaaaaagttcctttagtgcagatgggataactgttttctcatttagaatagcgcccactctggctcagatccaggcaaaatgtcaactgctccaactcatgaaaggtcaatgaattgcctcaaacattttatgaaatgctcatctcaaagctggagcccccatggagatggttgatggttgtatgcagtccaaccccatgatgtcatcagtcttatgcccttgtcccagcctgattcatcccctcagcttctaaggtggagccgtttgaagcttcattttctcctatctgaagttgagccaactttctattatggttatgggaatagagtaatagcatgaaacagagaaagcaacagctcatcggcataaagtatttctccccagagtttcaacttctgcccctaagtctttttactaaggctaattagaattagtaaaatcatttagtttgaatttcttattttctccagctgttcttgatgcaaaattagtggtgatgttggcaggcgccagaagaaaggagagagtactaaaagcatggataatatacagaccctataattggtcccttccaattatctgtatttgtaaactgatgccaggaatatagagaccctttgggactgattcctgtttacagacacagtaactggtacatagaagctgcccaataaatacctttcaactaacctgaagcaaatacaatctaattatctgtcacttagaacatcaaaggaaatgccataatgccttcagaatagagactgtcacactgaaaagacaatatcttaaagatttatctgaaaaagcatggtagaagacttccactgtgaccaagatggagtaacgggaactatatttacccttcttcctgaaacaaacaaaaaagcaggtaaaatgtgtgatactgcaatgctcaaaaccttggacatcaggcaatgactcctgagagatgggaaacaaatgagatgcccctctgagaagtgcccctgccttgatctctcaagccatggcccagggagagggaaccgcaggagagcctgacagactccctgggttgggaagacagagctgagagtctggaagaccgaaacagccactgttcacaaggcagataccagtaaggagagaactacacagagaatcctggagattttgaaaagggtcctctagcatttagctgagaaccgatcagtgtatgtgtatgaggagactacacagagttgaggcaaaaactacaccacaggatgagaagaaatagtgctgagcactcacacaaggccagaaataatgcctgtcctgccagtgggactggaaaatgtcatgattcatgggacattgggtagagcacacataagggcctcacctctatggaaagaattagccccagatggaataccactccagtcctgcctaacaaaccttaatagcaatacctgaaaagaccaaatggtttccaaataactgtgtcccagaaaaaaaaacactgatgaatagttttaggaatataaaaatatccaaccttcaataaggtaaaattcacaatgtttggcacctatgaaaaaattaccagggccacacgcagttgttcactcctgtaatcccagcactttggaggccaaggaaagaggattgcttaaggccaaacaccagcctgggcaacaaagcaagagccccagctctacaaaaaataaaataaaataaaataattaaccaggtgtgatgcacattttaacttgcatattagtctaagactctgggaaattttctcctcctgtatctttttgtgtcctaaacaaactgtttgagtcctgtctattcttcctcacatgtggatttccaaacacttctctccatttccacgaccacaaaaccattgaggcaggtacattactgggcaggggaggggcagccaggggccagctttcacctgtgtgagctgtagtgtggtggcacactagagccagctgtagtaccagctacttagaaggctgaagtaggagaactgcttgagcccagaggcttgaggctgcagtgaactatgatggtgccactgcagcaaagcctgggtaacagagcaagaccctgtctcttaaaaaaaaaaaaagaagagagagagagagagagagaattaccaaacatgcaaagaaggagcaaatctgacccatgatgtagagaaaaactgatcaattgaaactgacccagaactgacatggatgttagaattatccaacatggacctttaaatagttaatataatggtattccttatgatcaaaaagttaagtaaaaacatgaaatttaaaaaaaaattaatatcaaacttctgaatatgaaactacaatgtgtggatggaaaacataccaaatggcattcatagcaaaaaatacctagtaatagaaactattcctaatgaaacatagaaaagataattttttaaaaatgaacagagaatcaatgagctatgctacaaattcaagcagcctaatacacctatagttggagtccacaaaggggagaaggaatcaaaaatcatttgaagaaataatggctgaaaattactcaaatttgataaaaactgtaaacccccaggtccacagaagctcaataaaccatacgtgcaagaaatatgaaactaatgacaccaaagtacattgtaatcacaaagctcaacaccagtattaaaaagaaaattttaaaaagccaccgaagaaaaaagacacattacacatgcaaactaatctataataagaggaacaaagaggtggcagctgatttctcactagaagcaatgcaaatgagcaggcatttaagcaacattttccaagtactgaaataaaaataactgccaagttgtattctatacccagcaaaaatatccttcaaaaattaaggtgaaatgaagacttactcagacatacaaatgctcaaagaatgcatcacctgcatacctgcactacaagaaatactacaggaagacttcaggcagagagaaaattacatcaaatagaaatatgtatctgcggaaaggaataactacataatgttacgatggtaacactttcctcattgatttgtaaatccaatgccatactaatcaaaatctctgtggatcttttaatagaaattggaaaactgattctaaaattcatatagaaatacaagggactcagaatgaccaaacagcttaaaaaaagacaatactagaggacaaacgccacttcattctagtctttttataatgttacagcaatcaaaacagtggggtattgacaataagatagacgaattgattgatgaaacctaatagggagtccagaagtggactcacatatatatgggtaattgactttcaagagaagtacaaaggcaattcaagaaaaatagtattttaagcaaacagtgctataaaaatataaaaattgaatatccaaatgcaaaaagtacttcaatctttatattacactgtatacaaaaattccttcaaatgtatcatcaacctcaaagtaaagcatacaactataaaacttctagcagaaaacaaaacatttttgaatttgagtttggaaaaggttctagataagacaccaaaaacacaataactaaagcaaaaattgataaattggatttcattaaaactaaaaacctattattgagagaataaaaacacaagccaaagattgggagaacatatttgctaagtgtgtattgataaataacttgtatccagaacatatatatttatttatttatttatttatttggagatggagtcttgctctattgcccaggctggagtggcacgatctcagctcactgtaaactccgcctcccaggttcaagcaattctcctgcctcagcctcccgagtagctggaaatannnnnnnnnnnnnnnnnnnnctaatttttgtatttttagtaggagtacggggtttcactatgttggccaggctggtcttgaactcctgacctcaagtgatccaccccacctcggcctcccaaagcactgggattacaggtgtaagccaccatgcccagccaagagtctatatatttaaaaaatctctaaatttataataaaaaggcaatcaatgcaatttttaaaaggacaaaaatgtatacagacacttgatcttagaagatagatgcatagaaaataagcacaggaaaaggtgatctacttcattagtcaatgcacacatgcaaattaaaaccacagtgagatactgctacattcatatgaatctagctaaaattaaaaatgatcactatattaggtattggcaaggatgtggaagaactcagaccttcatatacttcagtttgaaaatgaaaaatggtacagtcactctgatacagtttggctattccttaaaatgttaaaggcacacctaccatatgagccagcaattcctctcctagctatcaacccaagagaaatgaaattatgtgtctatacaaaaccataaatgttcatagcagcattatttgctgctattactataaccaaaaactagaaacaacccactttcccatcgaagggtgaataaacaaacagtgctgtatccacgtaatggattacttacccataaaacaaatgaactattgatacatgctacaacatggatgaatcttaaaacaattatgctgtgtgaaataagccagacaaaaggaagacatactgtatgattttatttattaaaattctagaaaatgcaaactaatcttataatgagagaaatggagaaaggactgtcatggggggtatgtatgtctaaaattattgtgcacttaaagtatgtccaatttattgcatatcaattatgcctcaataaagctattagaaatgcagttatagaaatagtcttgcagataaactggactatttgctattcctgaacatcctcagctttcatacatttctgtccttggtcatcatgttcccacagactggaatacccactcttcattctccacctgtcaaaatcctgttattccttatgccccatgtcaaatgctttcatcttcctgaagtatttcctgatccttacacatatcatggctttccttccttgtatatgctgtgcttcctgaatggcacacctgttctgccatgtattataattattttggtaccatccgcctcactaagctatacatggcttagattacatctaatttatctttgtatcccctgtcttcctatgcctagcagactctgtaaccatggatgggtaatttttgagttcagtatttggaggacgcaatttcctaaatatacaagcattaatttggaaataaaactgtcataatagaatgccctccttctctgctgtaatcggatctttagtatctcaagcattctctcttttgcacttctgcacccccattatagctgcagagacattctggctggtctccttgccccgtctctgtcttctccaatctgtcttccccagcatgatatcactaaaatgcaaacttgatcaggtcactctgcttgaataattctgtcaatgggtcctcacgctgcctcctgtttgtccctttgcttttttgcccacctttcccctacacttctaagccactcaagaactacttgtggccgggtgcagtggctcatgcctgtaatcccagcactttgggaggccgaggcaggcggatcacttgaggtcaggagttcgagaccagcctggtcaacatggtgaaaccccatccctactaaaactactaaaattaactgggcatggtggcgcatgcctgtgatcccagctactcgggaggctgaggcaggagaaaaagaacttcttgcacattccatcatgtgcaatgtactctcatacttatgtctcttcctcaggctgctgctcttcttgggatgctctccccttggcctctactcttcctttttggcttagttaacttttcctcttcattcaaaagtaagctttagggtcatcactgttctagtcattatacatgtaattcagcccatttctatctgcagatgaggaaactcagatgcagagaggtaatttctttctccagggccacttagctcatagccagtacttggacctaggcaaactggctctgttaacgacattctaacttctgtgctatgcggcctctcctagacggcagtcattgggttctgtatctgccaccacccaaataccccccccaccgcccccccacccccacacacacacttcagcctctgtggacagtgagctctttgaagtccatggctatgttttctgcctcagtatctccagtacctagcaggctgcctagcaggaaacaaacattcaaggaatatttttgaatgaatgattcaaacatgattaaggttgtttgtacttgctgcacccaaaaatctaacctctttcagtttatgtttttgtagaaggtacatttaagtcttgctttcaggccatgctttcatgataattgataaacacccctcatacaaattgcccaagggtacactgctggatgtaaagtttaatcacttgactcacacatctggagggaacaaatgtttggaatgctgtgaggcagaggcagacatctgaccacctaggagctcagaaggtctccctggcagcacacacagcattctcctctcgctctccactgcctgctcctcccaacccaccccatgcaccttgatgccaagaagtagaaagttttgggttaatttctttcatctgtaacaatttttctgttctactattttaatacacattatcttaaaaaacaggaactaatgaagtcgaaacaaaacaagtctaaccccatagttttgctgcctcacagagagactgactttcttcccaacttgtctggcaccttggcatttactataagatgagaaagattgaatttcatgtagtgtgaccttttaaaacttgagttgaacatttgcattattctgatttttgtccttctttgcagaattgcatgacaatttaaaacttgtctagatagtttagatatagatttttttaaatagcaattttgtgggtagctgatttatttgtttgtgcttgtttaaatcagtcaggtaatgaaaatgattattgctatctacaaaagaggtgaaagtgtctttgagcaaaggcttccacagagaaaataattatgaagctgtcatttccataaagaccttgacagtgaaatatctacaaagtacagtgagtgtttaaaatacagaaagagctactagtcacaaatttaggaccagctctctggaaaatgatttaaaaagttaaaattgcctccagcacaccatgaattttctactccttccccattctctgaacatacataaacttagttgttaagaaatctggactcgcagccataaaaaagaatgagttcatgtcctttgcagggacatggatgaagctggaagccatcatccccagcaaactaacacaggaacagaaaaccaaacactgcatgttctcactcataagtgggagttgaacaatgagatcacatggacacagggagggggacatcacataccatgacctatggggcgttgtggggaaaggggagggagaacattaggacacatacctaatgcacgtggggcttaaaacctagatgacgggttgataggtgcagcaaacaaccatggcacatgtatacctatgcaacaaacctgtatgttcagcacatgtatcctagaacttaaagtaaaataaaaatcaaaaataattaaaaaaagaaatctgggctctaggctcaataatagtacctgcaagtgtgaccttgggcaaataatttctcttctctggaagttaggcttttcacttgtgaaatgagtgatttgtttaaatggcctcgaaattccttttagtttattaattgtctttggtcattcattcattcatgcatttaactaggataactttggtttctgcttttcctctgtacatgcatacttcattgtgttgcactttgctttattgtactttgcacatactcttttttttttttaacaaattgaaggtttgtgacaaccctgccttgagcaagtctccaggcaccatttttccaacacattgtgcacactttgtatctctgtgccacatttttgtaattctcacagtaattcatacattctcattattttgtatctattatggtgatctgtgaccggtaactttgatgttactgttgtaattgttttaggataccacaaactacacccatgtaagtcagataactgaatgcataaatgttgtatgtatcctgtcggctccatcgattggctgttcttcccttgctcccatctctctccctctcctcaggtctccgtgttccctgtgacataacaatcttgaaattaggccagtgaatacctctttgaaggtttctaagtgttcaagtaaaaagaagagtcacacgtctcgtctctcacttgtattcaaaaactggaaatgattaagcttagtgaggaaggcatgtcaaaagctgaaataggctgaaagttaggcttcttgtgccaaacacttagccaagttgtgaatgcaaagggaaagtttttgaaggaaaccaaaagtgctactccagtgaatgcaaatgataagaaagcaaaacagcttttttgctcatatggaaaaggttttagtgtgctggataaaagatcaaaccaaccaccacatttccttaagctaaagcctaatccagagcaaggccctaactgtcttcaattctttgaagactaagagaggtgaagatgctgcagaagaaaagtgtgaagctagcagaagttagttcataaggcttaataagccatctctgtaacatagtgcaaggtgaaacaagtgctgatgtaggagctgcagcaaattatccagaagatctagctaaggtcattgatgaaggtggcttcactaaacagtagattttcaatgtagatgaaacagcctagaattggaagaagacaccatctaggactttcatagctagagaagagaagtcattgtcttcacatcttcagaggacaggctgactctcttgttaagggctaatatagttcgtaactttaagttgaagctaatggttatttgccattctaaatatcctaggaccacaagatattatgctgaaccttctctgcctgtgttctatagatggaaaacaaagcctgggtaactgcacatctgtttatagtatggtttactgagtattttaagaccactgttgagacctgctactcagcaaaaaaagatccctttcaaaatattactgcttattgacactgtaactggtcacccaagagctatgatggagatatacaaggagattaatgttgttttcatgtctgccaacatagaatctattctgtagcccatagatcaaggagtaattttaactcttatgtctcattatttaagatgtgatcatgagtgaaggcatgaatcatatagccttatgaaatgtatttctagcacaggagaactagatacaggcagatatatttcttaaatacgtttcataaggctatagctgccatagatagtaattcctgtgatggatctgagcaaagtaaattaacaaccttctggaaaggatataccatcctaaatatcattaaaaacatgtgtgatttatgggaggaggtcaaaatatcaatgttaatgggtgtttggaagttgattccaaccctcatgggtaactctgaagacttcaatgaaagaagtaattgcagatgtggtagaaatagcaagagaactaaaattataagtgggacctgaagatgtgaccgaatttttgcaatcccatgataaaacttgaacaaatgcaggcgtcgtttcttatggatgagcaaaaaaaaagtggcttcttgagatggaatctattcctggtgaagatgttgtaaaattggtgacatgacaagaaaggatttagaatattacataaactagccaggcacgatggctcacacctgtaatctcaacactttgggaggccgaagcaggtggattgcttgagttcaggagtttgagaccagcctgcccaacatggtgaaaccctgtctctactaaaaatacaaaaattaaccagacatggtggcgtgcgcctatagtcccagctacttaggaggctaaggcaggagaatcacttaaacccagggggtggaggttgcagtgagccaagatagggccactgtaatccagcctgggagacagagtgagactttgtctcaggaaaagaaaaaaaaaaagaatatcacataaactttgttgataaagcagcagcaagatttgagaggattgactccaattttgataaaagttctgcagacagtaaaatgctatcaaatagcatcacatgctgcaaagaaatattttgcgaaaagaagagtcaattgatgtggcagacttccttgtcttattttaagaaaatgacacagccacgccagccttcaaaacccaccaccctgatcagtcagcagccatcagcattgaggcaaggccctccaccagcaaaaagattacaactcgctcaaggctcagatgatcattagcaatttttagcattaaagtatttttaagttaaagtgtgtacattgttttcttagatatattgccattgcatgcttaatagactgcagtatgatataaacataactcttacatgcaccgggaaaccaaaaaaattcctgagactcattttattgtgatattcactgtatggtcatatttactttattgtggtggtctggaactgaacccatgatatctctgagttatgtctgtatctagttctcctgtactaactaaattgcctatggtgtttcctacttcctgaacccaaattccctggctactctctagtccctttatgtgatagattctctttaaatccttcctgtcccatccagcttctatctcctcttcagcatactctcttggccctcttctctgctgggtggcagctactgatagttcctgttaacaggttcttggatactaatagcttgatttactgccttctacaggtaacacatctttatttatatagaagcctgagacacaatgcttttatctgtatcctctcccattttctcctcctgtaccctcactaaggaaagatttagtagaaattacaactgaatggatgagtgatattttggtaatggtgaagtactgttattatgttgaagcactgctaacttcacatactaaataactgctttaataatttattgagaatagaatgatgattctctgcacctaaaataggtacaaatgattctctcacattaggaatttcttgagttatttgaaaatttaagaaagtgtgtgcttgttcaagattgcttgagtataatctcagtgattattgaaacaatatctgtgttgagttctcttcacatggctcctggcatgtctggcaagtactaggcactaaaaaataattgataagtcaataaatgaaaaggaatttttctcacaattttgtaaatgggtcagacagataaatcttattattttacatgaaactctgacataatgagagattgtacttgaaagagagattattagatgaaaaaatccaggactcaatccaagagtggggcaatgaggagataaagtggcctatttttggagaggtataagtcaaaatgctttctagaaatgttaagtaggcagcatgagtgctgccaattcccatttccatgcccacagcaaacatccataaatgattatgacatttatcctagatgagcctggaatgaggcctcagattcctttcaagacatcatttcaggcaaccgctaccatttaatcaaagttggcctagaaaataaaacttacatctcatcctaggttagtgattgccccaactccactgagaaaacttggtaacttgcagtctggctagctcttctgaaagggagatactgccaagataatactgataaaattgtacactggggcctagagaagaggacaagaggcatcaaggatgttgggtcatccaacttcaattattggaaagatattgattgcattaaaacaaaataaccataggataaacagactcttgaagagtagcttgtacatgtatatactataagtctgagattgtaacaagacatccaaatgaaaatggagatatttaaccaaactcacaatgtttctttccaactctgaatcattttcagttttttatcgtagtaaatagcactgtcattaatttagttgtctaagctcaaaacctaggcatcaccttgacacttctctcttccctgccacctcacagtttatctatcataacatcctgtcagttttattttctatacctttttctaactcatgtactttatgccatctccaccactagatattacatgggacatactaatgctaaaaaattattccgtgtttatctgaaactcaagtttaactgggcatcaaacatttttatttgctaactctggcaaccctagtttaaaataatctaattcaaaagaagcaaaaataggccctcagactctaaatgctatgatctagattgggctgtgggatagattatttatcaatgtaagtactaagattataagacaaatgcacatttatttgccctgcatagcaccttgtctatttagatgccttattatttttttaaatcagctgagcaagataaaaccacagaatattttgggaggtatagatgatatgcatagtgagaaaacaaaatattttctttagttttgacattagctgacttttcatctaaaactaataatgatatcatttccccaggaaaggtcaaagtgctgaaattctccacatattttgtaaatgtatgtgtcactgaaaaactgaaatctagccaacacaagagatattgtcagtttccctcagagcttagcagaatactatatcatgcatgacctgtttttgaaatgggattttgtgaaaaatagcagaacacctcttctggtttctttttcattaactgctcacacttgacacattccttaaatgatctccttagcccccatcatggcaacctgcttcctaaatccacattcttagctgaggattgtagtttcaggcaatagaatcaactccaactctagttaaggatattatggtgttcacggatttcctcaaaatttcaaaaaaaacaggctcaacaccaaccacactgtgaatgctgctctagggaaaatacccctgttgtcacctccttaacaactgtctcacaactcacacactgcctaagcccacaccaatgacacctgagattggccaagctctacctaaaagtggggtgcctcctccttcctgccttccagatgatggagtctatgcatgtctatgcacatttacttcctgatgttgcctccttcagaattgccattcagtgtgagtggttctgtccttgagcaacaaggaaggctgggaacttggattctggcttctatctttgggaagctcaacatgtaatttggaaaattttccaaatacacaggatgggtattcaaaagatattgaacagcaaccaacataaaatatgttccctgctttcaaaacaccacattttataaccatcctgctagatggagcataatgattaagacatgggctttggagttcaatgaactttggttctagttccagttttacctcttactaatgggaagaggcaggatgggctaccccactaagacaccatcttcttatctgtgaaatagacacattaataccattcacctcataggatggtgtgaggataaaatgagaaaagtgaacaagtatggtggtggagtttgcctcttcatggaacaagtacttatccttattacaaatgtgattactaccaatctttttacctctttcttttacatcttgtagttacaacccattttagtattttttaaacaatctaatttttgctttgatgttatctttttcacataagaatacttctttttactgaagcatttcatcaatgacattatcgcaaaaggtttacaagtattcttttttttaagttttctaattttttcctgattacgctgaaaaaaactagaaactacagaaaagcagaaaggtggaaataaaaacaccccaaaatgtcatgatctagagttaaccactgttatttatttgtctgttgagaagtatttttcatcagccataggaatcacagatttgaggaactgaaggcgaccataatgaccatgtggtttgaattctcctggattccccgaagttgctgcaagccagcaagacttcatcctcctgactagtttcatctgtgttttctccagagtcacttggaggggaaaggtcacttgaaacttttgttgtcaggttgtgagttttgttttatttattaatttcgtagtaggaggcttcaagttttatgtattagcctcatgtttctaaacagaggaagtagaggatgctgggaaatatcacttggctccatgaaagcctttgagagagcaagaggggaagaaaattactcttttattgtgagttttgccaaatgatctctgagaagctgtgatatcattcatacgccgtgccaagctggatcgaaacggctcatcttggcagacattgagagtgagcgtataattccttggggttgggatgggctgttatcagaaatagttccataggcagtatttacataactgtggtggagggtgagaataaacacagctgtggcattgccctaaatatttctattcagcagggaattaaaagagaactttatcgctgaactacagataaacacaattcatcaagcagtggtcagttcaactggggaacaaaataggagttataaaagactggcctgctgaaaatagctccaatcagccatcctgactttattgctgctttactccctccctccctcttttttcctagttccagaaatgtagggctcatcagccagcaaggaagttgtctagattttctttaccccaagaaggaagtcgagggtactgtcctttacagagtggagacctaccctgggccagcatgctttatgtatgttccttacatcagaatggttccccgttttctttctgggctataaaactgaatgttagtgggagtaagatttattgccaagaagacaactttttttttttttttttttttttttttttttttttttgaggcagagtctcgctctgtctcccaggctggagtgcagtggcgccatctgggctcactgcaagctccgctttccgggttcacgccattctcctgcctcagaccccccgagtagctgggactacaggcacccaccacaacgcccggctaattttttgtatttttagtagagacggggtttcaccgtgttagccaggatggtctcgatctcctgaccttgtgatccgcccgcctcggcctcccaaagtgctgggattacaggcgtgagccacagcacccggccctaagaagacaactttttaactccaaagtgagctaaaatggacacatgattccacagctctaaatgatctaaattcatcttatgaatatctttaagcgcccatatattttaaatagtagtgcagtcctggttctgctatacccaggaagatagttacatgatgtatttgtgtaatagttttctaggattggcataacaaagtaccacaaactgggtggcttaaaacagtagaaatttatcctcgctcagctttgtagaccagaagtctgcaatcaaaatgtcagcagggttggtttcttccagatgttttcagggagaaaccatttcatacctctctcctaacttctcgtggttgcctgccctcattggcattccctgtcttgcagctgcatcactccaaactctgcctccaccttcacatcaccttcttttctgcatgtctctatgtcttttctgtctcttataatagcactctcattggatttaggacccaccctaatacactgggtggaataatgagataatgtgataaggatctcatctgaatccttcccttaattacatctgcaaagatcctatttccaaataaagtcacatcctgaggttccccaggaacatgaattttggagggatactattcaatgcactgcacagggtgagttaattggaggcagagaccatgtactccagttgcctctacagcacatgacacacgccagacacctcatcagtgttctagaacacttgctaattagctgtgacagcattgcatgtttcttactccgttttgtaacccaagagatttactgggattttctgtttcaatatgcatgccttgactctttactaatagaatttctaagagagacctatagctatagataataggaaaacattatgttcactaatgtagttttttcccccatttactgagtcaacagaaagtcttaaaatgctaaaaacgtaagtgacaattactaacatcaggtcacaaagcacttccataattattatctcatttgatactccagtaaccctgtgaatgttatcaccttcattatcatcatcatcaccactttgatcattaccacaaccatctcaattttacatgggatgaagaaacttgaggctcagaaaaatgaaaagacctatttgaggtcagtgtatgagtcaggacttttggttgtattttgaaagtagcccaatttgaactggcttaagaaaaaaaaaaaaggaatgtagcagaccaagtccttccctctcgatggcaaggtggtcatcacagatccgtgattccatccaaccccccagtatttacaatgagggggaaaaagtctccttaacaattattcctggaatagaatttctttactctctatcactttctattctggaatgtgcattacactgcattcagtagaaactctgggcctggatctctttggtccaaattgtttcacacctacaaccctcaagccatcaaatcccccagaccacttagaatgagattgaggataaagcctgttaccagaaaagcagggtatggaaatggcagacaaacaacagatatccataagaagcatagttcacaaatgacagcttgggcttgagacaagatggttttaaccaatagttctatcctatggcccgtccttctcctcttctgtttaaatgcattgaatacatgataaatgcgcctggaacaaaatttaaaagatacaaagttatacagtaaaaatctcccttccaattttgtcctcctgtcactcagtttccctcctaattgaactcatctctatacccctccagggatagttatagtttccacatttacaagcatcatatgagttgtttttacatcagtgatatattattctcactgttctgtccggctcttttttcgctccactctgttaggtatttttggctctctgactttaatgacttcaaccacccaggcacaatgacattttcacacaccacttagttttcactcttgagttttttccgttttcctttttctctccttctccctaccctcttcttactgcatttcctcattttacctccttccatatgttcattatgtaattgttgaagttgaaactacctttttaaaaaaacacataatactaaacatttgaccctacaaaatggttcttttggggtatgttatcagcaaaaacctactaaaaaaatgaaaccattctcatctcttttcaccacagagtcactgattagctcaggctatgagaaagcaaagagacttcaacagctaattgtagctctagttacggccacaactctcattaacttgtgccccttaacaggaacctcatatagctcttttttgtttttagaacaaagaggtagatgggttaaagggtgacatgttatcaggtttgccccaaatctttcagtatcttgcaaaagactcatgcatctttccctaaagttattttattttccattccaggatagtagaaagagcctttgtataaccttttagtttttcctggggcttgcatttttctgcaaatcccagtactctggaagggagttggactatagcccacctgccctggaggactctccatgcttcattggaccaatacaatacaattttattgtgcacaaatttggaaagactgttcattgtaaactaggaagactcatcaagatgagcatggcactgtgacatctcatgcatgttacttcatttcatcgtttcaataatctcaatagacaagtatattgaggcattctacagataaagaaatcgaggcttagggagtttaagtaacttacctaatgcttcacagccaataagtcataaagccaatctgaatccaataagtcataaagccaatctgaaagtcataaagccagtgtgcattccagcatgcatcttttcaattggtgagaatatgggctgctgaaagaactactgcacagccagccaggaatggaatgtctttactctctatcactttctcttctggaacatgcattacactggatcacgttttggtaaaatgaggtcaaataacaaattaggtcaaaatgcgtgtatctgaagttcagttaatgccaggcaatggagatatataggtataaaatcaccccatgaccttgttgagaatcttgagttgtcacccagggatttgaaggacttcagggacaccaagtacctatcgtttgccttagctagtagagctcattgatattaaaagaggaattttgtagacctttcttctctccctttgggttttgttgggcgtgagggaaaaaaagggggaaggtaggttgctgaattcttttaattactcagtgcacaaataattgacaaataatttggcactttttccatgccaaagttttgtcagatcagcccaacaattcttagcccaccatcatatttagtggtttcatgctgctctcacgtgtttgtcagtgagaggctcattctcaactctcctattgtcattgactcctatcttaagtctaacatatgtctcatcttataagccagagccaaagcttagttaaaaaggatgatttccgggaaccagagccaagatggccgaataggaacagctccggtctacagctcccagcgtgagcgatgcagaagatgggtgatttctgcatttccatctgaggtactgggttcatctcactagggagtgccagacagtgggcgcaggtcagtgggtgcgcgcaccgtgcgcgagccgaagcagggcgaggcattgcctcacttgggaagtgcaaggggtcagggagttccctttctgagtcaaagaaaggggtgatggacagcacctggaaaatcgggtcactcccacccgaatactgcgcttttccgaggggcttaaaaaatggcgcaccacgagattatatcccgcacctggctcggagggtcctacgcccacggagtctcgctgattgctagcacagcagtctgagatccaactgcaaggtggcagctaggctgggggaggggcgcccgccattgcccaggcttcattaggtaaataaagcagccgggaagctcgaactgggtggagcccaccacagctcaaggaggcctgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaagcaatggggaaaggattccctatttaataaatggtgctgggaaaactggctagccatatgtagaaagctgaaactggatcccttccttacaccttatacaaaaatcaattcaatatggattaaagacttaaacgttagacctaaaaccataaaaaccctagaagaaaacctaggcattaccattcaggacataggcatgggcaaggatttcatgtctaaaataccaaaagcaatggcaacaaaagccaaaattgacaaatgggatctgattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacattcatgcagccaaaaaacacatgaaaaaatgctcatcatcactggccatcagagaaatgcaaatcaaaacaacagtgagataccatctcacaccagttagaatggcaatcattaaaaagtcaggcaacaacaggtgctggagaggatgtggagaaataggaacacttttacactgttggtgggactgtaaactagttcaacccattgtggaagtcagtgtggtgattcctcagggatctagaactggaaataccatttgacccagccatcccattactgggtatatacccaaaggactataaatcatgctgctataaagacacatgcacacgcatgtttattgcgacattattcacaatagcaaagacttggaaccaacccaaatgtccaacaatgatagactgggttaagaaaatgtggcacatatacaccatggaataccatgtagccataaaaaatgatgagttcatgtcctttgtagggacatggatgaaattggaaatcatcattctcagtaaactatcgcaagaacaaaaaaccaaacatcgcatattctcactcataggtgggaattgaacaatgagatcacatggacacaggaaggggaatatcacactctggggactgttgtggggtggggggagggagaagggatagcttcgggagatatacctaatgctagatgacgagttagtgggtgcagcacaccagcatggcacatgtatacatatgtaactaacctgcacaatgtgcacatgtaccgtaaaacttaaagtataattaaaaaaaaaaaaagaatgatttccctctttacttggatctgcaagatcatcataggctactggtacacagcttcaaaaactctccctctacatttgctaacaggctttttacaggactttacttcatctgaaagcttctctatggtggttttaagatatagatatgtctacagatgctttggtactctttccttgtatcctagtggagcctaattctcattttcttgaatgtgtattggacttagtgactcacttctaacaaaaagaataaaccagaactcatggtgtgtctgctggtgggaatgtaaactagtaaaaccactatggaaaacaggatggaggttccttaaagaactataagtagaactaccatttgatccagcaatcccatgactgggtctctacccagaggaaaagaagtcattatatgaaaaagacactttcacattcatgtttatagcaacacaattcacaactgcaaaaatgtggaaacaacctaaatgcccatcaaccaatgagtggataaaaaaatgtggatatacatacaccacagaatactactcagtcatataaaagaaaaaataatggcatttgcagcaacctggatgaagttggaaactattattctaagtgaagtaactcaggaatggaaagccaaatatctcatgttcttataaatgggaactaagctatgagaatgcaaaggcagaagaatgatataatgcactctggggactcaggaggaagggtgggagggtggtgagagataaaagactgcacattgggtacagtgtacactgctcgggtgatgggtacaccaaaatctcagacatcaccactaaagaacttatccatgtaaccaaaaaccacctgttcccccaaaactattgaaatctaaaaatcagagaaacaataacaacaaacatggtgtgtgcctttgaagaccagatcagaaaaggcatagcagttcctttttttctttggaggaaacaagctgccatgtcaggaggacactcaagcagcctttggaaaggctcatatggcaagaaactgaggcttcctgccaatggccataagagggagccatcttagaagtggatcctcaaccccagtcaagccttcagatgcctgcaacccctgtcagcatcctgactgcaaattcctgagccagaaccactcagctaagccattcccaaattcatgacctacagatactgtgagataacagatgtttggaattttgttttgttttgtttttttgtttttcagtaagggtcttgctctgtcacccaggctggagtgcagtagtgcaatcatggcttttactgcagccttgacctgggcccaagcaatcctcccacctcagcctcctgagtagctgggactacaggtgtgcaccaccatgcctgactaatttttaaattttttgtagagttggggcctccctacttgcccaggctggtctcaaactcctgagctcgagtaatcctcccacttcagcctcccaaagtgctgggatcacaggcatgagtcactgtggctggcctggaattttaagccatattttaactgggggaatttgttagtcagtagtccataactaacatactctccagaagccacctgttgtattgcccttctggggacaactatcaataggcgcagctccttaggggctccagcttagcctcagagaggcctgtggtggtcttcaatctgtataatttgtggaacatttaaagcataagcccaggcttcaatctctggagatttttactcagtaggactgggacagggtccaaccatttatatttaactgaatgattttttaaaaagaagcctattaaaggatatctgaagaatacttttggttgagaaccttgctgttctttttgatgataaaaagcaacaggcctctctgctctatgtcttttgtattctttctctgaaaactgacaggggaagctcagttcaccattccatgtccctctcagccattgggaagcctggcaaacaactaagctcagtcctttttttaaatgaacctatggcgcagcccttctcaaacttgactagagtcagattttcctggaggatgattgctggaccccacccccagagttcctagttaagtaggcctgagatgggaacctataatttgcatgcaaatactgctggtctgtggccatgccttgagaatcgctgccaaaaagtatgggacctggtatttcaactttgcctcagaaattgtcctagatcctccctacacttcaggtaacaacaaaaaatgaaagcaaacaaaaattcatccatttttgcctgaggcaaaagtaatccatagtgttagaaatttgaatagtgattatatgagaggacaggaactggaaagggtatacaaaaggaatttctgggatgactgtaatattctatttcttgatctgagtgacagtgacacgaatatattctctgcaaaaatacagttgaggtggacacctacaatttgtgaacttttccatctgtatgttacacttttaaagtttacttaaaaattaataataatgataagcgctgtcaaaacctggagaaaatgggcctctgcaacaccaacctgtacctctgtttgcaagtctgctttatcctagggccatgctggcaacccaacaaagaaaatacccttttttctttctttcatttttgctggcatcacttttgtttgtgtaatacctgtggagtggctgtttcccaagatgtcgtttctttgaaaacaaatgccagccttcaaaagaaaacattgtaaatgacgtatttgcatgctttaaattcctagaataatagatattgatagaataacttgaaaagccagttgataaccaccattgttgattaaaaataaagttttaaagaaaggaaagaaaagcaagctgagatctcattaatgcttttgagaatcctagtttgtgttctgctatgcaactttactgaacagtgagaactttgggagacaatgaactcaccccagatttattacccatttctttgaaaagaacctaaaagtcatgagatttttttttgattgacagttgattgtaattattaagtctttggctatgaatgaagaaagaggaagaaaaaaaaatgctggctattgggcctaccaaccaaaaaaagtccaggaccagatggattcacagccgaattctaccagaggtacaagggaggagttggtaccattccttctgaaactattccaatcaatagaaaaagagggaattctccctaactcattttatgaggctagcatcatcctgataccaaagcctggcagacacaacaaaaaaaagaattttagaccaatatccctgatgaacaatgatgcaaaaatcctcaataaaatactggcaaactgaatccagcagcacatcaaaattttatccaccatgatcaagtgggcttcatccctgggatgcaaggctggttcaacatacgcaaatcaataaatgtaatccagcatataaacagaaccaaagacaaaaaccacatggttatctcaatagatgcagaaaaggcctttggcaaaattcaacagtccttcatgctaaaaactctcaataaattaggtattgatgggatgtatctcaaaataataagagctatttatgacaaacccacagccaatatcatactgaatgggcaaaaactggaagcattccctttgaaaactggcacaagacagggatgccctctctcatcactcctattcgacatagtgttggaacttctggccagggcaatcagggaggagaaagaaataaagggtattcaattaggaaatgatgaagtcaaattgtccctgtttgcagatgacatgattgtatatttagaaaaccccattgtctcagcccaaaatctccttaaactgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataggaagaatcaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgctagatgacgagttagtgggtgcagcgcaccagcatggcacatgtatacatatgtaactaacctgcacaatgtgcacatgtaccctaaaacttaaagtataataataaaaaaataaaaaaaaagaagaagaagaaagaggaagctgagccagcaccctcaccatgtgatgccctgtgctgcctggaaactctgcagagagtctgcatcagcaagaaggaccccaccagactcagcccctcaacactggacttctcagccttcataactataagaaataaattcctttttaaaataataaaaaaaaaagccttgagttctttagaactcagtagccatcttgcaaaagatcttctggttctattgaatgggattctggagcaagtaaaggagagggcatatctgaaagctttggagaaaatcaagattcggttagcaaaaaggaaataaagaatttggtgaccagcctgaagcagcaaaggatgccagcttgactacaactatttttcaaaatgaagatgaaaagaataaggaagtacatatgactcttcttagggatgtaaaagcaaccctggcatcaaaatctactcaacaaaagactaacaggggacagagaaaagtgatagcttcaactatgatgaagaggagacatcacattgctgaggctgactctgaaagtgaccatgaagttctagaaccagaatcagaaatgaagatgaaactagcaagacaagccaaaacagcagtgctggaaaaaagtaaacttaatcttgcacaatttctcaatgaatatagaagttaggaaagatggtggaggtagagttctttaaaattatcttcagttctttgctttaataaagttacctttgtcaaaatttttaaaaaggccttcaaaagaaaatattgtaaatgaagtatttgtatgttttaaattcctagaataatgaatattggcagaataacttgaaaagccagttaataaccatcattgtcaattaaaaataaagttttcaagaaatagaagaaaaacacgttgagctctcattaatgctcttgagaatgctagtttgtattctgctctgcagctttactgaagagtgagaacttagggagagaatggaaactctcaccttagatttattacccatttttttgaaaagtgcctaagaggcatgagatttttttcttctgcgcgaggacagttgtcacctaaagaattccctgttccatcacataaaatttttgtatcttattggggagactggctttgcaaattccttaaaaagaatactttctggctaacacggagaaaccccgtctctactaaaaataccaaaaaaattagctgggtgcggtggcgggtgcctgtggtcccagctactcgggaggctgaggcaggagaatggcgtgaacctgggaggcggagcttgcagtgagccaaggtcgcaccactgcactccagcctgggcgacagagcgagactccgtctcaaaaaaaaaaaaaaaaatgaatactaattatggctaaagttcccctagtgacatctcactttccaaatcatctctcttctacaacttaatgcttgtggtaagacggtttagtcactgtaaaagtttggtttcaaatgttaacaaggccaagttgcattgggtcttctaactctcaggccatctgcaaaattgttattttgaaactcaggatctaggtgggacattactgggcatagttgttgatgatgagtagtactacacttcacatcactgcaggagacagtgagtgccccccataagacattgtccaatctcaaggagaggcatcgtggtatagtatttaaattcacaggcttttgagccaatttaacatgggtttgaatcccagcatcaccaacggtgtggccttgggtaaattacttcttcctctctctctctccaaagttccattttttcctctgttaaggggggttaataatatcagtcatagggctattagaagcattatatgtaatactataaaatgatttaaaagtttgcctggcacatagtagattctcagtgaataatatcatgattattaagagatgaaaggaagttaataaatggataattctattgagctttgaatttccgaatccctgtatctttctaatgtaaacatgaatgaataaatgatatttattgcatatatacgtgaatgaatattgggttttttttctttatgcaattaaaaagtatctgtctaaaatttacagatacggagaacaggttagttgttgcctagggatttgggatagtggtgggtgtgggggaacacatgactaaaaaggggtagttgcgggggagattaaagatctctgctttgtggtgatggagtagttctgcattgtgattgcagtggggtttatacaaatctacacgtgaaaaaaatggcatagaactatacattcacattgtacctatgtcagtttcctagttttgatactgtactataggaggtaaaatataaccattgggagaaactggtgaagggcatcccagacttctttgtactatttgtgcaactccatgctaatctacaactacttcaaaataagaagttaacgacataaagtatctgttgagaatttccttcttttaccacaattacagtatacagatctctctctctctgtttctccagtaatccaattacagttctggcctaagttttggtgttggacttttatttttattttaatttattttattttattttatttgagaccgagtcttactctgtcacccaggctggagtgcaatggcttgatctcggctcactgcaacttctgcctcccgggttcaagcaattctccagtctcagccttccaaatagctggggttacaggcacccgccatcatgcccggctaatttttgtatttttgtagagacggggtttcaccatgttggctaggctggtcttgaactcctgacctcaggtgatctgcccacctcagccttccaaagtgctgggattacagtcatgagccagcgtggtgggcctggactttaaatagaatacatttagtgcatctctctccccattgttaccccttcctaggccaattcatgcctttacaccacaggtttgaggattaagtggaagctaaatgtgctacagataaaattcctaaaagatgcaaagtttggtcatcttcgattctaaaatattctcaattgattaacactgagcagcaggattaagcatgtggcttaattgattaacactgagcagcaggattaagcatgtggctagatatatttcaatctgtttcctgccagcagcagcaaggatgtgtgagtatattattaaaatcctctgtgaattaagaagtaaagcaaattagtatcagctcacagtttggaagtctccatatgatactactaatcagcaaatcagctgagtaacaagaaaatcagataaccttaatttaggtgatttggtggttgcacagctgtgttcccaatatgtagaccagtacttgggaacccagtaaatatgcgtggatgaattaatgagtgaacgaatggatggcgggactgttaaggcatcccgttagaaactgacaaagtctaaaagaaggagtaaagaattaattcacctttgtgacccagatcttgacgaagcaggacctgccaggaaactttctaacccttctctctgtgctcctctaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtaaggaaaataccttcctctgtaatagtcgtcctccccgagattcccccagcgctcataaccactaaaactatctcatcccataggctgattctctcattcacagtctgtgtggatttctcattcctctccagcaggctacaggcctttacattatacatgggttttgtcttaatcaactttgattacctgcacttagtcaaacatgtggcaaattgcacggggtccaggttgttggatggatgaatgagtgagtcgaggaatagtttgatcctattttaacatctatgtatgaagggaagggaaaataactcaaactcagaacagagctcttgctttgggaggcaaggaagtcaaaattattgcttaaaaagggtttgtgtgggttttgatgagcctgtttgtttgaattgagatgattcaattatacatttacaaataacagcaagaattacttgagcaattactatatgctggctcttttcttatgttaccttatattttatttatgctcttaagccagccactctttaatgtcatcattaaagagcacctacttttgtgaggcacagtgctaggcaggagtggggaagggagtgaaaagataataaagacttagcctctgtctcagagaggacagctgctgtggaaaagactttgggtcatattaacacagtccctgatttttttttcccaagttatgtgatatgttaaagatagtaaaactcactctgtggccatctcttgggagttactctttctctctatttcaaaggatcgagcctttgccattgtccttacacatgattgctgtcccttgaagttgacctggagtgctcaggaacactggactttgggaataatctgacctcccagtgactcactttctaataggcagtaaatgggaatagggaacgtcacaataacacctttcctgccaaagaaccctgtcatctgagaaggcccagtcaaatggcacccgaaataatactcaggttttccaccattgttctttgtttgcagcagatcatgcgcgggtcttagcctaaaaatttaacaccaaatgggttgttgggcttggtattgtcctatctctcaaagatttcaaagaacgaaagggacaatgctggtggtaggagcatccaaattcataataaacacaaaccacccgtagccctcatgagtttatgtgttagggttcctgaagaaaacaagagcataaatctggatggctgatataattttgaaagtcacatctctatcactccccactttctactctctccaaatgcatgtgtttttattaggaaaaggcctgatactcaaggatctttcaattacaagtggcagaaaactcaactcaatttagcttgagcaaaatgagcatgcccgggttctgataactgcaatgtccaaagataagcttcaggcatggtgggatccagggacttaaataatgtattaggtctaagtctccatctctttctttccctgtcctttcattagtttattaccaggcttcctctctagttggcctgacggttccaggcttatgttttctttgctcctggttgtctcagtgaagaaaggcctctttgccccaattgtttcaatgcaagtcctgagattataagtctaattgggttaacttggataattcgttcagtcttagtgctgaaatcagcctcacctaagtcatttgcagtgaagatgaggaggggtggttctctaatggaaaaaatcaggtgctgtgcaagaaaaagaatgaatggataccagggaagcaaaagcaaacatttactgtagaagagaaggagctgattgggatgaaaaatgctctcacttggttaagtttctgagtggacttggaggtatagcacatatttcaggatcctggcaggagatggatgggaaggtcgaaagggatcattggaaaggatttaatgcaggaataatttataaggtatagccaaggtttgggaaaccaataagagatagagaagaactccagggccaacagtagtaagaagccactaccatcccttgaccagaaagggcaaggagaagcagcagttacctgagactagggaggcttgtagctgtagaaaagtgccacccactaccagctgtggtctttggaagagaaatgcagcccctgccaacccctgcccactgaccccctgctagtgtcttccacgggctgaagctggctggaagccagaggtaagaagccccacggatgcactcttaaagtgagtcttccagggtacagagaaggatgggaaaggtagagactggatctgaaggggcaaagggaggctggccaacacatgcaaccctgcatctaccaagttgatggtcttaattcttgaaggtacttttctctcatctcttcaatcacaagctatgtttaaaatcattaccactattcatgaaattaaaaaatcttccaaaagttactctttctcacctataatttgtctcatgccttttgcttatcccaaattattagcagacatattattagacattctcatggaacagcaataaatgtgcctataaagctcttcctgtttttagcatatgattgttcttatgatgtaatttcagatcatcgttccagagttctccttcagggtattatgcagagaatctgtaagagcaataatgatcatggataattatgagaagcaagaatgtcttttattgccttcattttcacacttctcagaagattaccatagatcaagtttaagggaacaaatccaaactagatttttttgaatgaatatttaatactgaatcctggtgtgcagatatatgaatggtttttagcaaaatgttataatgaatggcaaatccttaatacgatgcctttcttatagtatcacaaatatcatgaatttgcttggtatttgtaaagacataaaatgtgaccctgtatatatctagctgtaattgatcttaaattgatgttctttgtcttttcctatattgttatattttgattttgtaaatttgtcacagtcactctgtgacaaggttgtacagattatatttaatttaatttcaaatttttaaaagcggcatttatatgaactcaaacaatatgaaacaacaacttcctttttaaaattccatttagtgcaaatcctaaaacctcctcaacactacacaggaggaaagtttaatattaacattatttttcttcatgagatagtcaggagacttgaagaatggcttctgagaaatgacagggatttgagtgactggagaaatttccctgcactccaagagaggagaaagaaggaaggcctgtgtcagtacagcttgttgggggagtcaggggaagaccagagactgatctaaagtgaagcgagagttcatcctggagaaaagtgacaagcggacctgacacctcgactagaacttgattgtggaagattatttttttaatagacagggtctcactatgttgcccaggctggaactcctggactcaagcaatcctcctgcctcagcctcccaagtaactgggactacaagtgtgtgccactgcacctggctatcaattatggacaatctgctttcctctgtgagcactgtcacctgtagatgggtcatgcacatcaatgtaaagcctttcccatgaccatattagcctcaactctttcttttttttttctttgagatggagtctcgctctgtctcccaggctggagtgcagtggtgtgatgttggctcactgcaacctctgcctccggattcaagcaattctcctacctcagcctcccaagtagctgaaattacaggcgcatgccaccacacccagctaatttttgtagttttagaagagatggggttttgctctgttggccaggatggtctcgaactcctgacctcaggtgatctggccacgtcggcctcccaaagtcctgggattacaggcgtgagccaccatgcccagccagcctcacatcttttaactccttgcaagcccccatctggcccaagatgacccataaatactaactcctgtgaattgtaaaatgtgtcatgccccaaacacatttttcccaatctttatttcttagttcatctaatccttttacagttatcattacgtttcagataagagaaaaacaagctaagttctagctctcttgctacttagaaaaacagtaataaacagggacacagcagaattgttgagttatattttgtgctcagttcatcaggcattccctttgctttcccttgttatctcggtttgcaaactatttcttgtagattaaatacacaaaaacacaacacagcaaaacaaaagcccagttgggagctctgagatgcaagttcaggtatcagctttattcatttccatttcgtattctttcaaatgggaacgtttatgtagttgtgcctccccatggtgttactggagaaaaggaagttggtaattcatacttattgtgagcaatatgcttcaaataatccaaatccaatgaggtaaacttgtagtatttgagtcacttttctaagatctctcctctagtatgtggtagatttagaatttgagcttctctttctaactccaaagtccagcactttccactaagctgagataataaacgggcccaggaaacatctgtccttatgagtaatgcctccaacaatcccatctagagcagtatcgcagaccaaaagcacagcttcagagctaagagacataccaaggtaattcaaatcctttaaaattatgaaaataagggaaatttgtatacctaggccgggcaacacttaccaagatcttctcatctctcctatccatatccatcctatatcttcaactgcttccattcttctcatgactctaaaagaagaaaaacaagaagacattctctcctttctgtccttctcttccattcttgactatgtcaatcagctgaacctctctggttaggttccttcttttatcttccacagagtaatcctcctcccttctcttccttcctaattttgtactataaaatttcaaagaacaggtcctacagagactgcaatcatatttcatagggcagattaggggaaagcaatttgtatatacccatacacacacacacatatccatgaatttcagttatcattatttaattagatacgccagtctctcaacaaaacggttcaaatttctgctaccaaggcatagtaactgtgagtaatttcataagtacagacctcattgctaagtcttcagttcacaaatcccaccatgtaattagcagatgtacatcctgactggtgaccaatcacatcgcttctttcaaaatctatgggtgattggccatggcacctctgttaatcagttcacacacagacagcaaaggagataactccctttcctccctgtctcccagtgacaaatccatatgacacttcacaagaatggatcctagaaagaggcagttgtcccacaaagatgacagtgcagcaaaggtacaaaaagtggtaatgctggaaatgaaatttgcatcaaacataaatggaatgatagcagaaatagctgcccttagaaatgttcacactgatactgttcaagatagcaaccagaagaacttagggaaggtaaacttataacctgtaagtgaagactgtagctgtgatgaaggatgaagatgccccagaggaggtgacacttgtgaaaacttcacattaaagaaactctcaaagatagctcacatcattgaaagtgcaaaggataaaatgttgctagctgatccaaacttagaaaggatgatgacaatttgtcaaagcattaaaaaaaaaagcttgttctatattataagttagatgaggagaagacaaaaaggtctattcaaactactcttcactttaatcctcaattcttctaatgttttaaattagagattactaaataaacatttactctatttttcatctccctatgcatatataattgacagtaaggcagtttttaacattttgataaaaaattttaaaggtcatgtaatgatcctaatttttccaactgattaagattgcttagtgtggtttcagctttcacagtcatttttattacccagcactactgtgcaaaggcagaactgagagatttctcaatctgtctacctccctgtatctatctattcatccctatctaattacctatttatctatgtgactatattgatctctctctctatatatatatatacatactatagtctatattcttacataatttgttagatcaccattaattttcagttccaacaatagcaatttactcatcccccccaattctaggtaactagaaccaaccaagtgatttcattctctagctacattgcccacctacattagaagaatctcagtgtgaatgtaaaatagccctggccctagtaaaacaggctgctataatcaagatcttgacagtgtaattaacagaatgatatttttggagcctctaaatatatcagccccaccatctgccttaaaaaaattacctaagtcagaatttctcactgcttcttccagggagaaaatagtctctgacctgagggaactcccatctgataagagatagaaatagaactactgtccaagctaccctggcttgcatcatccctaaatcaagactattggttatggtagaaaacacaggctgttaatgcaattaagtgctaatagtcctattgtgttgctttaaaagagagtcatcaagttcctgagtgaatcacctctgagatggagcaagactaagaaaaaaatctggcagcagcttgggaatcttcccattagtcttttgctacaagtgtttaaactaaatgtgccagtatgaatttcattcagattgcctccatcatctattctctcaaatgaaacatcagagattttaaattgggatgagtgagtaggtgggtggcagaggcagtatgaaatatgcccacttttctgcatgccttcacagtcatctgaatttagtaaattgaatttagtaaagtgaattgttctcaccaaagtggaaacatcagagctgcccatgtaagacaggggggtgtgtacattttatttcttgtaggctgattcatacaacttcatatgggcctgcttcaatctctttggagagaaccatagaacttgagatagaaagccccctgtgcctggccacatggtgctatggtttgaacgtgtcccccagtgttcatgtgttggaaacttagtccttaatgcaacagagttgggacctttaagaggtgatgaggtcttgagagctttgccttcatgaatggattaacgccattatcgcaggaatggattagttatttcagaagtggggtcctgagaaaaaggatgacttcagcccacttcctgttagttcacacgcagacagcagggctgcctcaggcactggaggccccatgtctgtcccactgtgcctaggatttgagacatggagtcaaaggagatcattctccgtcattaagtcttaatgttgttttcccttttgtgttttggacttaactgggaccaggtacccctttcttcttgcctatttctcccttttggaacaggaatgtctatcctatgcctgtcctatcattgtatttcagaagtagataacttgttttgatttcacagactcacagctggagggaatttgcctcagtatgaattgtaattttgagtctcactcatatctgatgtagatgagactctgaactttggacttttgagttggtgctggaccaagttaagactctgggactactgggatggaatgaatatattttgcatgtgaggaggacatgaatttttgggggaaggcgtggaatgctgtggtttgaatatgtccccaaagttcatgtgttagaaacttagtctacagtgcaacagagttccattgatgggacctttaagagatgattaggtcattggggctgtgtctttatgaatggattaatgccattatcatgggcgtgagttagctattgcagaactgggctcctgataaaaaggatgcttgaccaccttccagattctctcatgtgcatgctctcttgcccttgcttcttctgtcatgggatgacacagcaagaaggtcctcaccaggtgcaggcccctcatccttggacttcccagcctccagaactataagacgtaaatgtctttcctttataaattacctagtcgggcaggtgcggtggttcatgcctgtaatcccagcattttgggaggctgagatgggtggatcactggaggtcaggagtttgagaccagcctggccaacatggtgaaaccccatgtctactaaaaatacaaaaattagccaggtgtgttggcacatgcctgtagtcccagctaatcaagaggctgaggcaggagcatcacttcaaccccggaggcagaggttgcagtgagccaagattgcaccactgcactccagcctgggtgacagagcaagactctgtctcaaaaaaacaaacaaacaaacaaaaaattacccagtctacggtactctgttgcggcaacacaaaacagactaatgcacgtggctagcagactctgttgaacctactttaatcttattgggcattgtggattgccctttctttatgaaatagatgtgttccagaagagctgcctgactttggtcaaaacacaatgattttcctattaatttctattatttgatttttctggtcacctcctctttgccccactggtaagggagatattccctacctgaaacaggatgagatggtgaacgcactctactcagcactggacagatgagattagcagcagtttattagtcacatatactcacagcctgggagaaggacactgcacgccgtgcaggaccacattggggttgcactagggagcagagtgacacagcagaagcactgggaagcatattttgcagtaataggaggatgaggtgtgccctggttcctaggggaggatgtgattggattctttgaataatttcacaggctgttagggaaataaaacccactaggttgaggactaggtgcagtgtagctggtccagctgataagagaactagctgggtggcaggcatatcaatggaaccaggttaactcaccagtaggcttttggaaacatgtgaggctcaaatatgtcaaggcaacacatgaagttttaagccttacaatgatcatgaggccttacattgatcaatgtctccaaattctttagaagcagagtctgagacggagattcttggggagcaatcaactgagtgaggctcttaggagaaacctgtaaggaagtgagtgaagcaggctaggctgcagaggaaggtaaacagaaatgtagtattagctgaaatctagtttcagcctgatcccactgaagctcaggagtaggaatagcagcacagagttctcccactttaagccaagggagccaggactttgtacacccatataaggcagccactggctgtggtctcccatagaggtaaagagtggccattcccatcagccaagggcaattctctagagaaggaaaaggttaagctgtgaccagtcaacatgcacatcaggtaaggctagagtgcactggcctaacaaagggaattttggcaggggaccaacaatatctactataatcactggtgtgttcccatgaggggaggaattccagcagggattcctttaggtatatgggacctttaggtgggacagacttaaatataatggctagtactgtgacatgttgaaggttatagccaccacctagaagtttacttttatttacagctgtattcacattctgataactcacattggcatttacttgctcccttgtccctcacatcatggaataattattttttttaatgctttgaaattctcaaacatcattttcagagtttctttgcatccttacatgtttggtttgggctttttattacttctaatagtactgggctgctatgcaatgcaaatgaacacatttcattttccatcctgaaactctctcaagttggtattttcaggtttgtaagctgaattcattttctggtttagcaagtcagtcagtgtgaagtttttaaaatattgattttatttataattagggttagaaatataggtgaagctgtaattctagaatctgatttaagaacatccatatctacatatgggctgcatcaaggtgaaaacagagatctttacggagctggagaggccaagcaggactctcagaattacgttagtcactttatcacagtgattcagagagagaggccctaaaatatttctccatgtgttttggccccgcagcttgtaaccctgccaagaaaagaggctgcttcttatttagttctacagttccagtgcctagacagtgtctggggaatagtaaggggtcaacttaacgtttgttgaatgcatgagatggtggaccagtgatgttagccagaaaatgattccctgttggcagtagacactgcaacacattttctctgggaatgaggtacaattcacattattggttcaaagtggctttgctggggatcggggaggagggagggaaacccaggcacttggtctgagtcaaaacgtggaggagatctctggaaaaatgagaaagagaatgaaagagtgaaacctgggggtgcatgaaaggagaaagaagatggaatgatagttggtttctggtcacggtgacccattgaccaagctctctcttgccctgtgtagaattgacacattccttctgttctgaaaagcttctgaaatataactcataatgcctattactacacttgtttgttgatctattgtgttgatgcgaaagtaattgtgatttttgccattactttaattatgcaattacttttgcaccaacctactactttattttggctcacaaaacatgtggctgtactgttcattgtactctctgacctcccttccctacccctccactttcccatttctcacttcttgttcttttattctctgctctgtatacaaacagactaaatcttccctgaactaatcttggcatcttctcagttgcaggttccctagacactttactgcatcttcttttccctagttagctgtccacttatagggtcactttcctgctcagtagcacctccaccagtgggcatgaaagagggaataaaggccgggcatggtggctcacgcctataatcccagaactttgggaggccaaggtgggtggatcacctgaggtcaggagttcaagaccaccctggccaacactgtgaaacctcgtctctactgaaaatacaaaaattagccgggcatggtgtcgggtgcctgtaatcccagctacttgggaggctgaggcaggagaatcacttgaacccgggaggtggaggttgcagtgagcagagactgcaccactgtactccagcctgggggagggagagagagagggagagggagagaaagaaagaaaaaagaaagaaaagaaaagagagggaagaagagagagaaggagggaggaagagagggaaggagggagggaagggagggagggagggaggaggaaagatgcattttaacccagttggattctcataagaggcattggaaaaaagtgtgctagaggattccatcagtaggcatgtttgtgtattttacaaagtttcaggcagacattcacttttgtgtgcctggatctctgaacacaccataagataacctgaagtcaatagtgtcagtgctgaaaacacaagaatatccctggtgtgtgtgggggtgggggtggggggagttgtgctgcacagtttaactggctgtatattagctgttgaattcaaacatcaaccattttggctaaggtgaattggagaacctagaaataaaattggggtcaagtaagtgcaataagaacttatcgaatgaatatgtgggaggcagggaagggcagtgaagtaccatactatagaaggaagagcaggggctttgcatggagacctacctggattttaatccccagtttgctacttactggttgagtgacttttgacaagtttttaaaaaatatttaatcctcactttttgtgtctataaaaaaaagatattaatacctactgcaaaagataatttatacaacttaattgaaattgtttttgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgcaagtcatcagcattcaaggtcacacagagtaaaaactgtattaaatcatgaaggccaaagatctaccgtaaatggtagagtaaaaactgaacttaataaagaatcaaaatcaatacttaacaatagtgctgacaaaattagggaggcagaatgcactgtgtgaaatggggtttccaaagagagcttgatgggaaaaatcaggctgaatagtcttcaaaaggggaaagatttaaaagcttcaaatggatcatagatgacctgctgtctaatttcacaaggtcctgaaataaagaacatattacttcatgtctggaaaagaggtcataagtcagagttaacgtaaatcaattccaagttccctgaaaatgaaatctctctctttctctctctctgtctctttctctctctctctctctctctatatatatatatgtataattttcaccaataccccattatgaatcttgtagaagtaactccatatttaatgaactgtaaattataagaacacctttctaaagtttatataaaattgattttaaaaggcaattttaaattagtataaaaatgatctttcaataaaagcataaaataatgtattcataattgctgtatttcttttcactgcaagataccagaaattgaaggaagaagtatttttaggaattttagggttcttgatggctttagtagaaactaacccatagatatggattttattgttttctcatttttctatttaaacttctaacaaactagaaccttaaacataattgctagttattatggtgcatttgaaaaagacaggtttctggaagcttaaccatgaaccttgatatttttctgagaaaatgggcctcagaaatgtggaaaccaacttctcccagctctagattttccaccctctgcccttttaccatattgtttctcctccttgccaagcttcaaggctttaacttgaataataactgggttgaaaggtaatttcatccagcgtccaacagccagaaaccagaatggaactgtcacagaaatctattttttatttatccctcatcttttagggattgaacatctttttgcttataaataatcaagtgattttttaaacaaacaaatatatgactagtcattttcttatccatttgataaacactattcagcacctataattcattcattctgtaagtaactattgagcacatacaatatgccaagcaagtgaaagtagtgggactatgatggtgacacgtcagacaagttccttgctgcactggagcttactttcagcaggggaggtagataatttgtaagaaaacaaacaattcagattgtgatatgtgctgataaagagaatgggcaatatgaatgtaagggacaaggaaattaattttagataattgtttataataggtgaggcagtaagctggagatacaaagatattctcagggaactcacaaacaaatgaggaagacaaacatggaacctaagaatttcaaatacagacctgtgcatgctataatttatttccatattaaatcagtgggggctcaaaggaagaagtcagctcacttggactaagaggttaagaaagctcttaaactgaatcttaaaaatcaggtagagaaagactttccgggttgcagaaatagtatgtgcaaaggcataaagacgcaaaatgcatggcctcgtttaagaatagccattaatcttaggtggctagagcactaaatatatatatatatacatatattcaggtgatactgcctttcttagcaacacccttaggcagttgtaccttcactcgtttgctgctgtattgcatttttagaattcttctttggaatcgccttcaaaggcagtatatgaaaatctacttttacagtcacatgggcatcccccttagtccaaatgtattttctctctcttcttcactttcaccctgtttggcttaactgatcaccttgtacctattctaaggagacctccggtctcagagctagggatctggaggcgagttctgagtatggagcgaggttggacacgctattatgcccaccaaggctgaccaacaaaacacctcatccaaaatgcacgaggaagcccaataccgtaagttcctttggaaaataattcaacagcattttttgagtccccaccactgggtcaggtaggtgttctattctaccttagcactcgttctagtgagttttacatatcaattcagtcttcacccagtatttataaatctgtggattatctttcttttaaaaaattagacagatgtagcaaattgcttttgtgaaatatagcctagagctttatgtatgataccaaagtggatttagaagtgaacactccagtttctcattccacaaaaatattcttccttggtgtcccaactctaagaaccacatgagttataatagcaaaattaaatatttgcttggggctttatagagtgattttatattccttactgcctttaacatggtaagagctcactgattctacaccaggggtgtccaatcttttggctttcctgggccacattagaagaagaattgtcttggcccacacacaaaatacactaacactaacgatagctaatgagctttttaaaattgcaaaaaaactcataatgttttcaacacaaatttgtgttgggcctcattcaaagctgtcccgggccacatgtggcccatgggccatgggttggacaagcttgttctacaccattatctgccagagcagatgatttgatgagtgagcatatgcctgtgcaccaggctgctggcctcgctctgcaggagccacgttccctttcaggaggagcacaggcatcttcagcaatgttgtgtgcacctcctcgttgtcatggtgcaaagtgcttattgggattctgccagaaaagatgtgatcattgagaataaaaactactctttgaattgtgctaataagaaagctgatccttggtgttgaaatgattagtttgacctttaattttttaagtggctttatgcaaatggaagtgctgcatgctgtgtaattttaaacataatattatatttgtttggttttctttttcaaaccaggactgcaaaaatcaagctaggcctggcatggtggcttatgcctgcaatcccagcactttgggaagccaagttgagagggtcacttgaggccaggagtttgagaccagcctggggcaatgtatcaagagccccccatttttacaaaaaaaaaaaaaaaactttttttagttagtcaggtgttgtggtgtgcccctgtagttctagcttactgggaaggctgaggcaggaagatcacttaagcccaggaattcaaggctgcagtgagctatgatcacaccactgtaccccaggccatgtgaaagagtgagacactgtctcaaaaaaaaaaaaaaaaatcaagctaatcttaagcaccagtgttgagtcaagtagtcgaatctaaaatcaccaactgctagtaatctcttcctcattggtccacccttaaagaaaaggaaagttgatgatactacccaaaatgtactattaaataattattcttgaatcattaccgacttggagatgtgaggaaggcttcctttcctaatattattttttcactcctacaagagtttgttgtcctccaggaaaaggtgataagaggtgtgtaggcactatgtgggtgctgaatgatgaattacagaggataatttaggaggccccaccctgaggtgaatagttagcttttaaagagttacatccagttaaggaaaaaattggtaggaaagaaagaagaaaagataaagggagaagaacagttagtttttaaagagctacatccagttaagagagaaatgggtaggaaagaaagacgaaaagataaaaggaaggaaaggaaatgaaaggaaaggaagaaaactaaggaaggagaaagacatgctgtaatctttttacctccgttcgattcaaactggcttatgttattcagatggcagaaataacatttgcacttaaagagacttgctttaaaactttcagctctgaccttgaggctgctcacttggccatctaatgaatggtatttggttcctggaaatatgataatgccatttgcaagttcagtttctcctattttggtggtaaatccaataaattcttcatgtaagcagaaaggcaaattgacaaccatgaagccctgtgggttctgcaaagggatttttcctcccctcagtttttaatgaggccgcatattcatcatcttccccaatggctactttgagcaagatgtgctcagtgtgtgctgttgagctgatgtcaagctgctgacctttgcattcggtgagccctcagctgagaatctgacctaagatcagacatattgttggatccgtcatgttgattcttggctctgatactaatgggcagctaatgagttcatggtgtacatattaaccccggctctggcgacgctaatgccagatgcacagtgagttggagttgtggggagggaagcaagatgcccagtgcactagcatctttttgttttgttttttttgttttgttttgagatgtagtctcgctctgtcaccacactggagtgcaatggcgcaatctcggctcactgaaacctccgcttcctgggctcaagcaattcccctgccttagcctcctgagtagctgggactacaggtgcgtgccaccacaccagactaatttttttttttttttttttttttttagtagaggtgagatttcaccatgttggccaggatggttnnnnnnnnnnnnnnnnnnnnnnnnnnnnnnnnnnnnnnnnnnnnnnnnnnnnnnnnnnnnnnnnnnnatcatcttaataaacgtgagcaattagaagagccgtgttggtagaatgcctgtttcatggcttatgggaagtaatatgcaatctagaggtggaaaaaacatactgtcttatctctcctctcaaattaaaaaaaaatccctccacctcagagaggtgctttacgaactgtgaaatagggagaaaagttgaaatgtttgaagagtccgataatggcttttattaccaaggggaaactgatgtccagccctgctgttgagtaacagtagatttaagacctccaggcgtggccatgtggcattgaccacaggcacattggtgacatttcaagacagtgctgtgttgtctgttttcttcaagagctggcaggccagagctaaggcatagaagggcatgctactctggccttggaaacaagttttcaaaaggcagtggtgtaaagaatttctaccagcacactctgaaagacataatatgccagagaaggagttgtgtctaatttgttcctgcacctgaagtgcctaccactgtgtttctggccactagtttaagacagattggttgaactggttaaggagtcatgaaaattgattatacactccaccaggctactaaggatagctgttttactttggacagggtatctctcttaaatttgttttagctgcctcatattacagatgagaaaaccgagacacagaaaggataaataactttgcactgtattgcactgatttccctaagaatgtatgttatatgagaaagaaggatgcctgctgtaatgctgtggataaacagtgtgcatggagccctaaagaaccaattctcatcctcactgctctttctgttttttcttgggcaaaccactgacagtctctctgagctcctgcatcctgcctcataaatggtaaataatgcacgtgaaagcactgcataaactttagatccccatataaagataagctcttattattattttccaagacactgcttccccaactctgtcactacagtttatatgagaaaaagaaaacgaggagtccacagtcaaataactgaaaagtgagatgtcctgatacaaacaaatacatttgaatttgtttaatatagtgaatcctaaatcaatctcaccactctgatacccaacaaagattaataaccactaccggatacatggtaattctacattttatccttaaaaagacagaaacaaagaatgccatgtactttttcctgtataaatgtcagtaaaccttatatttattcattcactgtcactgagcatctggtacattattgtagtacatgacattactgtatactagcagtactgtaatgttgatctccagagtgttgcctggagaggagatggtgggatggtgttaattaaaaatgcagattttgtacccattaacaaaccactcttcatacctcacttacctttcccagcctctagtaactaccattctactatctttcccagcttctagtaactaccattctactatctacctccatgcaatcaactttttttttttttgagatggagctgcactcttgttgcccaggctaaagtgcagtggcacaatcccggctcactgcagcctccacctcctgggttcaagcaattctcctgcctcagcctcccaagtagctgggattataggtgcccaccaccatgcctggctaattttttgtattcttagtagacacagggtttcaccatgttggccaggctggttttgaactcctggcctcagctgatccacccgcctcagcctcccaaagtgctgggattatagatgtgagccaccatgcccagccaagatcaacttttttagttcccacataagagtgagaaaatgcaatatttttcttcctgtgcctgacttatttcgcttaacatcatgacctccagttccatctgagtgactatagttaacaatatattatatatttcaaaatagctagaagagaagatttggaatgttcccaacacaaagatatgatacatgtttgaggtgatggttatcctaaataccctaatttgatctttgcacatttcatgcatgttatcaaaataccacgtgtgccacaaatatgtataattattctgtatcaacaaaaaaattatggccagctgtacttttgtctctactaaaaatacaaaattagccagcatgggtgggtgtgcacctgtaatcccagctactagggaggctgaggcaggaaaatcgcttgaacccaggaggcggaggttgcagtgagctgagatcgagccattgcactccagcttgggtgacaagatcaaaactccatctcaaaaaaataaaataaaagcagatttggggactctaccttaaacccactaattcagaatcaccccagtggctagggcttggaaatctatattttcagcaagctcccaggagattccgatgcctaacagtgtttaataaccaccactgtatactgcattgtggaagaccacatgctatggagttagtccccttggttctatgacttactagccttgtgacctgggcaagctactttaatgtttctaagctccagttttcttatctgtgaaagggatgtaataactactttgcaaatattttgtgaagattaaatgatataatatatgcaaagtgcttgttataacatctgatattataagatctcattcgtagtaatggctactgttattgttattataaggaccactacgcaaagtggaaatatcagttaaacacgatggctttctcgaaggctcactgttcagtgccagtgttaaattttagcagctaattgcaggcaccatgatgtacactacaggggagacgtgaatgaaatcaaatggaaattcagtgactcactctgtttggagggacttgtggaaggctcaccagagaagacatgtgagccgatcttgaagtaggtgtcttctaggtaagaaccaacctcacctatacacagaaaaataagtaatactgagagtacttccaggaaacccaaaggaaatttgccacacgtctggcactgccttttttttttttttttttttttcgagacagagtctcgctctgtcacccaggctggagtgcagtggcatgatcttggctcactgcaacctctgcctcctgggttcaagcgattctcctgcctcagcctcccgagtagctgggactacaggcacccgccaccacgcccggctaattttttctatttttagtagtaatggggtttcaccgtgttagccaggatggtctcgatctcctgaccttgtgatctgcccacctcgcctcccaaagtgctgggattacaggcgtgagctaccgcacctggcctggcactgccttcttgatagctgtgtggcatgacttcccattatctctcgtctcagaggtaattattctttctccaacttaattttcttcacagactgctgtaaggaatgtggacaatataactccacaaatatttttaaataatttaaaataacagtcccagtttccttattaacgatttttttttccagagcttctaattgctatttgccaacttttgattttgcttcttctcccttttctccctcttctgcactcttgggggaaggtttaactggccaccagctggccaaaagtgaccctgaacagagatctaaggaatccaaagcttaagggtggataagcctaacaaccagcatcaatttcatatgcactctgtttagcgttatcaagaaaattcagcacatttagattaggtgcttgctctagggtcagacctgctcagggctcttatttggccagcaagaggtcaagacccacagaaccactgccaccaccacctctgtgtcagcaggaagcaattacagaagactaacctttgtctgttttcccccaaatctttggggtcttggaatcttgaggggggaagtgttacagtaggtagtagtcaggtatgagcagggcaggagcgggctccccacccacacacagcaggtgtgttggctgatcatcaggtgatggttaggccgttgttaattgcctctctaaagtaataattgatcacagcgggcaccagggaaaagcagtctcttaacagagagaaaacacctgaaactgatcagcagcttcccaacaagatctcaggagtagggagaagcaatgcgagatcccggaagtaggccgaagtataaaaccccaaatcaagaggtaaagctgggcccttggtttctcaagttgcccacttggccctcttccaagtgtacttttcttcctttccttactgttttaaagctttttaataaacttccactcctgctctggaaaacaaacaaacaaacaaaaactttagtcctgctcagtgggctgcaaatgcaaaccatgaccctatcctccaggtttataagatgattaatgaatgaaacaatcagttaagaagtttcaaaatcagggccgggtgcagtggctcacgcccgtaatcccagcactttgggaggctgaggcgggaggatctgaggtcaggagttcgagaccagactggccaacgtggtgaaaccccgtctcttctaaaaatacaaaaattagctgggcacagtggtatgtgcctataatccgagctacctgggaggctgaggcaagagaatcgctttaaccagggaggcagaggttgcagtgagccgagatcacgccactgcactcctgcctgggcaacagagtgagactatctcaaaaaaaaaagtttcaaaatcaaatagtgaataataaagaaactgtgtgtgcaaagcaaaataatcttttgctgattaagccagtgcctatatctttatgtgattaactagaaaaatgtgagatcaggagaattaagaacattgatctagcctcatggatcccaaagcacaagatttgggaggagaatatgaatttattaaatctcacctgtggtacccttaggaattgcatgcgcaccttttcatgaggcaataggtctatgctatggttcccaggaagtgttgggccacggtctcttacaaagcctggaaaacatcagacagaacagtggccaacactgctggaatacttgtgtgtaccgccatgtaatatgtaataacaaagtgagacatctctcatttctccccctctcaggcagaaagagaggtttgacacagtttgttttttatttgtttttgttggtttttttaaaatgttaattttcttttaaaaagtaatctgtactcattgtaaaaactattttccatttgttttttcaatgtgattacaaattttttaaaggtggttctgcagggcttggcagcgctccccaaagatactctcatattgacagggctctccaacaccctcaggtggcaggttgggagggaactgcatacttcaccagcagcagcagtctcttctgatggctcggggtgtcctgccccagcccctgctgcctggtggcaggattactgctggtaggtggtcatttgatccccagcatatgttgacaatgaaagaaaaactctagtatggacctacgcctggtctactcattgttgtcttcagtttaaggaacacagaacattaacacaggagggtaagggggcaattccacactgaactctttctacctcagaatctttggcttgtctagtttttaagatattttttcttgcctggaactagatttattacttttcctttgttcttttcctttgttttattttcctttctatggattttggaataagacttactatgcagtctatatctgctcttttagtagtcatcctttacttgtttagacacatatgtgacctaaaatctaaacagaactaatatctctaattcattccccctaaatttaaggatctcagcaggattttactgcactcttatcttaacatgttattttgttcagtgtcttatttatcatcttattttacactccccaaggtagcaattacttttttaaaaatccatttaatactcacttaggttcacacacaagttggtttctttgctcacctttgctttctatgtcccactacttccttgggaattcagtttccttcttcataaagtactccttttagtaattttctttttcagaagagtccttttctttcttccaaaatgtgttctcctgtatttttctagtattttaaacagatttctagtgtcgtctctatccttttattgtattatagaagctgaattagtttgctaagtctgccatagcaaagtactgcagactgagtgggttaaataacagaaatttattttctcagttctggaggctgaaagtctgagatcaaggtgccagcagggttggtttgttcagaggcctctccccctggcttgtagatggccgtcttctctctgtgtcttcatctgttcttccctctgtgggtgtctgtgccctaatctttccttctaatgatgactccagtcatattggattaaggcccaaacatatgactttattttacttaaaatacctctttgaagaccctgtgtctatatacagtcacatctgagaaactgggggttaggacttctacatgtgaattggggtggggagcgacaatttcacccataactgttgttcatgttcttctaataatcctatatgatgtgttcattaactagttctcatggagaatttttatcttttgcgatttgaaattttggacagtgagctcatcttcattgggtgtttaatttgggaattctgtgtacctgggtcaaaggtgggttcctacagagcagctttatcccaaaggatctgccaggtgctgccacagtttcaaagacgctgttcaatgtttatgataattaccaagcttgcggtttcttggatcatgtaggcaatataagtgctaaccccagaccctcacgaggcagaagcctgtggttgtaaatgatcagagaccttttatcctatccaaatgacagctgttggcaataaagccatttcttttcatcctttcacgaactgtgcattctttcaagggtccagacttaagtgtggacatcagttacaacatttcaccttgcaggaaccacctgtggagttctgtagcactcagctattcacaagtcatgctgaaacctatctgggattatggagatcttcattttccccaagactttctaccccagctgggccatagcatcaacactgcatcactcccttttttctttttcttgcatcagtggctttcagctactcatttaaaacgatgtaagttagatgttatccttcatttttaggtatctgtagtacaagggttttcaagataacaagtctttcattgctggaatgaaaagttaaatggccatttaacattagaagatatacctaatgttaaatgacgagttaatgggtgcagcacaccaacatggcacatgtatacatatgtaactaacctgcacgttgtgcacatgtaccctaaaacttaaagtatacttttttaaaaaaagccagacacaaaaaagaaaagaaaaaaaaagaaaagttaaatggcaagttcattgggattgcattaaatttatagattaatgtaggtggacgcaccagccttaaaatagtgaatattccctctcaataactggatatttgtttagatactctttgtgttcctctgtaagatttttaaatttttccttgtgtgaatttgtacttcattttattttctattcacttttattacctttgactattatacttggaatctttattattttaacttctactaaatgttttttgtttatgtaaaggctataatttctgtatactaattctgtgcctacttgttggattcctttatttatgataattttccaactgcctctcttggcttttccagggatacagtcttctcatctcaagattatgataattttacccctctcgtctaatattttatgtctccatttaattctcttgctggattgatgtttcttaacaatggtatgtaattgtggggataaagagtattcttttattttccctaacttaaacaggaacgtttcttgtgttgtcaagaaacaataatgttttttgtggtttcttgttaagcttcacattggctaccttgcaaattaaagtgatggacatttgtataggtctttagaatttaaaagcacttttctctacatggtcatgtttgaattctcaccaccacttgattctgtgagaccaaaaccaacttgctcaattttcttttaaagacaacttactgaaaattttacctcagtgaataatgaccttcaattgtacctgcgggtggaaattttatccacttttggttaccaaatgtagtgataatacctgcctattcacaaacttcctattgtttgtttcttactgaaactcaaatctggtcttctttactaaaaagcaagtgagaagaatttaagaagctgtgtaatgatttggagtgtgtgtatatacacacacacacacacacacacatatatacacacacgcactgacatagtattttatactgacataaatatacaactatatttataaagtatatcatatttatacaggatacagtatatatagtattatatatactttaccattattatatataattatataattatgttataaataattatatattattatattatatataattatattatattataattccatatcatataacatatgatatatataattatatatatagatacacatatcagtatataattttagggtaatagctattactttaagatgtttgcataaagcactgcaaagccctagtctgatctatttatacttacacagttggtggcattcactaagggccactctgcaagactgtgcagtttgtgcattccacaaaggttcccagatgcagggacgagtaggggcgaaatctaattgacattctacttgccaagcctcccaccttggcagggtcatggctcaccagaacaggcccctttttgtctgtagctaaatgttgtacctgcagggctgcattttcccagaagggggcaccttttcatcattcacttaaagattcaataaggctgacaccacaggccatggattgcactgacttccctaaagcataattccgtgcatagctcacgggagtcagagcgcaacctcacactaatattacactggggctttgccctatctggactttgttttaacaaatgtgaggtcatcatttcagaaggttcccattatataaatctcagttttgagacatatgtcatcttcatcaccatcaacagcaaacatctactggacacctaccaagcaggagtcactaatacacagtagatacaaaaagaggtgaacacataacttagcatggcttcttaagaaacactaaccaaagatacgtgtcatggctgggcttgtgaacatacactactcttgtctcaaataaactttcttaaaaagcacagttagacgtggtaatatcactggaaactacagattcctagctgttagccttgtagctacttctggagagcttgatgtctccataggaaatggagtaagtaaaacctcctttcagagacaagctgtgaattatgggagtagcacaatgactctggaaagcagataaatgtcctgtgcattgatgcactgcaaaggactaagcccatttcttgctgttcctccaagccctatagaaaggggactgcagagtcagcaccactgaatcaaattattaaagtggaaggaagcttatacatcatccactcggcattcctcgtacacaaaggcacattggtgtaggaatatgcagtgaccaattcaggaccacactcttggtaatgggagagcggagattaaaatatgacatggacctctacttggggattcaggatgctactacttctgagatttttcaagtattttcattcatccagcaatgacttataaatactataagtattaatagtctctgaaacatcaatggcttgaagaagcagcacatcttactggaaacaattgcctggctttgaattctggtttatatctttttaccaggaatggttactgagctatatagttcagtctttaggtctgatgcttctatttttggaatagttgtctgtatgaatttaaaatgcaaaagttggccaggcatggcgattcacacctgcaatcccaccactttgggaggccgaggtgggtggatcacctgaggtcaggagttcaagacaagactgcccaacatggtgaaaccccgtctctactaaaaatacaaaaattagctgggcatggtggtgcgcacctgtaatcccagctacctgagaggctgaggcagaattgcctgaacccgggaggcagaggttgcagtgagtcgagatcacaccacttcactccagcctgggagacagagagaaactgtctcaaaaaaaaaaaaaaagaagcaaaagccataggcttccaagccatgggctaattagtggcctttgatatgaaccacctgagaagaattgatatatggaaaggctgcaagagtgggccacttagctgtggaacccgaaatgacatttgatggagattcaggtattcagagcaccaccatgagccatgagaaagcagaggacattcataggcagagacagatgactatactgacagagacgccaaggggatatcaaaagaagagataactaattctgtttctgatggctctccaattcccaggaggcctggctcagtttctctcttgatctgtgcattccatgagaccttggcatcctcaacttacacctccctctttatttgggcccatatcagtcatttttccttttctgtaatcagaggatctggaccaatgccacctttcactcgcagacacctgggtatggaaccctggaagagcaggattccttttgacaaagccttggcctgacaagtctcttagtccctactgagaagggctgcagacacctcttcttcatcatccctggtcaaagtgtacctctggggagatggaaacttcattcaaccactttccaattccattagaaagagctttattcctcccaagattgattagtgaattgatcatgaactgaatattaggtctgaacattttgaggtgacttctgaatgaaacttgaatcccacaggacctgtgggtgacataggacccagcagtttccccttctcatcctgaaagcatatgggcacagtgtcgtgtcctacagatcagtgttgtttcaactttcgcatgcatcagaattgcctggaggacttgttggaacatagattgctggactcccctgcaagagtttctgattcagtaggtttgaggtgtgatgcaagaatttgcatttttaacaagttcccaggcaatgctgatgattctggttctgaattacactttgagaagcactgctttagaacaattcttgtcaaaaaaagaaaggaaaagaaaagtgacgagtgtggaatgacaactaaaaatctagggtagctgggcgcggtggctcacgcctgtaatcccagcactttgcagaggccaaggcgggtggatcacttgaggccaggagttcgagaccagcctgaccaatatggtgaaaccccatctctaccagaaatacaaaaattacccgggcatggtggcgcacctgtagtcccagctatttgggaggctgaggcaggagaattgcttgaacccgggaggagaggttgcagtgagccaagatcgcgccactgcattccagcctgggcgacagagcgaaaccccgtctcaaaaaaagaaaaaaaaaaaaatctagagacttttttgaggggggtggatgatgaaaatattctaaaactatattatggcgatagccccacaaaaataactgagaataattgaattgtacattttaaatgagataatatggtggtatataaattacatgatagcaaatctgtgtaaaagtcatcttaacatgacttttaaacagctattaatgtttaaacgctttttaaaagtttaatgactttgaaacagctttgttacatagcttatacacagaattgacatttaaaatgacttttaaatgctttttattatataatttatatatataatttttaaaaattaatttaatagattgcaaacaatatttttctcttaattaaatagaatagaaaatattagattgtgtttatgtagtgtatcaggattctccagagaaacaggagcaataggatgtgtgtgtaagatggagagggatctagatagatacatagaaacacagggaaagataatcacatgattataggggctggcaaatctgaaatctgcagggtggactagctggctggaaattgtggcaacagatgaagttaaagtcttgagtccaaagacagtgtagaggcagaattcctttctttcgggggaacctcggtcttttcaggtcttcaactgattggacaaggcccacacacctgatggaaggtcatctgctttactcaaagtcaatgtgattaagtgttaatcacatctaaaaaatacattcacagcaacacctagactgatatttgaccaaacagtggcataccatagcctagctaggttgacacataaaatttaccatcacacagagtaaaaatagcattttgtgaaaagtttgtttccatttgcacactcacctgtgtgtgaactggcttgtgattttcaatgccttcattactgtgagtcatgggttaaaaaatacaaaagcctctgctttccatcttcatatgcagacagatgactgtaccaaaaactttatgaaataaacaaaacaaacaaaaaggctgctttagtacttttggtgaaagcatactaaatgaaatttaatcaagttttttgttgttgtttgtttttgttttttgtttgttttgcctctaacttaaagacctagtagaaagaaagtagtctcaaggtttctggagccttatctggctatgtggctctcacctttattaccgtagacagccatatgctggtgactgtctgagggctgtaaagccaagcccgggatgactgaaccaagtggaaaacacgtgtaggttggcatgcgcgtcttgtagacacaatgggatgattaagccaagcctcactgtttcattaacctgcaaccaagcaatttatttggaggaggctgttttggcatggcagcttcaaagacataaaaatattgccatttcttaaccagtcaggtgcagagctgacagtcctgacctcccactgcagacacaagcagggcacacaatgagagtcagggatggagtgagacacaagaggtagatgaagttgtctccaatacacattactctgtattttttgttttgtaaaggactttaaaactgtgtctttgaatttttttagcacgaaggatatcgtgaaactctcaactggattagagatggggttaggctcaggtacggggtaaggatgtccatggggtattttttggaaaacacagtttaaattgtttttgaagataatttcaaacggtctcatccaagtaagctgtctcagaatatcagatgttttcatcctcatgagactaacgaaatctaaattttaccatctaaattcaccatccttaggtatgtaatgcgtgcatacctcccctccccctatgctgaccactccccctccccactagagatcagtctgatgatgactccaggaatagcaaatctctttgctggggtttggattattccgcagagtgaaagtgttcattgtgtctgacccatccagattcccagcagcgctagcagacagcacctcttgacataactccaggcagcctagctgccttgccttcctctttgtctgggtctgctgggcaccaagctctttcacctacatgagtgtggggaagtggtgttttgtcctctgtatgagctgtttgcttttccttcccatcagagtctaaccactcccctgtgctcaggctgagtcaagatgagcaaggctgggctggactctcattgtgccccatctcctcactcatatttcccaggatggccctgccctgtgtcttttgcttgtgcttccttcaccccacagccctgcagctgtgcctcatcccattcccttgggactaagcccagtttcccctctttctcttgctgccccatcttatggtcagcctcaaactgaactgcaaaactatatgtctgactgtagagctaccacactatgctgaccaagatagattatagataaattaaatgacaaattgatacatggaataaaagacaagtaaggaattccagctacctattgctgagtaatagctacttcaattaaatgccttttcactggggcagcagcttaaaagcaacagccaatttaacatctctcacaattctgtgggctgactgggtttagccggaaagaacttctgctccatgttctgtcagcaggacctgcagtcatctggaaactgcactgagctgtaccatccaagatggtgcacacatatggctgataattggtcctggttgtcatttgggagctcagctgggattgtcaactggagcacctttgttctccatgttctctgtctgtatggcttgggcctctctcagcatggtggctggatcccaggggcgcagtgttccaagtgcatgaaagcaggaggtgcagaatgtcttcaaacccagcttcagaagttgcacagcatcacttctgctgcatcctgttagtcaaaacaagtcatggggcctgcccagaggagagaaagagactctacttcttgatggatttgtggccctccttaaactgccacacagacaggtaaacagataaagaagaggtgaactgaaatattccaactaaaattttgaggagctagatcatgttttctgtgtttcttgttacttcccggcattttctggtttttaacaacaaataaattgctatttttaaatgtaataagtatagcttatgcataatccaaatgctataagtatagcttgataaattttaacaaactgtacctatccatgtcactagcatccacattaagaaagacaactttagcagcattttagaaaccttgaatagctatgacttttgcaaagagaaaagcacttaatatttaaagagaagcatctatcattttaaaaaaacagttatttccaatcttctattctttacaactacgacatctctttgacatatataaaataactcttaattattcttcaaattatagatttcagggttcaattggctaatctccaacaatctccagcaaatgaatggaagtgggattttccaacagtgaaatggccagtctgaatatttggtgaactgactgatcgtgtatatctttatttaagcatttatcattgtcaaaacgatatttaattcttcagatttattttgaaatgaggcatgaataaatataaaacctggatttatagcaaaagcatcaagcagcaattagcttcagaaatatttaaaaaaaatctgcatgtgcacacaaggtcattttgtcaacctcacattttctggaggtaatcattaggttctgatgagatagaaatcacacaattatacagctcactgttaatacaaattatttgtgcggtatttttattaacttttaatgtgtatttctattttgttacggccactgatgaataatcaaggaccaaggcttgttctcactctttaaatcttgacttaaagttccctgatgacattcacctttcctggccgccttatatagaggtagcacctttcttcctgcctggcttgttttctacagagccctgtggtagcccgaataatggcctgtaaacatatccagatcctaagccctggaacctgtgaacattgccccatatggaaaaagggtagttgtacatattgaagaccttgccatgcagacataatcctgcctgcattatttcactgggtcctacatgtaaccacatgtatctttataagagggaggccaagggagacttcacacagaggaggagccgtgcgatggaagcagagtcagagagagaagatgctatggctctggctttgaagatgcagggctgaaaaaaaatgcagctctagaagctaggaagagcaaagcaaagggctctcccctagaggatcaggagggagggcagccctgaggatgctttgactttcccccattaattcgaatttcagactttttggcctccagaactataagggaataaatacgtattgctttaagcaacctggtttatggtaatgtgttacaggggcataggaaatgaacatggtgcctgctacaatctgaatgctttgtttgcttccctgtttttattctcatctccctcactagactctaagctcctgggggtgagaccttgtctgacttcttcactgctatccacagttcagtacttagcacagagtaaatgtatactaagtgattcagccataaatgacactcaggagaaggttgtttggagaaagtctgtgaatgctaaaggatgaagaaagtttggcctcgcataaagaagtggggctggtgttacagataggggctctgttatatgcaaatgtgcagagatgaggatgaagaagtcatgtggaaatgtggagacccaatgaagaaatgaccagataagccctgagttcccttgagaagaattgagactcttcctggagggatgacataaggctagattgagggaactttgaaaaccaagaggaaaacaatggattggaatggaaagggatgtgtgagagccagaagtgggacttcaggctggatggctctggacttgtgtgcacatagttttcccagtgagcagaataagcgccagcaaagcatcttcccatccccaaacagaaaaaagtttactcttgaggaattaatgaagacttttgtagttggaaaatctaccaagaaactcttaatttcacatacaatgtatgttctgttttaaatttgtcttgatttttgttggaattatatgtaagtcaccaaaactgcaacatttccaggactttaggcctctgaaggattaagattgtaagtcgttggggcagcaggatgagccagaagcctgattcatccctggccggggcctgtgtcctgatgctgccagggtgactcagttctaggggaacatattcagtctgcaatgcacagatcagcaaattcattggctccgcctccttccataatgctgctcccatattcttactttgtataattacctgatgacttatatccttattaagagcttgccaaaatggcaatcaattagcaaacacatgcattaggatccttctttgtggttttcttgtaaaggatactcatttttcactaatgtgatgtcctgctactcctaaaaactgctgtcctatgaaaatgccaattcagcaggaaccctggctatggaacaagagtgtgcaaatcacacgtgcttataaaaatccatcgcatcccttgtaggaggcagattaatggctccctgggggatgttgtgctagtttcctatagctgctatagcaaattatcacaaacccagtggcttaaaacagaaatttattctctcatagacctagaattcagaagtccaaaatcagcatcactgggccaaaatcaaggtgttggtagggccacgtgccctctggatgctctaaaggacaatctatttcttgcatcttccagcttctgatggccactggtatccttggcttgtggccacatcactctagtctctgtttctatggtccactgccttctgctcatctatctgaaatgtccctcttgtgattgcatttagggcttgtgattgcatttagggctcatctagataactcaggctagtctccctatctcgagacctctgcaaagtctttgccatataaggtagcacaggttccaggtattgggacatgaacatcatttgtggggggaccactgttcagcctaccacagatgtctatgcattaagcaccaaacctctgcatatgtaattaaagttatggaccttgaaatgaacagagtagtctggattatccagatgtgcccagtctcatcacataagcccttaaaagaaaagacgctttcctgactgtggtcagagagagcacagagaaagacacaggagggatgtgaaggaggagagagagtttatccaccattgctggctttgaaggtggaagggagggtggagaagagcccaggaatgcaggcaacctctagaaactgggaatggccctcagctgatagcaaggaaatggggaccttggtattataaccaaaaagaactgaattcagccaacaacctaaatgagccaggaaacagattctcctctagggcctccagacaagagcacagccatgctgacatcttgatttcagccagatcagacttctgtcagacttctgacctgtgcagctataaatctgcattgggtcatgattggtttgtagcaatagaaaattaacacaccactgtaaacagtgggtttaataaacagaggaggtctcagtttattaaagtttttggtatcaaataacagacatatagatatactcaaaattaataaatgttgatattctggtctctgattagagaaaatatcatgatagatttttggtttagtgaatgtcgacctttgtgaatgtgtgccttaatgtatgcatgttatgtagagagacactggaaaatgcttttttagcttaaaaggcatagaaaaatttaagaagagaagcttgtgaaaccatccacatccctctgctttatcccctacccctggggggtatggatgtatgtgattatacgtatgtcattgaacatgggcaggggcattgaacgtatgtcattgaacacacacagaaacacatgcatgaaaaagcagctcaacatattgatcaagaaagtgagtccattacaggaaaggggtcccaatccagaccctaagagaggattcttggatctcatgcaagaaataattcagggtgagtccatagagtaaagtgaaagcaagtttattaagaaagtagaggaatcccaacactttgggaggccaaggtgggcagatcacctgaggtcgggagttcgagaccagcctgaccaacatggagaaaccccatctttactaaacacacaaaattagccgggcgtggtagtgcatgcctggaatcccagctactcgggaggctgaggcaggagaattgcttgaacccatgaggcagaggttgcagtgagctgagattgagccattgcactccagcctgggcaacaagagtgaaacactgtctaaaaaaaaaaagaaattagaggaataaaaaaaaatgaccacttcacagacagagcagcccctagggctcctggttgcccatttttatggttatttcttgatgatatgctaaacaaggggtggattattcatgcctcccccttttagaccatatagggtaacttcctgttgttgccatggcatttgtaaactgtcatggcgctggtgggagtgtagtagtgaggaatgaccagaggtcactcttgttgccaccttggttttggtgggttttggccagcttctttactgcaagctgttttatccacaaggtctttatgacctgtatcttgtgcagacctcctgtctcatcctgtgaattagaatgccttaaccatctgggaatgcagcccagtaggactcagcctcattttacccagctcctattcaagatggagttgctctggttcaaacagctctgacaagtccaccgcagagacaaagcacagcgatgtagcccaggaacctgtgcagtcaagcctcaaggaggaccaaggagagttaacatctgaggaggtttattttagcctctgggccttctgcttgactcttgccttcacttttttttgtgaatgcgtggtaaaatatacataacataaaattgaccattttaactattttttttattgtatggttcaattaagtacatttgcattgttgtgcaaccatcaccaccatccagccacagcactttttcatcttcccaaactgaaactccatacctatcaaacagtattcccattacccttgtcttcttttgcctttacttttgcacatgagctatagaaagggcagacatatccctctgaggtgctaaaacaacacacgaggaaactcaaagtttgaaataattcacttgaaatcatttgagatttatacattaagacatgagcagccggttgccatggctttcacctgtaatcccagtactttggaaggctgaggtgggaggatcgcttgaggccaggaattccagaccagcctaagcaacatagcaagaccctgtctctacaaacaataagtattagtggttgagtgcggtggctcacacctgtaatcccagcactttgggaggccgaggcaggtggatcacctgaggtcaggagttcaagaccagcctggccaacatggtgaaactccacctctactaaaaatacaaaaattagctgggcttggtggcgcatgcctgtaatcccagctacttgggaggctgaggtaagagaatcactggaacccgggaggtggaggttgcagtgagctgagactgcaccattgcactccagcctgggcaacaagagagaaactctgtctcaaaacatacatacatacatacataatagctcagtgcggtgggatgcccctgtagtgccagcgactcaggaggctgaggggggaggatcacttgagcccaggaggtcaaggctgcagtgacccatgattgcaccaccccacttcagcctgggtgacagagcaagaccctgtctcaaaataaataaataaataaataaataaagacatgtactgagctccttagaagagatatgttacatatataatacataacaaaagtatcaaaggcccataaaatctcaaacaatacagaattgaattgagtgaagtgaacaatgaaagtccctcctctctcccctgcctgatgccattttaagaaagatcccctgaagagtttggtatgtcccctcttccagacaaggaccttttgtatttgtgaatttgggccagctttaaaaatagaatccccagatagctttccagatgaggtgatttatgcaattaggaaaaacctctgtccaatgtgccatctccccaaacaattttctcattatgcctttttatggctgaaatcctatcattaacaattcatttctttggcctaatgatttgtcccttcttaagatgcaaataccgcttataagactaactcttaaagccctaaccctcctgtaagaatgagtttattaaatggactcatttcttctttctcctttatctcatcatttgtttgtttccttccttttgtccatcaccaacagagactctgagtcccattaggtaaaggactacttgagccttattcactgtccagttcctgggatggagtgacacaggatatactcaattagtatttgattggctgcaagaccttgagataatggactcagacatgagacccgagggtgctgagacagaatggaaggcagaagaaatgtggtgtgagcatgcgaggctgccactggatggcttttcagctgctgtgtactgcctaggctcagggcatctttcctttcggtgcctgcttcagtgggagtctgtgccggttgttaaatgttttgaatatcgtccctggcaccacgattaaactttactgacctcatagttctcttcatgatctaccctgtgaatcaaaactttacaactgatttttttttaagtttgagaagatggaaaatcaaagcaagataggagtgtctgagtttttttgtttttgttttgtgtcctcaaagttgttttattctccctttttctttttaacagctgtgtaaacatttagccaacaacaacaaaaaaagccatgggaacggggtgtggggaaaggatcatatgcaaaggaatctgctgtttgcagaaatatttacagaacgccggcagcgttattccaggtgtatacagcagattcaccggccctgttacctccccagtggcatttaattcacttattcagaattaggaattgcagagaccccagagtaggagaaagggaaactgactcaacagagctcttatatatgcctcatgatgaataccaacagttaccaccgtttatgatatatttctttatttatttgacggcttatgtaatgcctgtcctctctgccagcctaaaagctccatctgagggaaagcttgtctacttctgcttgtcacaaagtgcctagctcccagcacagtgtctggcacatagcatgtgcttaacaaatatttatagcatgaaagaatacatattatctcatttagttggaataggctgttctaatggtacaaatgaattttttaaaaaattctctgcttggccaggcacagtggatcacacctgcactttgggagactgaggtaggaggattgctggaggccaggagttcgagaccagcctgggcaatgtagcaacagcttcactctacaaaagaaaaaaaagaaaaaaaaattatcctggtgtggtggcacacacctgtagttccagctaaaggaggctgaggcaggaggatcccttgaccccaagagtttgaggctgcagcatgccgtgatcacgacactgcactccagcctgggtgacagagctaggccctctctcttggaaaaaaaaaaattctgcttattagcttgaaattggactgctaatttatatttttagtagctttctatcaaagcttttagcctttttcatactttttaataaaatgaaatttattttcataggtgatttagctttcttcatgaatgggatcaactgtatataattagtgactatcataatagaagcagtaggaaaagtttgacccttactattccctttatgagaaagtagtaaaaaattaaactgaagtggtctattttttatttgtgatatcatcatcatcatcatctttaactgagctgtcccttttgcaatttaatgaaaatggatctttgtagccactgagactgaaatgcttgcatatcaaggaaatcaccttctttatcctaaatcacactctttgcacacagtgaggaaaagaggagaactgagtttttatggaacaggattgcataggacacccaggggaacaagtctctaaaggactcagaaatttgttggggtgaggttagtatgaggctaaaagaagagatgccagaataggtgcaaaagaagcatttactgagccataaaaaagggcagttgttgataccagctgcagtacatctactacccatagcattgtcatggataacgtgttttctgtccaaaacctcatactcctcacattttgaggtataaaaccagagttttatgccagacattccttcctggcagaaagcaaggaggtcccgggtcgctatgcatctctgacaaatctatctagaatagcatgtacacctttgacccttagatcttaacatggatagaggaaaaaggtgactataatgaaaaagtcaccaattttcaaagggtcaaaaggcaggatgaagtaggctaaatctcacagagcttggtaaatgaggaacacataagaagatgctgaaggaagaagtaaattgttagaagtgaaatatgaaaagacaaaaagcatgttcttgaggaggagtttggtgtggctaattttcagaacttgctgatgatccaaggacagaggaaaatctaggagggaagcatctgagaatccacgatgctgacttttaggctggttagggtatatgttttgtctggtacctacttctgcagatgctctctcttggaaatgttaatgccttgcaggtatttcattccagagaatgaaagtgatatgtgttaggttgaagcctataatgaggcagggcacagtgtttcacgttggtaattccagcactttgggaggccgaggccggcggatcacgaggtcaggagttcaagaccagcctggccaacatggtgaaaccccgtctctactaaaaatacaaaaattagccaggcacggtggtgcatgcctataataccagctactcgggagcctgaggcaggagaattgcttgaaccgggacccaggaggtggaggttgcagtgagccgagatcgcgccactgcactccagcctagactacagagcgactctgtctcaaaaaaaaaaaaaaagaaaagaaaagaaaacaaaagaaagaaacctataatgaacacaggagaagcaaagatgagacttgtgtaaggatatgctgataagatagcggatgtcttttcatatgtgatgggccctgcaagaccagcagggagtgtggggattccagaaagcattaatcattatggcctgcacttttacaacacacattcttgcaagtactctatataatgtttcctgtgcttcctactttgcatctgttactcatttgattgtcacaataatcctatgaaatagatactgttatctgcttaaatcaggctgatactaggtactggcaggaaattgaaagacagaagaaagaagcctcatgattctttaactccagcaaggagcatgttggccacctatgtatcattcatggcaaaagggaattttgagggggaaaagtaaagtgagagagaggaacaaagcatgtcgccccacattttcacagctacttttctatttggaaatcacacttatatcatttcctatttgataactacaaagaatttgccagctgccataaagacagctgcatgaagcagattctttgcagtgtaggatgagcctgtccataggaatgtgaacttggatattgactgaggctaatggggtggaggtggaagactctgatgtgttggaattgttagaggagggtgaatgtgcaagataagatggagctggaaaatggaattttctggttggatatattatcacttctaataattttggagttattttaggaaatagaaggaaagaggaaattctgggtagtacaatggactgaatgtgtctgcatgacaatttatatattgaaatgctaatcccaatgtggtgatatttggaagcagggcctcagggggcataagggtaattatgtcatgagggcgggtcattaggttatgaggggtcattaggtcctgacaggaactatcccatcatgaatgcccctctcttagaagaggcaagagagctagctagctccttccaccatatgaggatacaatgagaatatagccatctacaaaccaggaagggggccctcaccagacagcaggtctcccagtcccttgattttgtacttaccagactccagaactgtgagaaataatgttgttgtttaagcaactcagtctatggtaatttgttatagcagccaggattgactaagatggatgggcaattggcaattcccatagcagtacaagtggatacaacaaaaatcatgacagtggtacattagtgacttagagtttggaaaaattactgtgagtgaaatcaaatgttcataaatataacattagaaagaaatgaggaggaggaaatccctgagcagagcttatcatagcttggaggtttactttggcagatggacctttattcaggtcaaccgatctcagcgagcatttatgatagtattgtagacactggctaaatggttaagtaataaagggctataatccagtatcagaatgagttacatgggtcagtgattcccaaagcaggctgcacatcagagtcctcaaaagagggtgtataaatacagatgtgtagtctcaattcctggataccaggattcagtgaatcagggattcaagaatctatttatagcaaatacccagtgatacaaggcacggaatccaaggagactggtcactggtagaaaatgagtggtatatacattatgatggtagtgatggtaatcgatgcttatgacagatatgctcaaacaatagtatgcagaagacttacccaggcccctccctatagatctagatttctgggagacacccacagcacttttgaataattggatcctaggaggagcaggcttctgaatttgtaactggcagcgccactcattctgaagcagataatctaccaatgaaattttgagaaatatccttgaaatacattacctaattccatcctcctaacagtctcagagaagaagtaatatccccattttacagatgtggaaacagcagcatggagaagataagtaacttcttcaagatcacagtgaaaataactaagctgagttgcaaactagaagtgtcagataagatttatgtccttactactagactccctccttgctgccaggaagtcagaggaaaaaaaaaaatggctattcccagttggggcaggttttacgaaggagtttaaagcaggataagtgggcttcagaatttgtttctcacttggtccttggaacacagttttacaatttctctaaaatcaattcttgtttttttttttttgtttggttggttagtcataaagctttggtagatcgcactgaaagcaagcatgttgatgttttgttcatatggtaaatggtattatggtgtctgacattactgaatagccataatgccaggccgtgagtttaggaaatgttggtgtgatgttgaggccagacactccctacattttaacattttcttccttcaaagaacttctggctttcttttttgatggaacaataaaatgagaaagtagacaaggaagcccacaaacacaccccaccttttatcctttggaaacaaaacacaggatgttgaagcatacatttttttttcccaaagagcctgctgtttttggatttagcaataatgttatctccctttcaaaagatagcttttttaaaaaaattgtcaatttctgcatatcagcatccctttaaagggcatctttcctgaaagttaaggaagtaaagtctgtaagtcaaagataacttgtttaccaaatagagactttaactgaaatggccctttggagttaatgaaagtaaaatagcttcccccaccacatcgagaggaggctaatttaattatctgtgagctcacagattagaagcagcctttcatccatttctggaagctgagtatggaccgctcacacctaatgaagggaaatgggaattggagccatgggtgagcgaagaaggtccgtgagagagcacatagatctcaggcctctgagctcttcaaacaatgatgcttaaacggtttacagcattcactgggggagcctaaggcacagttgactaggtgtgactttagttgctcagagttcagcaagaatctgttgaacaccactgtactccagtcattccacagggtctaaggatatataaagtatggaaccatgatacacaaaggacaggcatcccacacaaggtgagaatttccagaggctgatttttcaaaactagaaggaattagtaaaggagtggggaatgggtagtgggttggggccagaggattattgtggagatctttataatttgtaagaactgtgcctcaataactttgaaaggtgctgaactcttaaagctgccacatacaaatttcctcccataaaacattagttttcttttttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttaacagtatgattggattttgaagttgaggtaggtgctagcaataatttagtcccaccccatcatttggcagtaggcaggaaattttgacccagcaaaggcaagtaattcttgcccaagctcactcagatctttaattctgatgtgcactctccttaatagtaaaaaatagctatgatttttaaggattgcctgtttactgtctgtaagacagctttgtaaatcctatgtgtgcacgaattcatttaatccttacaattctgcctaagtgacaacagtatcattcttttctttggaagaacccacaaaaaaggcactgaaagttctggtaaaactgtccctttggaaatcatgtgaagattctaggttttttgtttgtttgtttgtttgttttcttttcttttttgacacagagtctcactctgtcacgcaggctggagtgcagtggtgcaatcttgactcactgcaactccatcacctgggctcaagcaattgttgcacctcagccttccgagtagctgggggctacagggcatgcaccaccatgcccagctaatttttgtatttctagtagagacagagtttccaccatgttggccaggctggtcttgaattcccagccttaagtgatccacccaccttggtctcccaaagcactgggagtataggcatgagccactgtgccctgccagattctagatattttagaagagacaagatcagttttcaaactatattccaaagattagtagcaaccccacttagaggcatgggtggtgctaggatgaagacataaagtctcagaggggccaagatccccactgggaggcaaccccgtataaagtctctttcaattgtttgtttgctcttcgtttgtttgtttgtttgtttgtttgtttgtttgttttgagacagagtctcgctctgttgcccaggctggagtgcaatggcgcgatcttggctcactgcaacctctgcctcccgggttcaagtgattctcctggctcagcttcctgagtagctaggattacaggcacccgccaccacacctggctaatttttgtatttttagtagagacggcatttcaccatgctggccaggctggtctcaaactcccaacctcaggcgatctgcccacctcggcctcccaaagtgctgggattataggcctgagctacctcgcccgtccaattcttttacatattgttctaggacttgtgacttaatctgaacagagagatcattgaatttaaagagtttggaagccactgacccagatgatttgggagacctgtctcagattaaggacacttccataattgttaccaattacttcttaccaccagctctgaaattcttgccattttgtaaacctttcctctcatgctctgtggaagtgattacagggtacacaactcagctcaccaaagttgtgcttcagaataatttcagaattgaatgttttattcccctgttgcctttcttcaccttcttcattagaaatctgatcagttcttgagaaactgactgcagcactcaaggcaggaagccaggcagagatggaaatcacatctgtttcaggagtcatgtgttaacaaaatgcagacacatctccaaaactgtcgtattcatatcagaatacctttgggtgccaggaaagctggatttgtaatgcacgttgtcactagaacaatagcaccaatatttgagcctgacaaaaactggtcttcaaaggcttgaaataatgaagcgtatgtagcacaaggtatggcttttaaaaccctgttgttcccgaggcaggcagatcatgaggtcaggagatcgagaccatcctggctaacacagtgaaatcccatctctactaaaaatacaaaaaaaaaaaaaaattagccgggcgtgatggcgggcgcctgtagtcccagctacttgggaggctgaggcaggagaatggcgtgaaccccaggaggcggagctgcagtgaaccgagatcgcaccactgcactccagcctgggcgacaaagcaagactctatctcaaaaacaaaacaaacaaatccctgttcttccacatgatttttcccccctttggaaagttgtttgtccccataggcagccttctacctctaagcatttacattagtattaaaataacagctctgcatacaggaatagtggaatgtgcccactccaagtattctcacagcagagtttaccatatccacacagcgctcttcaatagactgcaaaatgttttagggctttgggactatttaaacctacatataccacttgacacatgggtgagtttgtgattccaccagtagagaagtctgcattatactgttggtatttactgttgagtcttattttcaaacttaatattgtttttgaagaatgatgcttagttgctgtcacatttaaatgactgattctggtcaaagttaatggattgcatctgactaggtaagtaagctagtcactttgggaggatcatttgtagcttctccagtcctatttaatgagctggaaaagtaatttactaaatttaatgtagaagttggaaaaaatttattctgaacccccttccccctaccccaaacactttatgccttgagaccatactttattcaccttgcagagtctggtacattgccttctctaacaattcattttgatctattgaagatgctgttgttctgttggaaaaagtccttttacaaaagcaacaagctaaagctagcttttaaaatatgcataaaatacacaaaatgaggaatatgtcaacagtcattcatgttccagcataaatagctttacagcagcggagtcggggagggcacttcttcagaagcacagtttttgtttggaattgctggaagggaggcattaaaatataaaggtgatcatcaagcaatgagttcttcctgggagaactttggaaaggatgggaagaaaaggtattgaaattgttagcaccaagcttatttttggcttgtcttataatttttcccaaggaaagtcattgccttgtcatagtgatgccatttccaaaggacaccatttttgacatgttcaaaaattggtgtctgacacaatttccccatcctgtgttttactgagggcgttaccatctgccagctaccatgccaaacacattacacacactgtctcaatccccactatagcatgatgaggtaagtgctactttacttaacaggtacttacatgatgcttattctgcactgtattaagcatttctacaaattttagctcatttaatcttcacaaccaccctctgctataggtactattatttctcattttacagatccagaaactgagatacaaagaaattagttgacttgcccaagacccccacagctagtaaactgggtaacacaaatttgtgttcaggcctgctagctcccgagtcagcactcaaaaccactgttgtatatgatattatccttatcagtaaggaaatagaagcacagagaatatcttgaccagagtcacacaggcaataaataacagactcagatttaggcagcctacatgtaggacctacagaactcaagtcgtacatcattctgtaaatcttctctactttgatcactcattcctcatactagggtgttagcctaaagcaagagctacacacatgcttctatctctatacggattccactgtgtcacttaagataaagtaataataagactagaaagggaagaaattagctttatcacttatttagcttactgtctaattttctttgattctgaatagatttttgagttgtgacttattatgacaacattaaatctttgatagttgtcagtgtcaaaagcaatcttaacctcatctggagcagtgtttctttaatgagccaagggattacctgaagattttgttaaaatgcggactctgattcaacagatctggatgggcctgagactctagcaagctcccaaatgatgctgatgctactggaacatagtccatattttgagtagcaagaattgagcattcactgagtttttaaaccgagcttaaagatgtatcctagggcccatcaaatgggaaggagagcatttttatagacagaggaacatataggaagtttgggaagggcaaacaccaggccaaggggatggctcatgagataagagctgagctacacagattctccagattagaagggttttcagagatcatctggtccaatcattactgatgactatcacaatcctttcacattcctgtcaggtcatctcaacccttgagttaataaattatgcgtggtgaatggaactggacattcaacagaaccagagaagtttcaagatgatgcctgaatcacagaaccaatctaagagcaaaagactagggaaagaggctgtgatatctcactctgtctgggtagacatttgccaccatagtacatttttcagagcctttagatatttattcaaaaactttttagaccttaccatttcataataaaaaaaaatgctactgtaccagtgaatcagctggaagtacttattcccccaggcatttgcctcccactataaaataaagattcagtgctgactggcaggtgagaaacagtgacagatgtgtggcagctgggctgcttcttggctgtcctgactatacatttcagggcccttgagacaacagatattttcaaggatcaggaagcatgggataaagacaaggttctttccattttgattttgcaaccaaaccaaaagacactcaatgtattgctgagtcctctgattagggggatgccaacttctcataatcatcctttcctcaggctgtcatttgacagttctctgctttctttttcaggtgccaggggagagcaagaaacagtggaaaccagccctggttgtgctgactgagaaagaccttttaatctatgacagcatgccacggaggaaggaagcctggttcagcccagttcacacataccctcttcttgccaccaggtagccatggccttgtgtttggtatgatgtgtttgcaggtggattctatttaatgaattacaattagctcaatacgttatattactgctcactattgcagcaggggctgagagctccttaagaatatagccacacatttttagccacatagattaatgataatttatggccaaacatgaagcaacaacacagagacaaagaacaaaataccgtccatcatcaagaaacagtgacatctgcgagatggtcctcatctagccgccttcctgggtctccatctcattccctttgaaatgaactggacatatatgtttatagtcttgaagtccaagtagaatcaccaagcaagggtcttcacttagtggcacaaaagaatgttatgtgggaatgctccactgtgctttttaaggcttgttcagcaggaaatctcataacaagttatttctcagttccatgacgcttcctgtggaagggtggctgccaggctcggtttttcaggtccttcagtgcacatttattattcatgtgaaatatgtctttaaaaagcacttcatcacggtattgacatacaaagttatgtacatatttaatgtatacaatttgataaatttggagataaatatacacctatgaaaccatcatcatagtctataccataaacatactcatcacctccaaaaatttcctccttcctctatattttattttttgtgataacaacatgtaacataagatctaccctcttagcaacgttttaggtatataataccatgttgttagctataggcgctatgctgtacagtagatctctagaacttattcaacttgcatgacaaaaatttcgtgccctttggccaacacatccccatttccctctccccgctggaaaccaccattctactctctgctttaagagcttcgtcattttagatacctcatataaatgggatcctgtagtgtttgtccttgtgtgtctggcatatttcacttagcataatgttcttcaggttcattcatgttgtcaaatatgggagaatttcttttttaaggctgaataatattgaattatatgtaaataccacactttctttatccgttcatctatagacggacctttagaggcatcacacttcctgatttcaaactgtattacaagcctataataatcaaaaccttatgatactggcataaaaacacggagaccagtagaacagattggagagcccaaaaataaattcacccatttgtggtcatctgattgttgacaagggtgccaagaatacacaatggagaaaggatattctcttcaataaatggtgctgggaaaactggatattcatatgcaaaacaatgaaccctattttacaccatacacaaaaataaactcaaaatggataaaagacttaaaggtaagatctgaaactgtaaaacttccagaagaaaacatagggaaaaatattcttgacattggccttggcaatgatttattgtatatgacacctatagcacaggcaacaaaagcaaaaataaataaataaatggaactacatcaaactggaaagcttctgcatagcaaaggaaacaatcaacaaaatggaaaggcaacttacgaaatgggagacctcatatctaattaaaggttaatatccaaaatatataaagatttacatttcaatagcaaaaaaagaaaaaaaactgattcaaaaagaacctgaatagacatttctccaaagaagacatacagatgtccaaaaggtgtttaatgtcactaatgatctgagaaatgcaattcaaaaccacagtgaggatgtgcttaggatgtgtgttaggatggctattgtcaaaaagacaaatgataatgagtgttgtttatcatttgataaatgtgaacccttgtacactgttgttaggaatgtaaaatggagaaaaggaaatccttgtatactgttgataggaatgtaaaatggtgcagccactctggaaaacagtatggagatttctccaaaaattaaaaacagaattctaatgtgagctagcaatcccacttctgggtctatatccaagagaactgaaattaaggtcttaaagaggtagttacgctcccatgttcattgcaacattattcacagcaaccaagacatgaaatacagcttgatttttaattatttatttttgagacagagtttcactcttgtcacccagtctggagtgcaatggtgctatcttggcccactgcaacctctgcctcccgggttcaagtgattctcctacctcagcctcctgagtagctgggattataggcgcccaccaccacgcccggctaatttttgtttgtttgtttgtttgttttgttcgttttgtttttttagtagagacagggtttcaccatgttggccaagctggtcttgaactcctgacctcaggtgatctgcctgcctcggcctcccatagtgctgggattatggacagttcttctcaaccactgcacctggcctgaaatagttttaatgtgttgtatccttgtccccctctttgaaagcttatatcccaaaaacagaaatgaatcaaactcaagtcttgctttcaagtagctgacatttcccaggcctgacttctcttgccagctctttttgtttgtgctttatgacagtgagctgtttgtattccttctacacctgtttctttacctgcaagctaggcatgataaagtcatatttgtgtccttcctggcacagtgcctggcaatattgtgcccttgaatgtctgttgaatgaattattgaacaatgtgagacaaactctggaagaagtttggtccaagagacaaagcgtagtggacagaggttttggagcatctgacctgagcaagatgtagacagaaataaggtgggctcttcatctaggaaggactgagctgccaaacaggttatggtcaagggtcagctggctgcaaggaggagaatgagacccagtagcagagcaagaattaacacaagattaaaatgccagtagtgaatagagctgaaattccagaaaaatccttcttacttccagtcatgattgataatgaagaccagccgcgggggtggggccggggaggtggggagctaaagatggaaattattggctccagaggtgaatagaggaggttttcaggggtgaggaaccaggcctagatcacctttaaaaaataaaatttaaaagtaatttaatatttgaagctttcaagcttcaaaatgtttggcagaatggctactaaagtaaaatacagctttgtaataaaactgcagtaatcatggccgggtatgctggctcatgcctgtaatcccagcactctgggaggccgaggagggcagatcacctgaaatcaggagttcgagaccagcctgaccaacatggcaaaaccccatctctactaaaaatacaaaaattagcctggtgtggtggcacacaactgtggttcccagctgctcaggaggctgagccaggagaatcactagagcctggaaggcagaggttgcagtgagctgagatcacaccactgcactccagcctgggtgacagagtgggactctgtctcaaaaaaaaaaaaaaaaaaaaaaaaaaaccctcaatagtcagaatgtaaacatccttaactgcacacaaagactcaggctgtgccttggggtccatgagaattcggcccaatcgctattgctttctgtactttgcatccacagtcctcatccgtgaacattatcttcagattctgagacattcccgcaacagaaaccaaagaaagattagaccacagtcactggattccagttactaagaagcaaagttggacccaagcatcttgaaatgattctcagaaacaaaagttgaaataaggtagtttctgcaactctcaggcaacatgaaaataaaatttaccctcgtacatagccttgttctcacagtttctgggcattatgaacaatggggactgctttttcattcattcattcattcatcagtcaacatttataaatcatctactatgtgccaggagttataattgggacaagggataaagaggtgaaaaaaattcaaacttgtgaacctagcattatctggaacaaagtgtgttgatgtgcaggaacacataaggaaccatttgcagtaaagacaacaaaaaatgccaaactctgcctggacagtggtggaggactccttgcagtagaagtcatgttgaattgaagcctgagggaaaactcaccagaggaacaagggaagggagcccagagaggggcatgagcattccagacttagggaagatccaagcacagagctcgtgcactgctgcatggcccagttagagcaccacatacggccctggggaatgaggggaaatgaatcagatactcactaagtacccagcacttgacacaagttaccacttacaacgtgtgtatccattctgcaaggccggtattagtgtgcccattttgcagattaggtacctgaggctcaaaagagttcaggaatcaccccaggtggtgtagcttctgagagatggaggtgggattccagttccgggactgtgtgtcacttgcatacctgtgccttggtaccacagggggttgacacagaggtgggagatggggaggaagacttttcactagcgtatccttttctaccttttgaaattggaaccatggggaacagcaggagtctttggggatgataagagtcatggatgtgatctgggtagatatttttatatttggtgtcaaataacaaatgtccaaggagtgactgctgaatccaattttgcagtgatcctgattccattgtaaagaaaaataaataaataaaaataaaaccaaatttctgtgaggacacaaagtacttagctacaggaagagataagttgctccccaggagtctcccctcttttggttttttctcagctttcctatcctgtaaccaggtttagccctgggacttcaaacccctggtaagatgaggagactgagaaaggctctgcctttggtctggttcttcagaagcagagaaggcaacaaggactgaagtggcagtgagttcttaagcaaatgctcccaggagaagcctggaaaggaggaggggaaggacaaaaagagagaggagccaaggaggctaggatttcaggcaaagtctcagcctcagcctgaccttacaggggtcttgagagctagactgcttagcatggtagccactagccagatgtggctacttaaagtaattaaatttaagtgaaattaacaattcagatcctcaccctccttagccatatttcaagggtccaatagccacctgtggctagtgactaccatttcgaacagcacagatctagaacatccccatcaccaccaaaattctatcagacagcactttcctagagcatgtaaatgactccttccaagtttgtcccgactcaggcaagtgactggagctgtacattcctacagcagtccatggacagctgaggctgcctggagagatgtcatctcgcaggctcttcaggcttctgcacaagcaggaaagtcctaagtgtgattccttaaaagcaaaggcccagaaggagagatggatgtgcagaaacagtaaatgggaactgaagaggtttgagtggagcactgaaagtgtctgctacaggttcacaagtgacaggggtgccaggtctgaactgagagtaaagcagatgaatagcctaaacccataagcctgcatccaatatgcaaacaggaaatggaaacctcttcagtgcatcactgtgatcatttagaatagaagatgcgggctgggcacagtagctcacacctgtaatcctggcattttgggaggccgaggtaggcagatcacctgaagtcaggggttcgaggccagctggccaacatggtgaaaccccgtctctactaaaaatacaaaaattagccaggcatggtggtgggtgcctgtcatcccagctactctggaggctttggcatgagaatcgcttgaacctgggaggcggcattgcagtgagccgagatcgcgccactgcactccagcctgggcaacagagcaagactctatctcaaaaacaaacaagcaaacaaaacagaagatgtagtaaaaagaaaaaaatcagtgtctatgatgcaaccataaagcagacccagttgtaatagttgtcccctcaactcactgtccctctcccaaattacccagcttaaccactgaactgcaagaggaaatcttattctgtgtggatattaaccctatgaggaatgatacaattaggcctgtaaggattgccctggtctctggctggtagcccatgaggcagagtatgtccgggatcttaggtggcactggctattcattctcactctatcctctcgaagtagtaggtgagcttttgcctgctcctgggcggcagcctggaaatggcagagctgggagtttgcattctagtcttccttcctccagaagagtgcttaaccccagcctcatcaccccagctccctctgtcagaatccctatctgtgaaacactcactggaatgccattgtctccaaagccaaaggaaaatatactttggtaaaatagatttttaactgaccttttggcttgagcatcagctaccagagcatcagtcctgatcaacttctctccaagaccctgtggatgtacctagaaaaagacttttagaaagcaaacaatgggaaaaaaatgtcccctgccttctctgtgggatgatgccagggagatgtagcccctttgcagctccaggctgagcttcccaatgaattgcagtaggaggcagggtccaccccagctgaaatagaaactcttatctccttgtggataaaggtggctctctgaggtgggaagctgggctgatgctgttggtttctggcgggttgtgggggatggtccatgccagaaatggtagcattcaaagggaaacagaatccttccattgcagaggttaccccagcacttccattgactgcttttttagccacttatctaagttcaacaagtgactctttcatttacttccgatgcattctatacagccatatacagcaccgtgtcctttatatatgaccacataagtatgtaatctgtctagtagtattatttgtctttgtatatttctaaagaagaggatccattcctgtttttaaaaatttattttaaaaatcttgtattgaggtctaatttataaatagtaatatgcacaaatcataaaggtatggtgtaatttttacttatggatatagagctatgtttttaaaaaatttattatactgtgtctactaactaatcaccttgggtaatattatcaagaaggccatggtaatattattttcaaaatagatcaagctgggctgtaatcccaggactttgggaggctgaggtgggaggattgcttgagcccagaagttcaagactagcctgggcaacatggaggatccgtctctacaaaaaataaaaaacaattagccatgcatggtggtgcacacctgtagtcccagtgacttaagaggctgaagtgggagaattgcttgatcccaggagatcaaggttgcaatgagctatgatggcaccactgtactccagcgcctgggtccagagcaagaccctgtctctttaaaaaaaaaaaaaaaaaaaggagctcaaccctgtaatgaagtagtggctggcccttatttggcatagatcaaggctacgtgctttaggtggattctattagggtttgcaaaccttgcccaatatgagaattacctggctgtttattaagattcaggtcttcagaaccctgccttagatattctggcttaggctggggttggggatcaggagaatgtgcttttaacaaacatcaggaaaatgtttctcagggttaccgcattcaaccctcacaaccccataaggttaaggttttattcctatttcacagatcagttaactgaggaactgagtagttaagttacttaccacagtcatgcaacagtaacagtaagagatggacctgagattctgtttctaccttttgattcttatccactattctatgcagcttcctaagagcatgtccttatttcctagagtttccatggctcttagaattggctgagtgtatcatatataaaagttttctttcctgacaaataaatcatgcaacaggtggcctcttattccagctaacaatcaagggaattgttacccctaatcatgcaaagtgaggacagagttgtggatagaatcagagacctagagtttctggcttgcccagcagcgggaacaccatctgggactgttaaacaagcaaatgttcaactccaccccagaccaactgaatcagaaactctggggatgggacccggtccatctttgattttaacaagcctccaggtgtttctgacacaggctacagtttgagaactattgatttagaagattgtgtgctgctgcctcccatcttctcaggggtttgtggtgtgtccgagtccatttggggctgctataacaaaataccttagcctgggtaatttataaataatagaaatgttctcacagttctggagactgggaagtccaagatcaaggtgccagcagatttgctgtctggtgaagtcgtgttctcggttccatagatggagcctgttgctgtgttctcacgtgggtggaagggcaaaaagggactaacagactccccaagcctcccccaccctttttttttttttttttttttttttgagacagagtcttgctcttgtcgcccaggctagagtgcaatggcgcaatctcagctcactgcatcctccacctcccgggttcaagtgattctcctgccttagcctcccaagtagctaggactacaggcacccatgaccacacttggctaatttttgtatttttaataaagacactggctaatttttgtatttaatagggacaccacaacctgtctctattctgtatttaatagagacaccggctaattttgtatttaacacagacaccacatctggctaatttttgtattttaataggccaccatgttggccaggctggtctcgaactcctgacctcaggtgatccgccttcctcagcctcccaaagtgctgagattacaggcgtgagccaccacacctggctccccaagtccttttataaggcactaatcctatccatgagagtggggccctcataacctagtcacctccttaaaggtcctacctcttaatacgtttgcattggagcttcagtttcaacatgaattttggggggacacagacgttcaaaccacagcatggtgggtggggaactccacagcaactatgtggttcttcttaccccgtggttcttcagaagcgctgtttggccacaagctgtgatgaccaccagtggatcagttctaaggctgtcctgggtcccggccctcacagagtgatcaacagctcctaaaatgtgatgtgctgctgcccttccttttcacttagatgaccttctagcattttccctggtattttgcattctttcctagctttattttcatggctgcatagtgtccatcacacgaatgctccagagcgtgggttctggaaactgacaacctggctccgaatcccagcctcgctacttaccaagccttggagccttgggcgagttttgtaatctctttttgcctcaagtccttcatcagtaatatgtgcccaatatctatacgtgcctaatagggttgttataaggattacactagatcatgtaaactgcttagaatagtgcttgacacatggcaagtgctaaataaatttagtattttctaatttgttaacccctcttctattttcgggtttataaatacattggctacatttttaaaacaactccatcacactgaaaatttgtaaccaactaaaattcacaggtcatcattataccacctgctaaaaaaaaacttttaaaatccatcctgttagcagaaactaaaaaattaagaaataagccaacaaaatgtctccaaaaatatctccttaataaatggaagaccattggatttgctggtagagagagaaaacaatgtttcatcatatcagatttgacagacctgggtgcacactgcagttttgcccaggcaagcctcagtttatgaccacaagcaagtgacgtcttctctctgatctgtttccacatctaaaaaatagaatcataggctgggcgcagtggctcacacctgtaatcccagcactttgggaggccgaggcgggtggatcacctgaggtcaggagttcgagaccagcctgaccaacgtggtgaaaccccatctctactaaaaatacaaaaaaattagccaggcatggaggctcacacctgtaatcccagctacttgggaggctgaggcaggagaatcacctgaacctgggaggcggaggttgcagtgagccgatatcacgccattgcactccaacctgggcaacaagagcaaaactctgtctccaaaaaaaaaaaaaaaaaaaaaaaaccagaataatagtatctattgcagggcagttatgaaaattaaaatatgatgaatgtattagccataacaaaatactatagactgggtggcttcaacaacaggtatttattttctcacaattactagaggctggaagccccagattaagtgccagcatgatnnnnnnnnnnnnnnnnnnnntgccagcatgatcagtttctggtgaggtaccatcttcctgggacggctgccctattttaatgttctcaaatgacctgtactttctgcgtgcatgggagggagaatgcaagctctctattgtctcttagcattttgaggacgctaatcctatcatatcagggccccacatttagctttaaccagctcatcttaggccctatctcaaatacagtcaccttggaggttagggcttcaacacatgaattgggtggaaagaggcacaatgccattcaatgacctatgtacataattctttttttttttttttgtttgagacagagttttgctcttattgcccaggttggagtgcaatggcataatatctgctcactgcaacctctgcctcccaggttcaggtgattctcctgcctcagcctcccaagtagctgagattacaggtgtaagcctccatgcctggctaatttttttgtatttttagtagaatggggtttcaccatgttggtcagactggtctcgaactgacctcaaatgatccactcgccttggcctcccaaagtgctgagattacagacgtgagccaccatgcccggccagccttatttttcataaacacacgtagtagggccaggtgactgtcagtccccttctcttccctgtagcagagctagggagcttcgttcagcacaagagggaatggccaggactatagccagtaggaaacagttttcttctaaatcaagttatgccctcaaagagttcatagttgatgcatttctttgcttggatttttctttttaggcccaggcacatctaatttatatttttctggaggatgaaaatttgattgtgtttcatagaagtggcaccagaaatgctcacaacatgttcctggtgtcgactgccatgcagagatgtttacgagcagtcatctctcctcttccactgccaaacttcaatggtgcccctatgagtccattggtggtacagtttatagcagtgcgctcaggaagtttgcaaacaagttgtaattttagcaattctcattcctcagctttttatgagtccttgggagaacattttttgcttagccaaagtttatttgatattgctgaacattaaaaaaaaaaaaggtatgctcacttgtatggagtaagagtgttggtttttttggtcactgtcatcataattggcaaatgagatgggtctacagagagtgaggattaaggtcacattatttctggagttatagaggaggtttaacccagaaattctgcatacccagtcccagtggctggtggggagtttcgggaacacagagcttgtaaaaagggcgacactgctctgagcccagtttattgtcccatgggcctgagggaagggtgtggggttgccttgaaaggggaactgaagaatgtgcacttctctactcccagatggcttgggaaccaggcatgctgaatatttctgctaaacctgatgggtaatccttggtgcctaagcaactaacccgtttctttttctttttctttttctttttctttttttgagcggtagcaagggttattgtgaagagcgaaagaacaaagcttccacagcgtggaagggtggatggggacccaaccaggttgcccacaattaacccgtttctaagtgctaaaagtagtagctgcctcaggccagcctcagaaattttaggaattcttttcactagaaagtttggccaattgcatttgtcaaacattaaattacaatcagcctgtggtttccatgctaaccctgggaggcatcctcactggtagaaaatgtggggcatattctatgggcattgcctggggtgacatgaagaaatttacatgcccaataatctacatgctgtcaaactgaaaagtgtggggtttgccttccacacccagccatcccatttgtccccatatacctagtgatcttccagtgtctggtctctggccctcccttctgctaaccaggagcccctcaggagtggtgggtgggatataagaagagtgaggaggtccatggactttgaaatcagacaaaccaggtattgaatcctgagacttctacttgcaatgcgctcttgggcaaaataccagtctctcagaatcagagtctcctcatctgaacaaagggggcggtagtatcttccattttatacagtgattgataggactgattgagatagcatatgtaaatattaagcatatgactgaaacataagtgattgataaatgttagcaattgttaaagaccagagaaaataattgaaattaaagtaagtactttgacatatttgactctgcattttatctgggaatcccagtgtcttaaatcacagtaatcgagctctaaggactgaggttaatgaacttgttggctgtttggatgggtttggggagggtaggatggagtcgggagactggaactccttggcacacacaacagagctatctctaaatgctatttgtaagagctccacagacaggaggcctgcagatgccttcctctttggggtaggaatgttcatttcagttagagaaacttgataggctcctattagtggccaacatagtagccagggctgatggtaggagaatatctggaggcggtatgaaatagaggaaaagccgagtgttataagagctgattgttcaggttatttgttcatggtttcaattttccattaaaataggactgattttagtcattaccatacatggagacatttctaaagatctttttatactgtgtattctacacacacaatgggacatacgttgaactaattaaagcacagttagacaagagaatatatgagttaattaaaagattcaaaaaattatttaaaaagtatagctccaagactgctaaataattaaaaaaaagttaacttcaaaggaaaaatttcccaagatgttggactgtcatgacgtgagaatatccatcagattataagtcttgtttacctctggagaagagcagcacagggataaattaaacccatggatgacctgaagtctgcattgtaatctttcctttcaagtttcttttttttctttttttttttttttttttttgagatggagtttcactctgtcacccaggctggagtgcagtggtgcaatctcggctcactccaacctccgcctcctgggttcaagcgatcctcagcctcctaagtagttgggattacaggcatgtgctaccatgcccgtctaatttttgtattttagtagagatggggtttcaccatgttggtcaggctggtcttgaactcctgacctcaagtgatccattcatctcagcctccccaaatgctgggattacaggcatgagccactgcgcccagcctctttcccttctgtttccttccccacctatagatggtgagctggagcttggccctttttttgtgtgatagaaagagtatggactctgtagtcatatagccgtgggttcaaattctcgacactaactgtgggatcctaagcagttatttcactgcaatagaaccatggattccttgtttataaagtgcagctcataataccactttcaaagaagcgttgcggcaattaaacaagataatgcatccacacaacctttcacctggtgaacatccgcttttctctgtccataatactactggcagatggtcgtggcaggtcacaagggcacaaagaaaggtatggaggacagtcacttgtctccagaaatctacctggataatgccactgaatagtcaggaattgactccaagctgttttgctgcttattcacctgtactaagttgttcgtttcttatagtcaatatccctcaatatcaactttctgagacatgggatcttgcctttcactaccatattcagattaaaggagtttatttatttatttattatttatttatttattttgagacgaagtctcgctctgtcgcccaggctggagtgcaatggcgcaatctcggctcactgcaacctctgcctccagggttcaagcgattctcctacctcagcctcccgagtagctgagatcacaggtgcctgccaccaagcctgactaatttttgtatttttagtagagacagggtttcgccatgttggccaggctggtctcgaactcctgacttcaggtgatctgcctgactcggcctcccaaagtgatgggattacacgcatgagccaccgcacccggcccagatgaaaggaggttagaagatataaatgaggcaattgattggctactcctagctgggggaaatgatgcagggagttagagagtgttcctgggaaacccctctcacctgacaatttggtacttgttagtgattctttgaccctcatttctttcctgaagggtctcttgacgcccagactccattaggggtggccagtggatgaaagtatttgagctcgccagaaccatgtaagcaatctggccagttgtttttttttcttttttttgtggcttgcattgtggcatctgctgggagatgctaattacagcaattaagtaaaatgaggatgtaatattgcttagcaacccagttacctaatatgtaattttactaatttggctgaatctgtgtgctgtaactgtttgtgttttaattaaggatattaataataatgcttttgtatggaacattttatgcaacattctctgatacttctccagaattaaattaatgcaaaagcatttcttgaaagacaggtttttggggattttttgttttgttcaaaactagtcaggctaagggggcatatttgaagatccagaaacaatatgcaatctgatacctcagtagtcagtggagagagaaacacttggcctgatgtcctgcaggaatgagttccccaatgtcataaagatttgacccacaagtggtcctatcatgcagccagtttaagcctcatggaattcatcacattgggcatttaaagtaatttaaagacattttataaattatttttatcttgcttagggacgcatttatgtacaagtcttcaaattggatccatgctgaccatgaatgtaaaatcttaacaactttcactttttcaaaaaataggcaacttctatcccccagaccaaaagaaggtaactctacctccctaaacaaccaagttactaccgaaaacaccagtcactaaagatagattcaaaagaagaagcaggaaatggatgttaggctgttctcataaaacatctaatctcagctacctttcaagatcactttttttcagggctgaattaatctggaaattagcatgtagtggacataaacccaagttctttggatttagcattagttactgctttgtttggttgaagggctgagagtgggagaggagtcatgtagtagtcattaatcacaaacttcttgggaaattgttctctttatattctagttattcatttagtcattcatttaacagatactgagtgcctgctatgtgcctagaactgttctaggtgctaggaatacagcagggaataatcaaataaaaatttctaccttgatcaaacttatgttctaatgacaataatgactattactatgtattctgtgccaaacactgctccatgcaatattcatttattaatttatttaattttcacaacaccaccatgaggtgaccatattattatccccagtttgcagttgaggaagctaaggcatggagagtttaagaaacttgccaaggtcacataatgagtagtagagctgggatttgaatccaggtatctgaatttctgctttacctcctcctacctatggcttcattctgttgcccctctctgatattatacggtcctatttattttttcacttattcacacccctggctaataggaaatgtaaaatctttctgggatttgtagctttgcttccaaccatgggaatgtgtttctgaattttgtaactaatcaattttgtgaagaacaaagcatgtccttgggtttctcaagcagtttcagataatacttagaaactgggtgtgaattcagcttcaaattcagcttcaaaccccgtcccagggtgccagtattttcttctggctgggtaagaaagttatcttctcttgggagacagcattttcttggttactatagtatagttcttgccacatataagagacagatggtcatatttttaaggatacacacatagcttaaaatgtaaattaattgaaatataaataatagcaatttcagagtccccctgagactgcagatcaagacagatcattgggaagaatcttggaaggaatgtaaaaagactgttcctggcagaatgggaaaaagccaggcagacaggttttagccttaccttttcaaatgtccaaatgacgatttgtgaaatctcaatgtccagctgacatttacttggtatttagttcccagaatctggctacagtaatgtgtttccaagtatgatctacaaataaagagcacattaggaggccaattcactggccctgaatgtcagaatatttcagaattgtgttgtgttgtgtgtttgtgtatgtgtatactttcctttgcaaaactgaattcacatgttaaaaaccttttgaaaaacatgtattcatgcagttacccagccaacatttattgaacacctaccatgtgctagattccagggagttaaagagagaggagaccaggctcctaccctgaaagacagcaaggtctagtaagagagatcaggtggtgattatgaaacagtaaggtaaatggattgataatgatgtgtgggaatacagaggagggatgcctatctccagaaagagatcaaagaggagatcagatggcaaatggtcttgagctccagtagatcactttgctggcaacagaagtttgttttccccaacatctatcttcttacccaggagctgtcaactctgatacataagcaacaacccctacagagtaagcacccaagaacctctgttggctgccagcttaggcaacctcagacttgctggaagggcacttacttcatcttggcttccaagaagcaagacatctgctccaagtatggttttctcgcctagattagccaaggtccagagatggctttgatggaaacacgggcttttgaggggagaatattcttaacatccctggggaagtcaatatctaacccatgcttgaacacttccacagataatgcaaacatttatgcttaccctttcctcttttccattcctcacacaaaatcttctcttttccagacaaactcatgttgtctttggcattgttaggaaacctttccgtatatagaccctcaatttccaatctaaatgactatttcttttgaatactgttttgactccctgtataaacttcctctcctttgcagtagacatggccctttgggaatcctggtgttacttaacttagaactcaagtattgggttcttaagatcttaaaggccttatgcaatatgactgtagcttatctggagtctaatatgcctgtgagccatcagagtggagatgatcagtaagcaggctgttagatagacagtatccaacattgtatatccagtattatttattggctgggagttggtaatatgccaatgcaaattaatctcaagagaaagatttcacagagcatttataaattgaattattccactagttttctctatttctttctggaggcgctactcctattgccctgctggctcacataacaaaagagaaaggatcttaatcttatcttgtctgatggccttgactcatctttgcaataccataatatgtacagcaatcagctgtctgttcagtcactataaggtagtatagtgatgaatgtccacattcctatgtttcatccccaacttattattgttgataatcagaagcaattcattgggaatgatataaagaataagtgaaatctattatttccaacaccttaatagggatgaaataacaaatatgttgataaatgtgagattccttctttgtctttgtgccataatcactgatctccattttgcttttcctgaaagttcagattccctctctggaggaagatctttataatgatcgggttgctccagtgaggaggaataattctccacccatccaccctaccaggctcatgttctttgcttgtcatctaccagaagcgggttccgactctcttccataatccagcaatgagtctccccaaaactggagcttaacttggagtaaacaggccatgggaattaggaggggagacagtatttctccttttaagctgtgtctccttgaggcttaatccatgcctattctgttcacaccgtacctagacttgggtttgtgtagagtaggtgcttattagtctactagaggggccataacaaaataccacagactgggtggtgccaacaacagacatttagttttcacagttctggaggctggaagtccaagatcacggtgctgtcaggattgatttctggtgaggactgtcttcctggcttgcggatggctgccctctttctgtgtcctcacgtggtctttcctctgtgagtgcacgggagggggagagatttttggcttctcttcctcttcttataagaacacggttccgttggattaatgccccactcttaggaccccctcagttaacctttattacctccttgtaggtcctattgctataggggttaagaaggaattatttaggcagatagcaagggcatgggagtcctcagtaaggctgttctttttaatgaaaagctgccccaaatcattttctaacaaagagcagcctgtaagttgaactgcagacataaacaagcaagctgggagctttcaggggtgaatgccggcaggaactacggactagacattttcaagatggcggctctatcttcccttctctgccggccacgtgtacagcaagaagcagacaagatggcacagatcaactggaaagtccatttgcataagaagattagggtagggcaagcagcccttccctgcagtatgtaaaagtcatacctgatggaaccaatctgtgagtcctgcctaaatcagacaccgccttctcaaaccggactataaaattcagcacattggctgccaaccggtcctttctgctcggagacccctgtctctatagaagaagctgtttccctttctcttctacctattaaacctccactcctaaactcctagtgtatgcccgtgttctaaattttcctggcgcgggacaaccccggatattcctggcggggatataccccaggcaaggtagccacttcaccatttccaaatactgtcatattgggctttgacatatgcatcttatgaggacacaattcagtccataacagtgctccataaatatttgttgagtatatcacttggtgaatgaagaaatctttattgattgattgaatgaatgaatgaattagcgagtgatttttggtgttcttttgtaaggaagggagaaaggacttgaacaaagcaagaagcttctctgtgacctctgagagtacccctgagtccaaaaagatcctataacttcaactggcgggtctcagcatctttgctatctgctttgctggaggccagtgtgtcagtgtaagggattaatgaggccacaggtataggtttcatcccacgtggatcagttaactttattctgagaagggctactccatagctatagcctgcgggcattaggtgttagactcgaaacacttctaatattaaacaatgaaataaatgtgtttctcatgcatttaagaaaggtgaataaaaacaagtaaaataattatttacccaatttttggtgactcagtgacagcagtcgtagtggtggtggtttcattaaagaattaatgtttgccgagtgaaaactataaggagcaccccccgcccaccacgcaggtcaaaaccaatcacagatgaggcaggctcgctgagcgctttcagtcagcgctcattgtcctacgtctggatgattattgtagatgtcatgattttttatactaatttgtatgcatttcttcactcattttccaactcacttattccagttcagagtcaagggtggccagacggagcctgtcccagcagctcagggcacaaagcgggaaccaaccctagacagacgctcacacccacattcacacttaccccaggaccatgtagaaacgccttgtcaccgaacgggaacatctttgggatgcaggaggaaactggagatcccagagaaaactcaggcactcatggggagaatgtgccaactccacacaggcagtggacctccccgggaatcgatttcttttctcactaatgtcataataaaatgatgttgaatggaatgaaaatatttaaggacctgatgtatatgtttcttatagaattttttttttctttgagacggagtctcgctctgttccccaggctggagtccagtggcacaatctcaactcactgcaacctctgcctcctgggttcaagcgattctcctgcctcagcctcccgagtagctgggactacaggcacgtgccaccacaaccggctaagttttatatttttagtagagacgtggtttcaccatattagtcaggctggtctcaaacgcctaacttcacgtgaccacctgcctcatcttcccaaagtgctgagattacatgcttcagccaccctgtccagcctcttagagaaaattttaagaattttttaaaaagaagaaataaaatcagccataaaattgctctacattttaatggttttgttttcaagcttttctttaacatccttgagttacatttacagagcttttccagaatatagatgcattttcccacatttacacatagtacttataatttcaaggtgtgtaatgctgtatccagaggacatgcacacacatggatacagcagatagctcatgtatttcacttgagttttatctgggaaaagtatccttttattacagcatacccaccaggtagtgaaaagacaatttgctttatctcagagtttacatacagtactatacgtttcattaagccaatatcatcatatccaaaaggacacataattcaacatgtctgctgttcctcagatggcaaatcaaggttctttaatataaatgttagagaatttacacttggttagttgaaaaatcaattttcctcttctctgtttttattaatcaatgagaattttatgatgagatgaataatacagaacaccaacagtccttcctgtaaaacaggagtccccaagacccaggccatggacctgtagcggtctgtggcctgttaggaatgggactgcacagcaggaggtgagcagctagcaagcaaagcttcatctgtatttacagcgctccccattgctcgcattaccgcctgagctctgcctcctgtcagatcagctgcagcgttagattctcgcaagagttctaactctattgctccttatgagaatctaatgcctgatgattctcataaggcatcatcacccccagatgggaccatctagttgcagtaaaacaagcgcagggctcccactgattctacattatggtgagttgtataattatttcattatatattacaatgtaataataatagcaataaagtgcacaataaatgtaatgcgcttgaatcatcccaaaaccatctcccaccaatccccaattccccatctcatcccaaaaggtggggaaaccagtccctggtgccaaaaagattggcactgctgctctaaaagcttcctttggccgggtgcagcggctcatgcctgtaatcccagcactttgggaggccaaggcaggcaggagttcaagaccagcctggccaacatggcaaaaccccatctctactaaaaatacaaaaattaacagggtgtggtggtgcacacctgtaatcccagctactcgggaggctgagacagagaatcgcttgaacccaggaggtggaggttgcagtgagctgagatcacaccactgcactccagcctgggtgactctgtctaaataaataaataaaagccttcttcattattacttctcgaacacactggacttccccattaagctctccctgttcagggtattggtcagcttggttccaggttttcttagacctcattcctttctcttagtaattccattcctcataccctgagctaccaaatgtgtattttctaacaaattgcattttcccagttattatttacttcaattttatagtctctctggagaaaaataaatattggtaggaaattcacagaaactcctaagattctccatgagagtggcatatctttttctcactttgcttctgcctctacaatatatttatgctggctctggatcgtgacagagttgatgtcctctggatggaaatttagggtatggaaaatgagagcatgttaggccagggaaggaggaagggaaccagtttttattgaatgctgactataatgtactaaatactgaacaaagtgctctgtatattttactatatttaatcctaatcctatggggtaggtattatatttttaaaatgaggaaactaagggtaggtgtaagaatggagcacaaaccatatgctagtttctgtgataggtacagtgcattggttgtttaatcttcacaacacaaccttacttttttttttttttttttttttttgagatggagtctcactctgtcgctcaggctggagtgcagtggtgcgatcttggctcactgcaacctctgcctcccgggttcaagcaattctcctgcttcagcctcccaagtagctgggattacaggcacatgccagcatgcccagctgattttttgcatttttagtagagatagggtttcactgtgttagccaggatggtcacgaccttactttttaagaagtagtgattcttaaaaagtttaacaaatgtcagacaaaatggggttctaatacagctttgtatgcctcccaaaccatgtcctttttcagtttaacatgcagtctgacagctgtgctcaactgatacagatgttaaaattttaaaaaggcagggtgagctatttaatttctggattcagagtacagagtgctcaccattacaccatggcacctcacatgacctatttaatttcttttttttttttttttttgagatggagtctcactgtgtcacccagtctggagtgcagtggcacgatcttggctcactgcaacctccgcctcccaggttcaagcagttttctgcctcagcctcccaagtagctggaattacaggtgcgtgccaccatgtccagataatttttgtatttttagtacagacgttggtttcaccatcttggccaggctgtcttgaactcctgacctcgtgatacatccacctcggcctcccaaagtgctgggattacaggagtgagccaccgcgcctggccgagctatttaatttcttaaagtaattaaagcttaaacactttcaagtctaaaaacttttttttgaaacacaaacacttttgagcaaataagaaaacacagtatacatttttgctccttgtagataccttttcttaatgaatttttaccttacccttactccctttaaagcctatgctaggcttcagagaaatgctttctgttttctttagcctcacttgcatttgaatcctctagcagcttctcagtgactcttgctcacttattataaaatgccctcctccctcctgaatgaattgagcttaatctctacatgttaaatccccttgtgtgggcacccatgccagcagtcatttcccttcacactgtcctagactctactctcaatgagattcacagaacttccatatctctctttttttttttttttttttttaaagacagagtctcgcactgttgcccaggctggagtgcagtggtgcaatctcagctcactgcaatctctgcctcccagattcaggccattctcctgcttcagcctgccgagtagctgggactacaggtgcatgccaccatgccaggctaatttttgtatttttagtagagacggggtttccgcatgttggccaggctggtctcaaacttctgacctcaggtgatctgcccgccttggcctcccaaagtgctgggattacaggtgtgaggcaccatgcctggccttccatatctttaatgactcttccaacctaaaggcttttcaaatacactttttctttgagttggcattgcaaaccgcccctcttgcctaattttaactttgtaagtaaaagaaagctcctccaagttatacaacaagcttgttgccagaaattcaacaggtaataatatgctttattctactgataattttgttcctacagtatttaggtttataagagaacataagcttttgtatttcctctgtgcaatttttatctaggggtaacaagccttttgcctaagaaaataactcttgtatccaccatatgcttagacacctggcatttctctagtaaattgtaaagtgttgctttctggattaaaagataagattgaaaatgcaaataccctagaaagaagtcacatttactaaattagacttatgctaccctgcaaatggttgatataaaagtctctcccaaaaggagattgagatatcgaggagtaggagagacatgaaagatcccagtgtttaaaagcaatgaatgagaagtaggacctagcccctgctccgaaggtggccctcagagcactttgattcttcttctttcaagtctggcctttcagaaaatatttactatggaagtcacattttatgctgagtgtaagttcaaaagtcagtgtgaaaatcttgtgtggtaaaaatctctcttgaaaatctcccctaaagtgcagttccataccacttctcaagaagtccagcattgccagttcttccttgagctttatcagatacaccactggctattgcttcaactgagtttcagcttgtttgtttgcatttaggggctacgtgcatgaaaaattccatacccagaagtacattcaatgcagccagatgttcaaactacaagagacacaggggagtgaagcctaacccaggaaataatagattctcagtcttatttcatgcttgtgctgggacatatagatgctcaggaaaggaatattcagagagaattttacacagtatttaaattcttttctccgtcacatttatttatttttcttatagttgaatttgcacaaattaaagtcatgttattgaactcccttgcatatttgtccagatgcccagctcttgggtgctgtcttaacctcattggagaggagatggcagaagagcagggtatagtggagccctttgattccagaccagaaaaatgagagcagatcaccaatttgggtcttatacaaggtgatatgccaggtgaataaactagtctccattttgatgatgtctctctctctctctctccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactggtgagtactgcagtgagctaccaaggacacattgttacgggaagatgaaccctctactccaccggggccttaaagtagttttcatcactggcctctggggatagttaaaattccagaagcaaatttaaattcttctaaattaaggaggtctataccctactaaaatgtaacctaaggctttgattatagaaagacttatcctaccttcattcaagaaaagttggtaagttggatagtcagttacagttttcctacctgtaacctctgggtggcttcctggaggaatgaactttgaggcatgaatgagtagtgctcttggttacaaacaacagaaactgattccgagtaatctatcacagaataaaattattggaaatatattaggcagttaataggattgatcagaaaacaggtgtgtgagtcttttaggcctgctataaagaaatgcctgaggctgggtaatttataaagaaaagaggtttactttggctcccagttctgcagactgtacaggaagcatggtcctggcatctgcttctggtgaggacctcaggaagcttccaattatgatggaaggcaaatgggatatcacatggcaataggagaggggagagagatagagaggagaggaaagtgccgcactattttaaacaaccaggtctctcatgaattcaaagcaagggctcactcattactgaaaggaggagggaaccaagctattcatgaaggatccgcccccaagacccaaacaccttccaccaagccccacctccatactggggattacatttcaacatgagatttggaggggataaaacatccaaactatatcaactagagacccagggcagtaaaaaagagcaggagccaaaggcattgagctggggataagcggagcaaagggacagttctgggaagagtgaccagtgcccctgccctggtgtgaatgaagaggcagaggcagaatggaagtgctgagtgagcacaggccacattcacacagagctcttagaaagggcaagtcggtggtagaaatgggagatgtgtgtagaaggaagaacccttctatagtacagtatgtattaaggacctgctatatgccagtcatttaatgtgtcagtagtttcatactttgaaaaacaaagttgttttttttttttttttttttgagacagtgttttgctcttgtcacctgggctggagtacaatagcgtgatctcactgcgacctccatctcacggattcaagcaattctcctgcctcagcctcctgagtagctggaattacaggcacatgccaccatgcccagctaatttttgtattttttagtagagatggggttttaccatgttggccaggctggtctcgaactcctgacctcaagtgatctatgtgccttgacttcccaaagtgctgggattacaggcatgagccacctcacccatcctgaaaaacaaactttttatgggtcctaaaatcaattaattgattcaggcaagaccagcattttaaaaatgaaataaagtagaatagaataatgggtgtaaatattgtttcattgttttgaagaacttttgattgcactgtgtgtgtaccccatgtgtgtcacaatactttgcctatctcatccaatccttccatttcccttgtcaacctgacaaatcaggaagcaaattctcaaaaaaggtcaaataacttgcacgagatcacacaactaataaatgacagatctgacttcaactctaggttgtgtcactctgaagtccactctttgtccactgtagtttctacagagacaaagaacttcccacagttatgccactgatccaacaaaaatcagttctgctcaggctgctgtgatcaataactttcatgccactctccaaaacatacagagagaaatgatgatagacatccaaacttacatatataggtatatagatagataatttaaaatttttaattgggcaaagattaaataagggactggaaacccggtgtggtggctcacgcctgtaattccagcactttgggaggctgaggtggatggatcagctgaggtgaggagttcgagatcagcccggccaacatggtgaaaccccgtctctactaaaaatacaaaaattagccaggtgccgtggcatgtgcctgtaatcccagctacttgggaggcaggaaaatcgcttgaacccaggaggcagaggttgcagtgagccaaaatcatgccactgcactccagactgagtgaaaagagtgagactgcatctcaaaacaaaacaaaacaaaaaaaagagaatggaaaagtaatatcaaatcttaggtaacattactaggtaaacgcataccatgcaatcttacacatttgctaagttgtactccatccatatttaacccggtgtttttcatcactcaggaaactatacaattaacaatgtctgtaatgttattgttcttgatcctgaaatctaagacaaattctttctggttctgagctctaaggccaacctcttccaggtctcctgcggacattcatcaaagggcatcaggtgtcatagtggctagtaccctcaacaaaagtcttccagtaaatctaactttgagtttcatataatagttgctgttttcccttttctattatgctttcttgcctattctttcatttctctctgtctctgaggaagcagtacaaagttatagtcacaagtaggggctttaaagtcagataggcctggattcaaattccagttctatttctttcataatcacttactgaatgtgttagtttcctcatctacaaaaaggagaaagtaataagacctacctcataggtttaataggaataacagtacctagtacctaccccagggttgttgtcaataagtacgattattagttgttgttcttgtaattattatccctagacctgtgctgcccaatatgctagctttaatcagaggtggtgatttaaattaattaaaatttaattagttcctcagtcgtgcttgccacattttaagtgttcagcagccacatgggcctaacgcctacttcgctgggcagtggacagtacagatctagaacatttccatcacagtagaaagccctgttgtacggctctgctttagaggaacaggatttcccacaagacatcttaagaaccatgcttccaagctttagctgcactggaaacaatgataacaattttattttgtttcatttttaaaagcctcaatttgctaacccccagtcccacctctagagattcatagtcagcagttctagggtggggcctgagaatttgcatttaacaagattccaggtggttctgatgctgctggcccatgggaacactctttgagtcgtataacgccagggtgcaacttcctggtcacccaggagtactctttttttgttttgaaacggagttttactcttgttgcccaggctggagtgcaatggcatgatctcggctccctgcaacctccgcctcccaggttcaagggattctcttgcctcagcctcctgagttgctgggattacagatgcctgccaccatgcctggctaatttttgtatttttagtagagatggggtttcaccgtgttggtcacgctggtctcaaacgcctgacctcaagtgatccacccacctcggcctcccaaagtgctgggattacaggcatgagccactgcatctggtcccacccagtagtattctgaaagatgtggcatgtgttaacatgtagtagggtttttccaaatttcctctgtttatgcaatcatgaaaaatgagatgttttgcagaacttctattgcaacatatccaagataatcagtgcctttttgtaattatcctgaaactaattagtgtcctcaaatgtttcccatcattgttgaagtcttgtaggagtatcttggaagcttttatttttgatgcctactctgaatggcaaaaaaaaaaaaaaaaaaaaagttttgaacttgagagttggaagaagcttgagccacctgaatactaagtttaataaggttacatgtgtaataacagagaagttcagaccctgtgcaaccatttggggagtgttgtaggaaagaatgaagatgctcaaagggatttggcttaatttacattctacaaattttgtaaaatctttctctaataagctgaactctgctttgacaagaaaacacgagctattgatagactaatcagtggagaataggaaataattctgtgaagtgagctagctgggtggtggagaagtaagtatggaaatgacccaaagtgtgatccagttataatttgaaagatgcctgcagagagttggggaaagaggtctatgttttaatcagggcttcaattaacttgataatgtattcaatttattctgtataggttgagaacatattcagataaccgattccatcctatgtagaatgggatcacaaataccccaaatactatttgaggtcaaccagagtatttgaggtcagatactccaaaaataccatttgaagtcaactagaattaaaagtaatcacaatcagttaattcagaatatctgaaggtatagctttaacatttatttaaacattggggaaaagaacatcatttttacagcccattcacccacatggtctgcgggttgtagaaatgaagagtatcaaaatggagtcagtcatgggacacatgcctgtaatcccagctactcaggagactgaggcggaaggatcctttgagccccaagtttgagaccaacctgggtaacatagcgtagacccctgtctcaaaaaaaaaaaaaatggaggggtcaagacagggaggcagtgctatcagcacaatctctatgctactgtccttagacatccttgaatgggagggctggcggagggcagggttcagggactgtgcgcagaaggagttatagacctgttagatgaaaagatcagccctagttacaagtcgaaagatatctgcaagtcagtctggagaaggggcatatgttttaatcagagcttcgattaacagccaccgcattctgtgaacaatagaaatctctatttcttcccggaaactttggaggcctccccgcctactgtcattattcatgaggtaggaaagctgagcgactctgtgcccagctctctccccacatccctccttgtcctgagtgccagagcatgagaagggacacaggacagagtggaaagaatttgaattttgaaagccaaacaacctgggtagtgatgtgttcacctctctgagctttcctttttccacctataatattgggccgtgttccagcttcagaagtgtgtggtttataaagctgagtggagtaaatgatgatgtacagcaagttctgaatcaataaagctcttgctcttatgcctccaagccccatccccagcagtgagtgtgctggtttccctacataacttttagatgtagatcaaaacctgagccaatttacttgtcaggtctgttaaatgtggtgttttgtgaagcaaaaaaatccaatctgatccttaataacctttttcagaactctttgatcaagagttttaaacattcacaagtcttcctaaataggaattaggatgctgtggcagtccccttgcccagctcataagcttaaagagcaggactcttttcctaaacatagtgagaatcccagataaaagctggcaccgcacctgctcaagaggtttttgctttgtttctttggatgggagggcaccatgtggataccacccatgagattcctggatgccgcactcagggtgctcctcatggaagatgccacatctgaggtctgtcagcaacagcagcttttccaggatccaaaatcatcagcaaaattaaaagagcacccctctcaatttctaaaaagagattttttatactattaaaaaatagactatttttaaactactcattcctgacttatgtatttacgttagttaattttgatgtcatgggtgtatgctgtcttctttcaccaagtggtagatataattgtgtgtgtgtgcgtgtgtgtgtgtgtgtgtggatgataaggttggtgattcaaaggtggctttatttatttaaaaaaaaattttttttgagacagagtcttgctctgtcgcccaggctggagtacagtggagcaatctcgactcactgcaacctctgcctcccaagttcaagccattctcctgcctcagcctccagagtagctgggaatacaggcacacaccaccatgtctggctaatatttgtatttttagtagagatggggttgcaccatattggccaggctggtctcgaactcctgacctcaagtgatctgcccacctcagcctccaaaagctgggattacaggtgtgagccagcatgcccactggccttatttaaatcaaagttctgttttttctggcttgagacaaggcccacagggccattggaaggcaagtacacctatagagctgtgtgttgttagatggctggataaggactagaacccagataacattcagtagatcctagaaaaaggaatttctttccattatttttccttagttctatggggcttttaaaattacaacaccaaaataaatccaaacagaatattttcatgaacaatgactatatttttattttagcaagaaattcgtagctgatcgctgggactgaggaggcaagaagtgagtgattgggaaaatggattgattgccatggttcatacttgtctctttttctctctctttctctctcagcttgcacctacaaaaaccaggagtgccgtttgaccatacattatgagaatggattttctattaccactgaaccacagggagggtgcctttcccaagaccatcatacagtctccttatgaaaagctcaaaatgtcttcagatgatggaatcaggatgctgtatttagattttggaggcaaagatggagagattgtaagtgtacttttctttagacagtgtgatttcatatattaatatttcattatgcaacataatgctgccttactcttattcggcatttgactgctaatgatgtgcttgcaagcccatgttttatttgatccttgaaaaacggtgattaggttcaattatttcaaacttctgttcttcagtctcattttccattagaagactacataaatatttgagtcaaaggaaagaatcctttacaaagttagattaaattcttatcaaatagggtctcaccagcttaaaaaacgtaccctgcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatatttatggtgttggtatatctaaatttcacaggaactatttcggaaaaaagatatatgagatgtaaggaataagttcaaagagttgttcctttatctcattgaggggcagtgattttagagcataattgctccagtcaacatttaaaagaaggaagtgcatatagattcgtttgatgtgcaaatcacccatctacatcaagcattaatttaaaatcgctcatgctctcttctttttaaatttcagcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctattgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactgctttcactatatattttcaaaatcactggaatgttgttatacaagagaattataattgtgtattgtaaataacatattaaaatacatatattaatgccaatagttaaattcaacaatatgtaatctaaggtgctcg

SEQ ID NO: 17505 - DNA, 7027 bp, Human
tttttagtaccgacacggcgttttaccgatgttgggatctgcaggttggtctcgaactcctgacttcgtgatccacctgcctgctgtagaaggaccgatcagactatctcctaaaagaccagagctcatgactctccctcaaaatgaccacccctcacattcaacaagtgattctctgcttttgctagcaatatcctgtatgtagaaaagaaagcagaagtagattctctgttacccttcctgccctagggggattccacggatcctgagtcaccctgggagattatgaaactcaaaggtctttctcaaagatctttaaaaaccactgattctcaactgccaaattacagctactagtctttcctgatagtgttggctagacctcatggatgaccagaaggccttttcctcctctgcttctgtctaaaatgtcaggacttaggagcgcttgttatacatttcctggtaacagtaaattagaccgctatgactaagcgctagtgacagctgcgtagctaaagcaaaaccaaagccatcttctgtttgggttgcttagtttaatagaatagtgattgttttggctgggcacggtggctcacgcctgtaatcccagcactttgggaggccgaggtgggaggagtacttgagcccaggagttcgagaccagcctgggcaagatggtgaggccctatctctaccaaaaaaaaaaaaaaaaaaaaaaaaaaaacttatcaaggaatccaaagaccttaccttcgaaaattgtaaaaaacagtaatacacaagcacatattcttttagtcaccagagcaatgacatcatcacatattctgtaaatgtataattatttcaaaaaaaagttaaaggaaatgaagcacagaagatgaatcaagtagggattacaacaactttcaacagcaaccgaagtcagaagacagataccatcaatgtgctgaaagaggaaaacttctgaacctcaaaatctataaactatgaaataaacccttcaagaattttaagatgggctggtccaaaggtagtgagttatctcagttgattgttcacaatcagttacacatcaaactccttattttactctgactactgcacttgactagtctaaaaaaagaattataagatgaattaaagacacgttcagataagcaaaactgagaacgtttggcaaaagcagatctttactaaaggaaattatgaagaatgtacctcgggcaaaaggaaaagtgtcaagatcaagtgtcaaggaagattagagatttaagaaggtataagaaggttagaaaagtaagaaaaaaatatgccgtcaactctaaaaactacaagtataaagaaaaaagattattgggaaatccaaataacctaccttaggaaattctaaaagaatatacgagctcacattcctttggtcataagagcagtgtcatcattagacatcaggtcgcctctggaaaattccattgtgagtttaaaaggcaaatgacgtctataattctaaaactagttctcccaccgaaactctagaaaggatcttgggatctgcagggtctcccggatcacactttgagaactgctgctttagtcttcctcccatctcctaaggccagagctcctgagtttgcttcccactggccaaggagaaaagagcaaggtcacttgtcggggggctgcagagggaattaccttctttcatttgcaaatgttactgggggacacaccggctcccagtagggtttccgccaaggctccgcgaaacgccactagagggcgccgctagcgaatcccacagcgcgccccgctgcccccacttttgtcctccgggttcacacgggcgcccggaagagagggtggtgcctgggagaggaaacgatgcgccccggggccgcggcctcattggatgagaggtcccacctcacggcccgaggcggggcttctttgcgcttaaaagccgagccgggccaatgttcaaatgcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagggtggggtgattcacgtcttgaggtctcggccggtgtgagagcccagcctgttcccctttctgcgcccatccccggctcggccgccaccccgcccgcccgccccattcccttcccctgagctggccgggccggagcctcattttgttttctacttttttctctcctatgtgcatccccccaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgcctttttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacaggacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggtatgtcttagtttttggtttccaaatttgtaagtttactggattattttaatgatggaataaaaattgggtcttgagagcaggctgaaatgtcactgagtgtgtgttttactctctcataataggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaattgtttggtgtaagcatttttactagttctttatttcttacacatctttcttgctgttgaagacaaaaatgacccgcaaacatcattggatgaacagaattgctcaaaatagtttttaacccaatttaaagtttttatggtcatgtgttatgttagtattaacaaagtctggatagaagccagtttaccagttggctatcaaggttttatacatagcaacatgtaaaacatgacttttttttttttttgagacacagtctcattctgttgcccaggctggagcgcagtagtacgatctcagctcactgcaacgtctgcctcccgggttcaagcaattctcatgcctcagcctcctgaatagctgggactataggcatgtgccaccgtacccagctgatttttgtatttttagtaaagatggggctttgccatgttggccacgctggtcttgaactcctgacctcaagtgatccacccacctcagcctaccgaagtgctgggatgacaagggtcagccacagcacccggcaaaacggctttttacgttgatgacactatacactgcatctgatggatttttttttttttttttttttgagacagtctcgctttgtcacccaggctgggcagtgtggagtgcagtggcacgatctcggctcactgcaagctcctcctcctgggttcacaccattctcctgcctcagcctcctgaatagctgggactacaggcgcccgccaccatgcccggctaattttttgtattttttagtagagacggggtttcactgtgttagccaggatggtctcgatctcttgacctcataatccgcctgcctcggcctcccaaagtgctgggattacaggcatgagccactgcgcctggcctgacggaattttcaagagctgaaaaccaagttagaaactgaggcccacaatgaataaacccatcattacacaagtaaaatgtggagatgggattatgaaacattgaaaatcaagaaaaaacatcttgtccctaaaaacctcatgccacataagatttttttttttaacagagccaaggtctcattcaatgaataaactcatcattacacaagtaaaatgtggaggtgggattatgaaacactgaaaatcaagaaagaacatcttgtcccccaaaacctcatgccacacaagactttttttttttttttttttttgaggaagagtcttgctctgtcacccaggctggagtgcggtggcacgatcttggctcactgcaagctccgcctcccggtttcacgccattcccctgcctcagcctcccgagtagctgggactacaggcacccgccaccacgcctggctaatttttttttttttttttttttttttagaggagacggggtttcaccgtgttagccaggatggtcttgatctcctgacctcgtgatccgcctgcctcggcctcccaaagtgctgggattacaggcgtgagccaccgtgcccagccaagactttttttttttttaatagagccaaggtcttactctttcgcccaggctgcagtgcagtggtgtgatcacagctcactgcagccttatcctcccgggttcaagcaattttcccacctcagcctcccaaaagtaactgggactacagctgcatgccaccatgcccagctaattttttttatttttagtagagacagggtcttgctaagttgcccaggctggtctcaggtcctcctgccttggcctcccaaagtgttgggattacaggtgtgagccatggcacctgaccaagataattttgaaggtaaagcggatcactgaaattagggtctcctatgtgtactgaaaaagtacacatttttttacaggaaatttgcaaacagaaaagctccagttggacacaagcataaatcagataaattaacatctcatttggagggtgaatttgtagtcctgtgttaatacaacggatttttagagcagagaaacaatagcccttaaaactgcc

SEQ ID NO: 17506 - DNA, 13682 bp, Human
aaaccctgatttccccacaggggctggcagtcaaacaagaggaacagctgacaactatgtgatgttaccagaagaaaacacaaagcagggagatcaacaggaagggtgagcaaaagcaaagtttttcaaaacccaggataggggtttgtggccaccgaagtctagtctgacctgctggggtgatggcctgaccccctccagcgggcagcaggccttgttgtgcttgtgcctctgctcgagcagccagggcagcaaggcacggttggtgctcccgatttccctgtaagaggagcagatcggtggttggactccacctactgcccccgacccatgccaggccactccccaaatgtccaggctcctgacccctcctttgggatgtcattgtgcccactgtgacgtgggtgtcttgctggctagctcccaaaggggccgccagatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggtaaacaagtcatccctgatgtagctgtagagcccgggctgaggccccggccctgtagccgccccagcgccctctttctccacctcctccagggctgccggggctgcagggggcaccgagacggtagggcagctcagggcactgctgctctcctggccacagctctccatgggcttcgggccctgtgtggggacagatggggtgctagggtgaggactaggccctgggggcctggccccccaagcttccttatgggacacccagacctccgtcggtgcactctgcactcagccctgcccctcccccagtctaccctcccgaccccattcccgtctcctttcctcccccatcgcacctgcctcgtccccacctattctctggcaggtttcctgacccaccccgcctcctcccaccccatccccgtctctacccagcgtctccccgcactctacctcgttgtcgaggttctcactcatcgcccaggcggttctccgcctagaccagggacgccatgggggccgcctggccacctcgtcctgggcctgtcacaagggaagtggcctgtcacaagggaagtgctcagaggggaggtgctcacagagccggtgcaacgccgcgaggtcgccgccacccccggcttcgccccaggcggggcgggactcgaacctgcgatgctcaggtccgggtctcaggcttggggctgtaccgcccgcccgccaggggcccgcgccggccgctcgcttcgccagccactcttagtccgccagcgcgtgcggcggaggccgagcgtctctatgatcctggcttctggcaacgtcatcgtcacgcgccggatccaacccccaaccactttagccagctctagaggcgcgcgtggccgggacggaagtgcgcgcgggtgtcgccgggagtgcgcgctcctctggctgacgggcgggccgggcatgcgccgcgggcgttttggcgggaagcgcggggcgggccggacaatgagagtgtccgcctcctgagccaataaagctgtactggttttgaatcgcggcgcgtttcccgccgctggggtcaggggtcgaggttcgggtcgtggggcggagggaagagcgggcgggcgggaggcgccggcgccagacgcggagggaaggagctacgagtagccgccgagaggccgcggagccagcgacgaccgacccagccgagccgccgccgccgccgcgcccccatggcggccgccaaggtgccgccgggcccaagcggggacagggtgggcgggcggggccggggccgttatcagcggccacgtgggcggcccgcgccgccgccaccaacctccgccggcctgcaggctcggccgtctgctgggcctcggtggcgcggagtcggggcgcgtggggtttgggggctcgaggcctgcggagttggggcgtttgggggtgcaggctctgcagaggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctggaactacaggcacccgccaccacgcccagctaattttttgtatttttagtagagacggagtttcaccgtattagccaggatggtctcgatctcctgacctcatgatctgcccaccccagcctcccaaagtgctgggattacaggcgtcagctaccgcgcccggcccacccttaatatacaacatgatgcttgcgataacacatgaaaataggtgatggtttagttattaaaaccacttaaaaaaattctgtacatgtgcttcttgacgctttcagttaagagctggctacagtggtgggtaccagccttgtgtcttgtgacagtgtcacagcaccacagagactgtggcctgtcgcctacactcaggattgcaacaaacatcatgtttagttacacacctcagtgaaaatgaggttgtagtttttccctgttcaagttcatggaatccccccatccttgaagttgctttaagagtccaggttaaggttttgttgctctggggtgggagagggaagcagagagagtcattcctactgtgagtttcctatccaaggaagggggccaggagggatacctgggaaaggagagctgtgtgtcaccctttggtcacagagggtgatggacatctccctgaaaccactgggtggccatggctccactctgctgatgcattgccgtagcccctgtttgggagtagctctttgctgtggtgaagtgcttgcctctgttccctcactgcccatgtcgggtgggaggtgctcctggtggcctgggcccaggcccttcctgagggaggtgaggccagcagggtgggcccgggtctttgcagtaaagctccaggggcatcctgttggggaaccctgtgagacagtctcttgccagaatcatgttggggcagagagcagagtcgtctgagagaggcaggcagagctgtgcacagagggagggcgccagcctgagccctgagtgcactgctggattctgggtgccctggtccccagcgggaggggctgctcctgggcaggagggccaggtgttggccagggcctgttgcctgattagaggcctgggcctcttctctgggtcatctgacctcagatgacccgcccgcctcagcctcccaaaatgctgggattacaggtgtgagccaccgcgtccggtcatctaattctcttggttgtggaagtggaattcaagatgacctggagttttttgggctgctgtgcttcctggtggtgtcgtgacagaggtccttggcctgcacctgatccatgttgtccctgcagatctctggggctggggtgctcttgcacagtgaccatgggacggagtcttgctctgttgcccaggctggagtgcagtggcgcgatcttggctcactgcaacctctgcctcccaggttcaagcaattttcctgcctcagcttcttgaatagctggggctataggcgcatgcctccatgcctggctgattttttgtatttttagtagagatggggtttcaccgagttagtcaggatggtctggatctcctgacctcatgatccacctgccttggcctcccaaagtgctggaattacaggcgtgagcccccgcgcctgctctctcttttttttttgagatggaatttcgctcttgctgcccaggctggtgcgcaatggtgtgatctcagctcgccgcaacctctgcctcccggcttcaagggattctcctgcctcagcctcccgagtagctgggattacaggcatgtgccaccacacccggctaattttgtatttttagtagagagggggtttctccacgttggtcaggctggtctcgaactcccgacgtcaggtgatccacccacctcagcctcccaaagtgtgggattacaggcgtgggccactgtgccctgttttgttttgtttttttttaaaatagggtctcactctcacccaggctggagtgcagcagtggtatcatggctcactgcagccttgaactcctgcgctcaagggatcctcctccctctgcctcttgagtagctgagactacgggtgttagccatcatgtccagctaatttttatctttttgtagagatagtgtcttgctatgttgcccaggctggtccccactgagggaaatattgtgactgtaggagcagtggggcaatctccactcactgtatcctctgcctcctgggctcaagtgattgtcgtgcctcagcctcctgagtagctgggattacaggcgtgcatcaccacactcagatgatttttgtatttgtagtagagatggggtttcaccatgttggccaggctggttttgaactcctaacctcagatgacctgcccgcctcggcctccccgaatgctgggattacaaatgagccaccgcgcccggtcgtctaattctcttggttgtggaaccggaattcaagatgacctggagtttgttgggctgctgcgctttctggtggtgttgtgacgggcagttcttggagcctgaagaagggctggggcgttcgtggaggcatggggtcctgcagtgcagagttgtcctgtgtcctcctgcgcaggccctgcatgtgggctgcaggtctgcactcttaacctcacggcttttcttgcaggcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgaggagtgagtgctgcagggcgagggggtgctgtgtgtgtgtgtgtgtgtgtgtgtgtgtgtgtgtgtgtggtgtctggggggtgggggttggtgtctggggggggttaatggggggtatgtgtagtatctagggggctgtggtgtctactggtggtggtgtataggggtgtgtggttcggtgtgtgtggtgtctggggcagggggctgtgtggtgtctgaaggtgtgtggtgtctggggcgggggttgtgtggttgggtgtggtgtttgggggtgtgtagttggtctggtgtctggggggtgtggtggggtatgtggttgggtgtggtgtctggcgggggtggttgggggtgtgtggttgggggtctggtgtctgggtgtttggtgtttggggtgtgtatgtggtgtctgggggtgtgtgtagtgtctgaaggtgtgtggtctggggggctgtgtggtgtctgaaggtgtgtcggggcatgtgtggtgtctgaaggtgtgtggtgtctggggaggtgtacagtgtgtggtgtctggggggcgggtgtggtatccggggtgtgtgtaggggtcatctggtgtttggtgtctaggggggtttgtggtgtctaaggggtgtggttgggtgtgtgtggtgtctgggggtgttggggtgtgtggtgtctgggggtgttggggtgtgtggtgtctgggggtgttggggtgtgtgttgtctgggggtgttggggtgtgtggtgttggggggggtgtgtggtgtctgggggggtttggtgtctgagggggtgcggtatcgcggtgggggtgtgtgtgagagagattgggggtgttcgggcagtgtaagagcagatgtgtgaggtgcccaggcaccagcctccccagttatggtgtgttctaccctcaccaggatcttcctggggaggaaacgggaggggaacggggctgagaaggtggccaggtcctgggcgcctctgaagctacataagtagaggcccttgggcaggttcagccaagagctccagccaccctgtgaggggtccagcctggcctgcaaagaagtggcagtaggttgtcctgagtatggctggctgccagctgtctttagattgaacctgcactgcccagcttgttggcatgtttggaagtacacttgtcctggggtgtcccttggtaagcttcctagtgtcgtttgctgagtgtcatgcgtgtccggcggggcagggtccctcatcccaggtgcaggatgactgctggcaggagcctgagtggctcagcccttgagggcgatgcagaggggtgggtggtggtctgcctatgccatgggcacctcactgcacggcctggcctgccagacttccttgggaactggctcctgggttcccctccctccctgctcagcatgtctagtcctggggaagcttgcactctggctggtcctcctcctcgagccgtttgaatcatttccttgggggtcttccctgatgccctgtgctgctcccagagcctgggtcaggttgtgggttgttgtgtgtgcatcataagttggttctgggctcctgggcatctgggcagagccatctgtgtagccagcagtgtcttgtgcccatcatgggcccttggtagacagggaaagtggcagtgggtagaggctggcttctgggtaaggtgtcgaagaggctgtgggctgggtcggggcggggtgtgaagggggcatgcagggggcttggcatccgctgtggcaggctgcagtagacgagacccccccccagctcccagttcagatagtgacgtgtaggggtatcctgggggtgcatgtggcctggactgggcatgggcacctgggatggtctgggttctcagggagctgttctgaagagtggtcacctgcagggccatctccccttggggctgcctgtgcctggggagttggggtggaggcgtccattgcaggccgtggctctgtctcctgtgccctccaggcttcagtcatggggatgcaggtgggcactcctgcatcaatcatggggatgcatggccacggcccccagtgggctcccttctggcaactgccccactttctagccttctgctgccccccactttcagataggctggctctatgtgttgggttcccttaggaaagactgggccccctgggccttgtgccctgatatctgaccctgggcttctgacttcacggccagggtcagaatcaaggggatcagggttgggcttgagtgcagccctgggatacagctggggcctgctttgccagctctgcttctctgcatttctggaggtgggggtctgtgtgccaagtgatcttgaacacagctcaggagctcctcgtggagatggccttacggtcagggaacaggtgcccattcctatttaggatggtcctggttttaagtgaatatggaggattttcaaagaggtttgaataaaactcaggcgccgtggtactttgtctaagcctggttctccaaccccagactgtccccgtgttgtctgaagcagacccctcaggttggtgagcagggtgctctgtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggccaggggtgtctggtgccgggtgtggtactgatgcacgactgtgggctgggcagcgtgggctctgccgaggcaggctccactgtgccttatggcctgaacagctactgctttttttctatggtgaggaggggtgggctttctgtgttttgaggagagaaaggaagaccactggagtaccttggctttggagcagggaggcagtagccaactgagcagagtctctagcatcggccaaggctgactttggcccctgtggcagagtggcccctgtggagggaaaggccagtctggtgtgctgggggtgggggctcggccctgtagctcttcttttggaaagcctattgtaccctggccttggagaaaactggggtcttggcctcctggacttgaagtccacacttggcagtgttggagttatgggcatctgcagtaactttaaataaggagatattttccagtacgccattgggggttgtcatgtgtaatggattgtctctgcaaataccatcttaagtgtgtggtcccaactgccataacgtgccctgtcaccgtttgtcatgaacacctaccagacgtgcttactgtgaggctggctgcctgctgccatcacttgctctttcgtgccctccacctgggcctgggccctgttctctctgacctccgtgtgctgtgtcctgtctggtgactgcctgctggtttaaacaccagtcctttgtctctctggggcaggggtccccaatccctggcctgccgaccggtacaagtctggcctgttaagaactgggcaacacagcaggaggtgagtggtgggcgagcgagctttaccacctgagcgcctcccctcagataagcagggcattagattcctataggagtgcgaacgctaacgtgaactacgcatgtgaggaatccgtgttgtgcactccttatgagaacctagtgcctgatgatctggggtggacagtttcatcctgaaaccactcccccacccctggtccatggaaaaattgttttccaccaaactgatccttggtgccaaaagggttggggactgctgctctgggggatgtacttccaaagtcaactactctcaggtttgtttatttttacataaatgggaaccactttatggtctctagcatcagccaaggctgactttggtgggtccctgtggcagagtggcccctgcagaggaaaaggccagctcaggagagaaggctgtgccgactcctcatggtttccagtgccctacatgttcagagaaacgtctttggtaatgaactatggaaatggtccctgaaggtatggtctttgctctagaaaaagcccaactgatgactcctcactggcatcttgactgtgttctgtgagctgtggccctcatgctcatggactgcttgcctccagcaggttggcagggggacagtggtgcactttgcacccaagaagaggtgaagcctgtgccctatgccctgtgccgagtgaggtcctcgtgttgggagggtgacgccgtccactgcagatggtgccttgctgtgctgcactcttggtgacacccggggccccaggtcgggtacaggtgtcagttggaggctttgatgtct

SEQ ID NO: 17507 - DNA, 4869 bp, Human
gaaatatgggaggcactgagagagatgggatggttgttaagttcactgatttagctcagcttttgtcctttggggccaaagatataatagtcaacctcatccccgagagattatctgagaaccccccaccataagtaatgacaaaaatagcattatttccttctcctctcccacctcactgtaggtgcctatgtttccttgtatagctgcataaagtaaaaaaaagatctaaatatactcaacaggctgagtgtggtggctcatgcttgtaatcccagctgcttgggaggcaaagacaggaggattgcttgaggctgggagtttgaggctgtagtaagctaagatcacaccactgcactccagcctgggcaacagagtgagaccctgtctttaaaaaacattacagattagccaggtgtggtcgtgtagtcccagctacttgggaggttgaggttggaagatcatttgagtctaggtttatgattgaatttcaaagtgaaatctaaatctatgctaggtacaaggaggatgccaaaggaactcttggcaaagatatactgggaaaatgcaaataagaacagggtaatctgaataataggaacatttgaattcagggccaaagcattaggtaagattatataaaagacttaacaatgataaagagtacaattcccaatgaagagccatataatcccagcactttgggaggccaaggcaggaggactgcctgagcccaggagttcaagaccagcctgggcaacatatagagatactgtctttacaaaaaaaattttttaattagccatgcatgctggcatgcacctgtagtcccagcttactgggaggctgaggtggaaggattgcttaagcccaggagtttgaggctgcagtgagctgtgatcacaccattgtactccagcctgggtgacagagcaagaccttgtgctccccaccccccaaaataactgtaaatatctgtttagccagtaaactgacatatcatccataaagcaagaacaataggaaagtgtctataattgagaaactggtaccagactagtcttcttgctgtaaacaaccataaaaagtggacaaaatacacaaggcaactgtttacaggcagggagcactaggcagagaagggcagctgatgaggtgggcctcccaaatgcccccacagctctctgcctggagacaatgccatgagcatgaagtccaggcagaacatagtggtcacattaagctgaggaggcagagatcataatctgcagtagccagagggctgaaatccatggggcaaggcaaaggaacagagggagctgaagattgtctgagggggtccctatgagtcttgtgtgagggctggactgcgcatgctcacggtggactccacagggcttaccagagctgcacagttaaacagaacaagttcaagaggtcaacagtgccgggggtccagtcagcctgaatgtgaagactgtgtgacagcctgagaccagctgagctaccagaacggcttcacttcaggaataggattctatcttagagtatggcctaccctagatctaccagaacaaaactagaaaccaagccctgaaaaggtctgcaggagaggcagagtttggaagttgaggtccaccccactaaacaagcctgggaatgaactttccacagacctgccctaacaaagccaaaagccaagcctgcacaagctcaaggtgaacagtcagtaactgaactccataccagaatgaaagcaaacactcttcagagcaaaataacagaacccagagattcagcatgtatcatttaccatgtctggcacacaaacagcaaattagtagacatgctaagaagcaggaatatatgacccatagtcaaggggaaaaagcagttaatagaaactgaccccaaaatggcagagatgttgaacatatcagataaagactttaaagaaactccttaactatgttcaaaaaatgaaaggagctctctcccaccacccaagatgccaaaaggaaagaaggccaagggaaagaaggtggctctggcccctgctgtcatgaagaagcaggaggctaagaaagtggtgaatcccctgtttgagaaaaggcctaagaattttggcatcggacaggacatccagcccaaaagagacctcacccactttgtgaaatggccccgctatatcaggttgcagcggcagagagccatcctctataagcggctgaaagtgcctcctgcaattaaccagttcacctaggccctggactgccaaacagctactcagctgcttaagctggcccacaagtacagaccagagacaaagcaagagaagaagcagagactgttggcctgggctgagaagaaagctgctggcaaacgggacgtccccaccaagagaccacctgtccttcgagcaggagttaacatcgtcaccaccttggtggagaacaagaaagctcagctggtggtgattgcagacgacgtggatcccatcgagctggttgtcttcttgcctgccttgtgtcgtaaaatgggggtcccttactgcattatcaaggggaaggcaagactgggacgtctagtccacaggaagacctgcaccactgtcaccttcacataggtgaactcggaagacaaaggcactttggctaagctgatggaagctatcaggaccaattacaatgacagatacgatgagatccgccgtcactggggcggcaacatcctgggtcctaagtctgtggctcgtatcgccaagctcgaaaaggcaaaggctaaagaacttgccactaaactgggttaaatgtacactgttgagttttctgtacattaaaataattaaaataatacaaattttccttcaaaaaaaaaatgaaaggaaagtgtattcaaataattacccaaaaaattgtcttgagtgagcaaataggaactcttagcagagaaatggaaattataaaaaagagtcataatagaaaatatagaactggaaagctcaatactgaaatgaaaaatgtattgaataggcttaacagtagattggaaatatatattttttaaagtcagtgaactggaagacagatcaacagacattgcccaatctgaagagagaaaaaacgactgaaccaaaacaaacagagcctcagggggccatgggatgctatcaaactgtgtaactcatagaagccccagaaggaggagaaagtgaaaatggtcaagaagaaacagtggctggatatttcccaattttaatgggaaacacgaatatatagatgaaaagctcagcagaacccaatcaggacaagaagaaaaatctatctaggcacatgatagtcaaactactgaaaaccacagataaaaaaaaatcttgaaagcagccacggagcaagacatattacatgcatgggaatgataggatatcatgagttctcatcagaaacaatgtaacaacatctttacagggcatgaagaaaaataaaactatcattcctaaattccatagccaggattctgtaaaaatgagggtgataaagacattttttagataaacaaaagctagagaattttttgccagcagaattgcactacaaaaaaatgttaagaggatacttgggtctataggatgagcaccagaaatggcaaaggggtgagtaaatgtaacatgttatgttttttatttcttgtaagtttttttttaaactgatgatttaaaggaaaactggccagatgcagtggctcatgcctttaatcccagcatgtgggattgcttgaacctaggagttcaaggccagcctgggcaacatagtgagaccctatctctacaaaaacttatccaggcatggtgataggtgcctgtagtcccaactacttgggaggctgaggcaggggtttgagggtgcagtgagctgtgattgcaccactgcaccccagcctgggtgacagagcaagaccttgcctcaaagaaaagggaaactaatattgtaaggtgcagttttgaatgtgtgtagacgtcaagtagatcacaacagtcacagaaagactaaaaaggtgagtagaagggattgcaccagcacaaggtcatcatgtttgtgaggcgggatgtaaacaacactgattctaaggagactttgagaaggttgcacactcttggagtgcaaccacttaggaacaaaagtggcaagaggtctagctaagaagccaagagaggaaacaaaaccgaatactaaaaaataaatatttgattaccacaaaagaaggtaggaaaggaggaaaagtggtcaaaaatggaagtgacaagtagaaaataagtatagaggtgttagacttaatcccaggcatgtcaataattacagtgaatgcaaacagactaaatgcaccagttaaaaggcagagattgtcagaaagcatcacaaagcaagacacatctgtctgctaaagatgcttttcattgggaggccgaggcagacggatcacgaggtcaagagatcgagaccatcctggacaacatggtgaaaccctgtctctactaaaaatacaaaaattagccgggtgtggtggcgtgtgcctgtaatcccagctactcgagaggctgaggcaggagaatcacttgaacctgggaggcggaggttgcagtgagccgagatcacgccattgcactccagcctggtgacagagtgagactccgtctcaaaacaataaaataaaataataaaataaaataaaataaaagatgctttttaaatatcaagaggtcaggacaggttgaaagtagaagcaaggaggaaaatgcaaagggcaaacctaagaaagtcgatgctactgtttagtatcagacaaagccaacttcaagacaaagagcattaa

SEQ ID NO: 17508 - DNA, 28374 bp, Human
accctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggctgtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagccgaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgatcgggagggaaaatttaaatgaggacgacaaaggtaaaataacaaattaggaaaagaacgtctgggagagagagaggagaaacgcacgcgggcgggcggcagagcgagggccggccgacgggcccggcgcaccggtgagccggtccgggcggtcggggggccccgggccgagcgagccgcggcgggcgggctgggggccggggagggggaaggggcgggggaggggcgagggccgggggagggatctagtccattgtctccgcgcgggggtgggggggccccgggcggggcggggcggggcgcctcctcggggccggcctgcggtgtggggctgcacggcccggggcgcacgcagcgcggcgcccgccactcggcccgcggcgcggggcagcgctcagcttggtggcgggggcggcggcggcggcccgcgggtcatgatctccgccgtgtccagcccgtggctcacgcagctctcgcatttctgcgacgttgcagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgaggagccccgcgggactcgcccgcccgccccgcagccccaggacgccgcgcggcccagaaaccggcccggcttggggcgcacccggctgggggcaggcagcggcgtccagggggcctcaccgcccggccgactcctagtaaatcccacctcaagaaaactctggttcagttctggagttcagtctatgcgggcaagataaagagcggcagccgggcaactctctggacactttcaggagaggattacccttaaaaacagcgtgcactgttgcgtggaagttgctacccagtttccttcaacctagatccctatagttgtggggcctggctctgtatccagcggcccgtcacctcccaaccggcctgtatttgttttaaagaccaagagacaaggggaacaagttttgcagatgcacccgatttgaccggtagacaaaggcgggtgccgcgctgtgtctaatgtacgcaccagctcggagtccgaacagccaaggggagctcagggcctgtttgcaaagccttctcgtggtttctgtttccctgctgccggcgtcctttctgaggaacctgggcctgtgctctgctccagctctgtggtttttttccaggccctccttgctgtccccaggcacacaggccctcctgaggacagcggcagcccagccgctggctcaggccagcccggcaagggccttgtcggcgctgggcttcacccgggagcccacgtcccgcagcaccctccagcctgcagaggcttcgggtgggggagggagcgggcctgtcctagaggctggctcctggcatctgtcttctgcccaccgcctgcagggagttgcttgtgaggggaggcagaggggacggcaagtgagggccaatccttgtgttgtcctgaagggccccacggccactactgctgtgccatcatgtgggggtagcccatggcctacacccgtccaggcactgcagaatgtcctttcaagagccctgactggtcactgagccagggtccaaagcgggggagatttgaggaacaggaaagacacaaactgagtacactctgggtagctgcgtcttggggttatgtgtcttaaggggagtggaagcttgccctgtgccctgaggaaggtggggagactcttatcatggggccatgatagagaggggccctgagagtcaggggagggagggctctgagccttggcctcactgaggggattgggtaacagccgaagacccagctaaaagggcagcggggacgccttgaactcacacaggactacccggtttcactttgttggagccgggagctgcttcgatcaagctggggaggctctgctaagggcgcacgttaggcaccctgctgccggccgaagctgggaccaagaggccaaaaagtcagcaagggcgaggccgagtttatgtaggccaaggttgccgaaggtgggggctccagcgctgggctggccatttctgtgtccaggaacggcccaggaggctcccctgctgcgccaagctcccagttgagtaggggcctgcccagattagagcagctaagccaggaaagatggagcccaagggctgggacgacacagcagcccccagaggctggagggaggggccgagcagaggggccgccagccccaggcaggtcaaggggggctgccttccaccagctagggtgacccaaggcctcatcacccccaggcggatgtttcccaccttccaagtgaagctcttcggcatggatcccatggccgactatatgctgctcatggacttcgtgccggtggacgataagcgctaccggtgagcgagtggttgtaagcgtgagggaccgggagggcaccctggaaagtggcgggtctccgcctggtgacccaactccaagggtcgtctgcaccatgaaactctttaggcacctgcgatgctgcccgatcaacccgctccctcctccactcccatctgaccccagacccacaaccctactccatgccctctcagaacccgcctctggagccgcaggctgcagacagctcttgctcccctgggctggtgtggccctagggtggtcagccaagtactcagccccggacttcttcaagtctccctctcccaggaggccggcctgagcgcctagtccccttcccccatccccagggaactctggatcctggagctgggccggaaaggtggggtggccaggagagattatgcagggcgggcctcagctgcccggacaattaacagcaattaataaagagaacgcgcactgccctgtgcctgaggcccggcaaggccaagtgtgggctcccaccgcagcggcaccggggcgggaggacccgcatccagcgaaatgagatggcaggagcccagcctccccctctcggtgccccacagggtgtccagttccttgattgttttgagtgttggggtgggtgggagttctctgtttagtccatagtcccccttggaaaagctcccagcacatgcggcagcagagggttcaatctcacaggtggggaaacttctcaaaggcacttttagggttcgcccagcacacgggtcaaggccctctgggttcacctccacatgcacgaccccaccccgtgccgctccaggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacgtgagcgactgcctccccaggctccggtgtcccccaaggcctcgagtcccgaggcacccgcctgtccctaagaggcctgtagaatccccaggcccccggctgtccccaggcggctctgggctgtccccgaggaggccctttagagtccctgcgaggctagaggctgaggcggagcttgggcagtgctggtgtgccgatgaggagagcggcctctggtcaggggtcgcacagcctagtgggcctgggccctgggagaggggtcgccctccttctctcaccccactcctgattttatgcaggaagcttttttaatggaaaagatggggccctgcaagggggctggagaaagaggctttatggagtccaggccagtgaggtcgctgggcaggcacctaaggaaagagaacctaaacccagatcttttgccacttggagctcattcctggcagttgccaatgggtcacagcctcctcttggcccagtgacccagcctcatcttggaattaagggttttgcccaactcatccaggaaactcattgccaactcagacctcagcccatttcctggctcccaccccagatcctcagcccagccccaccgctggagctgattccccaccttgtcttccagattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcgggtgagggcctgtggggaggacctgagcggattcaacgcctctggaaaagcgggtgtaattttcagttgccgtttggggacagtgggtccgcttagacctgcaggctgtggtcccagtggagcccaacccaactggagccccactcccaagggcctcaggcagccccctccctctcgaggctggccggcccagcctcctatcagcttgacctctccagcggcaactgtcacttcgtcctgaaagtttgttttccgaaccattccggaaactccccatcaggggcctgatctgaggtttacccagattactagggaacccgctctgttccccaccccccaccccactgcacgtggggggtggtgaccacattcctgtcccagcgaggagcacagggcctccatccccacccacctgggggacaccagagaggggttccctagtgagagaggaggttcctcagacccccgcccccctgcaggagggagcaccagctccgtagaggaggggcagacgtggactggttcttgtcagggcagcagaaaggcccttggtgcgcttctcctaacactcccctatcctccgccgaggtcgggtggcccaggctgcagggctccagcggcttgctcacacccacctccctgcagatcacgcagctcaagattgccagcaatcccttcgcgaaaggcttccgggactgtgaccctgaggactggtgagtgtcctcccccgagagagtgagcgccgggcgcctggcgcaggcgccgccctgatccgcctcccgcccgcaggccccggaaccaccggcccggcgcactgccgctcatgagcgccttcgcgcgctcgcggaaccccgtggcttccccgacgcagcccagcggcacggagaaaggtagggccggggtcgtgggatccgggttccggccctgtgcgcgctctaccccgggccggcggcctcgcccgacctcgcctgcgcccccggggcgctccaggctttcgcgccggttgcacaacggccgcggcggcgggcaagcgcgcactcgcccgcccggcccgacggctgcgccccgcccgccgccgccgccgcccgcagaggggcgcgggccccggggagggctcggggcgccggcgacttggggtctcgggcacgctggcaccgactggtcggggaacaccgagggcggccaagagccttctctccgccagggcctcgcatggggcgtcggagctcctcggcggccccggccggccgcgctcactcctcggccctctccgcagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaagccgcctgcgtgtccatttatttgtgcccagttagatcgcgttgggaatcttcgggacagcgagcccggggtagctcagggccctcagggcctccccagccccaatccctgccgactgtaggtcggtcccggtcccacagcgccctgtccgccacgccccctgccctctccccgccccataggggctcccactgcccctcccctctccgaggcccctcctgccaggcctgtgcactccccccaccttcccaccgtcccgtctcatcccaacctccccagggctggtggtaccgcccaggtgtgcatcctgcctttttacttaaattcctcccacctgcagttgtccctattctgggacttgggcctgcgccctggcctgttttcgggacagatgcttgtgcttttccatggaagctgggaagaagggtcatgacagacactgccggtcggtgctgggagggggagaagcccctgaccgggatggggtcatggaaagacaaaaacaggcagcactgttctgctagcatttcccctgccggcctagcccaggcccgcatgttccctccttagtgactttatttgctgtgagtgtccctacggagtgacctggccagggggcacaatgacagtagccatgagtcatcttgagacctgtgtatgaagcatttttcccaggccaggtggctaagggacctctccccgttaactcaacaccagggatggggcgagaggaactctttgatccctcccttcctgagcgcaagcaggaagggctgacagccggtcagcgccaaggctgctgacttggacacaagatgaacgggaagtgcacgtggccgaggctctgtcccccacctcccgtgcctgtcccagtgtgtttgtggcaactgctgccttctaggccactcggctcatcaccccacgtggtagcggcagcctgagtgccacctctccgagggcacagccaggagtttccagatgtccaccctcgcggacctgtttttcgtatacatgtttgctctggcggcgtgaagtgagtggggtcttagtaattgaatggcaggaaccattcccagaggccagtctagggtgggagggggtctccaggggccatccaaagcctcaaagggcatctagcaccagagagtgaggacctctgcagcatctgcccaggctccgtgagcacggctttggagatgcatttggggggacggctgtggatgcccattcccaagtcctgatccccacctgcgtgaacttggggcagccattacccatgtgccccacggtgggtggggctttgcactgcagagggcctccctctcttgctgtcagaaggcagccattccgtactccacatccaggatgtgcggaggggctgccattcgagacctccgccttggttttgttcagagctaaagggaggaaaagccctcccctgaacaaagagcaaacacagtgtttgtaaatgagggtgggacacacagcaatgtgcaaggaccctgagtgtgcagcaaactggcctgttaccgtgcccctcctgttgggatggccatgcaagatggagcacccagccgtccagcagggccgccgctggccatccggggctgttcgcattctttttttttttttttttttttttttgagactgagtcgcgctctgtcgcccaggccggaatgccgtggtgcgatctcggctcactgcaacctccgcctcctgggttcaagtgatttcttttgcttcagcctcagagtagctgggactacaggaatgtaccaccatgcccggctaatttttgtatttttagtagagacggggtttcaccatgttggccaggctggtctcgaactcctgacctcaggtgacccgcctgccttggtcttccaaaatgctgggctttcaggcatgagccatcacactcggccacacgtcctaatgaactaggattcattaaacattcaggtcctcactggccccattccaggtgctccgtggctcacaggccgcgggtcaccacactgctgctgttgctgctgagggcactcccacgctgggcagtggcccccagaagtgtgggtttcctcccctccacctttgtagatgagtttgtgcatctgagaacttcttgtaaatgagagctcgcaggccggcgtctgggtggcagcttccgctggctgtgtgtctgcaagactggcgcacgccgctgctcaccgtccctcatgtgctcagtcctcaaccagtgcccagtgattgcctgcccgctgcgggggctgtctggctgatgccccagccactaccgttcctgtggaggtgacgttcccatgggcagctgccctaaggcctggcttccagcagcttcctctgtgacagctgtgatctgaacgttcacccccaaggtgatggtggcaggagatggagcctttaggcggtgattaggtcacgagcgtggagtcctcatgagtgggattagttgagtgctatgctgctcacagacctccagcctccagaactgggagaaataactgtccattgttgataagccaccgggcctatggtcatttgtcctagctgcactactggactgacagtggccgttcttccatctccttcttgttccctgttttaggttccccgttgagcacacctgccctgccccttctgtaagctgctgtgatgggcagtatggtgtaggggatagggggctcgtcccaccgctgttcccccacaggctccccctcagctgttggacttcccccaaacatcctcctccaggttccctagctggtccagaggccccgttgccctcccctagcctggctgcagacgtccagctgccaggactcaggaggacgagagaccagaagggcccccagactcctcactcccaaaaactctccaaaaacaacagatgcacaacgcaggaaatagatagattcttgactaagcgggggtggggaccatccacacccccttcacaccactgcatcccacggaagggttctaggaccccagggcctgggggtgcagctggacgatcctgcagtagccccgctccctgttttcagaagacccccccacggctgccctctgcagcatgtgcccctttgtcgaagggacaatgggcactccattgcccagagaggcttctcacccaggaaagcactggaggtgcagaggcaggagcacgcgggggcttggctgcgggacaaggcgagtctgtttggtggcaccttgagctgcggaggaagacaagaccctggcccggtggagatgagaccctggcctggtgggcttcaggccccaccctgcggcgcaccctccagctggggaagtccatggggtgtgtgggatccatgcgatgacagttgtatgaggctgaggccctgatctccaggtgtgccgcagatcaaagcacccgcataccagagaattccacgtagccacagttgccaagggcagaggcagcctcacctctcactggtggagggagagtgatgggtgaggagctgcttctaggacgaaagggatggctccagtgtgtcaggcagtgcaacccaaccaggagctgggcaccaggggagagcatgtggcccgtgttccagagactctgtgttccagagactcagttttcccttcagctgtggtgctgacctccgccctgtgtggagaagctctctgtcaacagtggaggcctgtgtcagccatgggcacggggacgttcattcctgcttctctcctccctgtgggttccaatgaggcggtgtgctcgggcagggtccacaagcatctgcaccatcctgcctctcctccttgccaagctccttcaccccccgccctgaaggagcatcctgcagagcctggccaaggagcaggtgggggcacggccccccagcctggcatagtggcacccaagcctagggagggcaggatgagacctttttccttggtgctacctcacacattttctggatttcaaaaaacacaactggtgcctttgattcaattccctttcctgcttgttgtactacttcaaaccagatgggctcctcagatgaaactccggagactcagtgtctctctttaaccgctgccaggtctgtgtgtgggaaacagcagaaccagaaatattttgctaaaaccagcccatgtgggggagaggcttagcttttaatagcagtaattaaattatcttcttaattataaagggtgatggcattgtcaacatgctttatctatcagctttcaattgcacaaagtaagcacgtaatcctctcctcccggccccactggcatcctctgctctgtggccagcccaggcccccttcctgcagtgcagacccccagaagctttggggtgcatctccccatttcaccagttctgaggtgcacagggttttttgcctgcatttcaacacctctgaagttggtgttctcttattcaaagtggggggtctcagcctaactgaaggatcttggctgcacatgaaaccatggtgcagtggcagttgccagggtgctgcagttgaggcccatgtcggtgcgcccactgtggcctcgggcaacgctgggtgccagcatgttgctctgggtgactttcttgcaggtggtgactccggcttctgtctccagcccttacagtggccctgtccttccaggaccttactcttcattcacatcatttctcaggacactcctccctgcacatccctagtcttccccatctcctcttcattcctctgtcattctagcttcagttcctctcaacagtttttttgtttgttttttgagatagagtcttgctctgtcgcccaggctggagtgcagtggcacaatctcagttcactgcaacttccgcctcctgggttcaagcgattctcctgcctcagcctcccaagtaaccgggattacagatgtccgccaccacgcccggctaatttttgtctttttagtagacatgggtttcaccatgttggcctttttttctttttgagacagggtcttgctctgttgcccaggctggagtgcagtggtgtgatcatggctcactgtagcctcgaactccggggctcaagccatcctccagactcagcctcctgattagctgggactacaggcgtgtgccaccacaccctgctaatattttgtagagacatatgagtcttgctatgttgcccaggctggtcttgaactcctgcctcttgaactcttggcctcaagtgatcctttggcctcagcctcccaaattgctggcattacaagcgtgagccaccgtgcccagccctcttctcaaatagtttttttttcccctccgtttctgaattcatcctttatctcagaatatgttttccggattactcccccaagacaagctttttttcttgtgacatcatcacagaacgaagatggtgacagcagcagggccacaaaacagtccccagtctacccagttgctcatggctgtggtttggaccttcagccatgaggcagtacgtcttcccagggcagggtagggaccttcaccgcggggctgggtctcaggagctgccgggcgcccttctccagcccgcctttgtgataagggacagaatcggggtcactggcaggacacaggtccccttccctgtcgcctcaggctggtgggattcctgcacccgagtgctgctggggctgcaggcgaggcctgggctacacaggaagcccgggcaccgcagagtggccgctagctggtggcattgttcctccacggattcagagcttacgagcacgggcgttgagctgaggcaaaatacggaaacagccacttccatgcaaataatcacccttctgataacaataagtcaagtctcaagggactaagaaaaacaagcagctttattaagatgcagctgaccgatctgaaagcctgcctgctccgccacctcctgggagagcctgcagggcccgagctctggggacaagagctgctgctcaggccccagaggaaggtctaggtgggaaatgggccgccaggaggtggacaccaacacataggagcacatcccaagacacccatcaccctgtgtggtgggtgctggaaagaaacagcctagttatgagagagacttgcaactgggggcaccctagcaccccacggaggcatttccaggtggcccctccagcttggctgtgtgggcttccttggaggaccctccctccaggcggccagccagaaggggccatctccaggcaggcacccccttcaggagagcccatgcccagtcactgcctgggaagcttactgcagggctggcccccacctgccactgtcacctcctgacctccacctgctctcctgggtcctcaggcctcacacagtcctgtccttctaacaggtgactgcaggatggagccccaggcatctcggcatcctgatgcggtcactgccaggaggggagtggtctcagggtgggccagacccctggacaccagcgtggtctccttcctgagctgccgagggagatttgcctggcaaagcccacctggcccctcggccctcagccgccgagtttccctcctgcagtgggaggtttcccacgactggagggaagcagtggctattccagtagtagctgtttctcatgcacaggtctcttccccagaaagaatttgagctgcaggacagagatcctatcacatatatacccagaaggtgattcaaggtgaatattaaagacttggatatccattaggatgatgatgattttaaaaaacaaaaacagaaaacaacacgtgttggtgaggacatggagcccctggaagccgtctacactgctggtgggactgtaagatagtgcagcttctgtggggaacagtgtcatgggtccttgaaaaattatacagttgttagggagagtgaagcaggaggactgcttgaagccaggagttcaagacccgcctgggcgggcctaggcacctgtagtcccagctactcaggaggctgaggcaggaggatcgcttgagcccaggagttccaggctgcagtgagctacgatcacaccactccacgccagcctgagtgacagagcaatatcttgtctctaaaatcaattaaaattctacatagaaccgtatgttccaggaattccacttctgggaaaatacccaagagaattgaaagcagagtctcaaagagatatttctccacccatgttcatagcagcattactcaaatagcaaaaggtggaggcgagccgagcgtccaccgataagtgaacggatcaacaaaatgtggtgtgtgtgtaccgtggagtattatccagccttaaagaggaagggaattctgttacatgctacaacagggatgaaccctgaggtccttatgctccgtgaattgagccggtcacaaaggacacattttgtactgtacaattccacttgcatgaggcacctcaagtagtcagattcaagaaacagacaggagaatggggattgttagggactgggggagaggaatggggagttggcgtctagtggggacagaggttccattttgcgttcatctggaggtggacgcacagcatcgggaatacacaatgccactgaattgtgtacttcaacatggtcacaatggcacattctttattttttgtagagacagggtgtcactgtgttgcccaggctagcctcgaactcgggttcaggctctccttccacctcggcctcccaaagtgctgggattataggtgtgagccaccacacctggccaaatttgtgggttttttggtttttatgtttttgaaacagagtttctcccttgtcacctaggctggagtacagtggcgcgatcttggctcactgcaacctttacctcctgggttcaagcgattctcctgcctcagcctcccaagtagctgggattacaggcacctgccaacacacccagctaattttttctatttttagtagagacggggtttcaccatgttggccaggctggtctcgaactcctgacctcaggtgatccgcccacctcagcctcccaaagtgctgggattacaggagtgaggcgctgcgcccagccaaaatttgtgtttttaaatgtatgtttaacaatttaaaaatcctagatcatccacagtttgcaaaagccactgctatccatcttggattgaccaattccctacctgcctctaaagcggtggttttttaacaggagcagtcttgccccctggggtgtttgacagtgcctgggacactgggtgggggtgcttctggcatctggtgggtggaggtggggtatgcttttcacctcctgcaatgcacgctcggaaccacaggtccggagccatggggctgctgtggcgaggtcttcccacatggccgcaccctgtctgaaggagctagtggtggggccccgaatattctgaggccaggagctcccaagtcccacctggcatgaagcggtgccccagggccctctccgcactcctccccctgcccaagtgggcccagactccccagtgaggccgcatggcctggagtgctcgcctggagcctgaggggtctggctgctgtgaggtgggcttcgagggtggctgccaggctgtgctggagagggctgggcatcagaaggctggtgacagccttgcagggagacggagggttaccggagccatccctggaggtggcccctccaagtgctcgggccccaggcaagtcccaccggctcccgagtggaaggtgtaagccacgtgggcacaggtgggagggagttctcaccacccatggctgctagtgcccctgaaaccacctggaagtcccagcggcttccccagggacaggcagtgctgtggcccgtgtccaccccagctctggggcctgtgctcgtggctccgtgtctgcccgtggtctccctctctctcaggggtggtttctctgtccctacccaatatggtgctctatagctttccttaggatcctagctcctcaggaggaagacgtgtggccccttgctccaggaaggcccagtcctccctcactgggggtgggagggtaaggcaaaagtgccaaagtgtccatcccatgaatgcaagacacacagtgcctgctctagaagagctcatgttccagcagggacagctaacacccaggggcctgcacggggtggagggctcttcagaggcaggatcacctcggagatgggtgcaggggacctcgggccaccccagggccaggcctgcttgccctgcttaggagctgggtctcccactcagggagggaggggtcatgtctcaagggcagccactgggcctgaaaagcagaaccgcatgtgatcagtctgggtgggcaagacttcaagagagcacgcctaccctcaagggatggaagcagaggctggtagccgacgtccatgccagccaccaactcagagccagcacactacccgcatgtgcctctgccaatgagtggatgaaaagcagcgacctacagatgcaggcaacctggatgagtcttgactttatctcacggagggaaggaagcaggctcgggaggtgccgtgccgcgtggctctgtttataagctgtctgggaaaaggcaaaaccacagtacagaacacagatcagccagtgcaggcaggaagggccagcacacggggtgggaggagcttcctgggtaacgctcaatcccatacgctacagagggcgcatgttattgaacattaaggtttttttaaaaaattttaatttaatataatttaattattattatactgttttagggtacatgtgcacaacatgcaggtttgttacatatgtatacatgtgccatgttggtgtgctgcacctattaactcgtcatttagcattaggtatgtctcctaatgctatccctccccctccccctaccccacaacagtccccggagtgtgatgttccccttcctgtgtccgtgtgttctcattgttcaattcccacctatgagtgagaacatgcggtgtttggttttttgtccttgcgatagtttgctgagaatgatggtttccagtttcatccatgtccctatgaaggacatgagctcttcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatggggtggctgagttctactcttataaagagcgtgctggcctttcccatgccttctcgtctgttttgacccattctgggtatcggtccttttcgtctccccctctccatcctctctcagcccctttcactgggtttcagtgtgctgggcacaggttcagggtgtgttgttactcttaatttttttttttttttttttgagacagggtctccctctgccccccagcctggagtgcagtggtatgatcatggctcacggcagccttgacctcctaggctcaagtgatcctcttacctcaacctcccatgtagctgggaacacaggcacgcaccaccatgcccggctaatttttaagttttttgtggagatgggattttgccatgttgctcaggctggtctcgaactcctgagctcaagtgatcctcttgccttggcctctcaaagtgctgggattacaggcgtgagccaccacacccaaccaggatttattactcttaactagtaaaacagcacattcctgctcatttcaagagacaggatcttgctctgtcacccaggctggagtgcagtggcatcgtgatcaaggctcactgcagcctcaacctcccagtctcaagcaaaccttcctcctcagtctcccgaacagctaggactacaggtgtgtgccaccacacctggcttttttgatgttgttgttgttgttagagatgggggtctcactatgttgcccaggctggtcacaaactcctgagctcaagtgatcctcccgcttttgccctccaaagcactgggattataggtgtgagccactgcacctggccattgctccttatttcttttctttctttcttttcttcttcttttttttttttgagacggagtttcgttctggttgcccaggctggagtgcaatggcgtagtctcagctcactgcaaactccacctcctgggctcaagcaatcctcctgcctcagcctcccaaatagctgggattacaggcatgcgccaccatgcctggctaatttttgtattttcagtagagacggggcttcaccatgttgggcaggctgatctcaaactcctgggctcaaatgatccgcctgcctcagcctcccaaagttctgggattgtaggcatgagccaccgtgtccagcccctttgaaaccccatctctactaaaaatataaaagttagctggacgtggcggcaggtgcctgtaatcccagctacttgggaggctgaggcaggataactgcttgaacttgggaggtggaggttgcagtgagctgagattgcaccactgcactccagcctaggcaacaataagactccgtctcaaacaaataaaataaataaaagtaggtaagggggagatctggttccctgatccgacgtctttccttggggtcactgactgtgggaaaggcctgtgctgggctgaggtgggacctggtgtggctgtggaggccgtgtctgtgtctgtgtcctgtgggcggctcggctcgttgggagatgcagtcctgtcctgcccttccatgcggttcagacactggacatttgtgcagtctgatctgcaagaaaagagaggcacctctgacatggtacttcatccactctcattggatggggttgtcacccaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaattgcatgttttgtaataaatacttctccatagagtcacactcccagttgataaatcaaaacttgttggataaaacaaagtaaatttctcctgacatttaaacattgactgtaaactcattataaacacttctaaatatttaatggaaactacaagcttaacatatctgatccaaaaatgccttaaacacctcagtacagacacccacacactatgaggatgattccctcaaactggttctgaaagcagtagctgtgcttttctctatcgcgttcttattctttctccgacgtgctcttagcaccctcctggggattagcatccgacccacatcactcgggaaaagccctggctggcggctcccaggcggaggcaccacggtgaggccaagtgctgctgtccagtaagcctgactgccccctcaggctctttcccttcacatttacttatttattttttaaatcgacatataaaattgacgtatttattgtgtaaacttcttaccacaaaaatgagaactatgtcaggtgatgtatttgctagttagctagacttaagcaggcctttagttttcagtttttaacattgagggaaaatacacgtaaatcaaatttaccatcgtagccctttgtaagtgtacatttcagtggcatgaagtccatccacatgactgtgcagccatcaccaccagccatctcagaactcttcatctcagaaaactgaaactctgtccccattaaacaagaactcctcattcccctcccctggcagccagcattctactctctgtctctgtgaatctgactactctaggcgcctcatgtaagtggaatcacacagcatttgtctttttgtggctggcttagttcactgagtgtaaggacctcaaggttcatccgtgttctagcctgtgtcggaactccctgcctttataaggctgaacactattctgttgtatgtctgtaccacgttttgttgattcattcttctgtcaatggacacttgggttgctcccacctgttggctgctgtgagtaatgccgctatgaacgtgggtatagaaatatctttgcagccctgctttcagttctcttgggtattctgccacaagaggaactgctggctcatatggtaattctatgtccaggattttgagaaatgaccacactgttttccatagctgctactccatttttacattcccaccaatagcgcacaagggttcagatttctccacacacttgttttctgtttttttttttgttttttttttttgagatggagtctcgctccgtcgcccaggctggagtgcagtggcgcgatctcggctcactgcaagctctgcctcctgggttcatgccattctcctgcctcagcctcccgagtagctaggactacaggtgcccgccaccacgcccagctaattttttgtagttttagtagagacggggttttaccatgttagccaggatggtctcgatctcctgacctcgtgatccacccgcctcagcctcccaaagtgctgggattacaggcgtgagccactgcacccggccctgttttgtttttatttttggtgtacccatcctcatgggtgtaaggcagtatctgtctcattatagttctgacttgcatttccccagaggatagtgatgctgtgcctgctggctactcatacatcttctttggagatatgtctacttaagtcatttgtctatttttttttaatttttaatttttagagacagggtctcactatgttgcccaggctggactccagctcctggattaagtgatcctcttgcctcagcctcttgaataactgggtacataccacggcacccaggatggcccatttttgaatcggcttttttgttgttgttgagttttaggagttctctatatattgtggatattaatcccttatcagatatatggtttgtaaagattttctctcagtctgtgggctgcttttttactctgttgatggtgtcttttgatgcatacaacttttaaattttcatgaagtccagtttgtctatttttttcttttgtgaaatgtgcctttcgtgtcatatccaagaatttattgctaaattcaatgtcatgaagcttttggcctatgttttcttctaagggttttatggttttaggtcttaatttaggtctttgctctattttgagtttatagggtatgaggtgggggatcaaactgcattcttttgcatttgtaaatccagttttcccaacatcatttgttaaaaagacagtcttttcccccattgaatggtcaccacattaaaaatcatttggccagccaggtgcagtggcatgtacctatagtcccagctacttgggaggcagaggtaggagaattgcttgaggccaggagttcaagaccagactgggcaacgcagtgagaccctgtttctaattgagaaaaatatcactggtatatacatgatggttatttctaggctgtctattctattacattggtctttacatctgcctttatgccagtaccacactgttttgattactatagctttatagtaaattttgaaaccaggaagtatgaatcctccaagtttattcattttaagattgttttagctattaaggggtccttgagactccatatgaatttcaaaatggctttttctatttctacaaaaaatgtcattgggatttttgaagggaatgcattgaatctgtagactgctttgggtagtatggatatcttaacaatgttaagttttccaatccatgaacatgggatgtatttccatttatttatgttttaatttctttcagcagtgttttatagatttcagtgtacaagtctttcacctccctagttaagctaattcttaagtattttattatttttaatgctgagtctcttttgataacaaaacctcttgttatgttgaggaactctttagcccatcttttgtatttgctttcagtttgtgacactttagcatctcttcctgagatgagcgattctttgggtttcatggatgggagagcccattgcattatcctttcatttggagatattgcctggtgtgttgggacaaggaaggactaaccttccttgtcagtgtcttatcacacccgcagggctgagtgacagggtggtcctgggcaggctgcctgtggctgtgcaagctgagtgggtgcacactggactcttcccacctactgatggtgtgtgaggctgatgtgcatggattctagctccttccctgtttctggggcctcagctgtctgtgttcactctttcttgctacacaaagagaaacaaggacaagccttatttgataaaggccacaaacactttgaccttcctccacccagtgtagggatctgtttcccctctcctggactccagggctggtcacagaaggctctgggctccaacctggcttgctggacgtgctcttgaagcccccaagtaagaagtctgagtccctgagaccaccacactgcaaggacacttgaaggtactcaggttggtggtccccgctgtgcccagcccctgaatgaagccaaggctccaagcacctgagtgaagaggctgtgatggaagcgaatcctccagccctggccatcaccccgtggagtagacaaactgctcagcccagcctctcctaaattcccgacccacggagcccacgtgcccagaatggctgttatgctgctctgtttgaggtggtttattaatgtagcaagagataatggcaccaggatgaggccaaatgactcgatttctctacaccccacattttacaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaacaaaacagcttatgagcacctcctactaatttcctcagcttagcacaccctgtggccgttgtccccatcgtccgtggcttcatccctcaactgatgctttcctatgtggacttcccggccagtgctgtgggacctcccctgtagggctggccagcctcatgggctgggctacccgtcccactcagcagtggctgcctggcctcccctctgtccctcctgcccagctcctaatgggcctcccataaaagctgatgcgtgggagccaagccacagctcgctgacctggggaagctgacagagtgacagagggtctcaaggactctccacccacaaggcgggaatggggatgctggcaaatctggtatgaaggttgagaccccgaggagaggcaggcctgggggaccgtgcagcagctgtgcccacctaggaccacagggctggtggggctggcagcttggtagagggcaggtgcacagcaaagttttcaccggtgccggcttgttgtcttccacgctgggatttcacatgaagttctagctaattgagtataagcatttctaaagaacccccggagggttgtttttctttgtgcaaacactccttttgtgcagagggtgttctgtggcttcttggcagagacacaggtgggaaacacctgattgaacatcattgcctggggagtggagacacgcacagcacgtcaacatggagcgcccagcagcggcggcgggtcctgggctgtgctccggagcccttcccgggatcatctcccggcatcggctgacccctcggtgtctacgtgccaagcccaatctgcctgcagggacacccactgccagaggcggaggcaggttctcctggtcccagacccagggccgtctgttggcctgcaggtaacacgcagggaggaaggaaaaggctctaggcacagctgcttgtctaagagggaccctgttggcggcgcaacgctgggtgagtgctgcccgcccgcggatggggtgctggccgaacctaccttgtaaagtggggctgcacagaggtcagcacatggtggcgcccaccgtcgagaggggaggccccttggcactggaggcagggcctcaccaggcagacgtgccaggacccgcgtccctgcacacagctgcccaccggccagtggagtgggacctgctgcccctctgacagctcctggtaatcagaggggcccactccacctgcaccggaggcagcggctggggatgctggagcatacggctccagccactcaggatcccactctgggccgtgaaagttactccacagaacaccccaaggccacccctgctggctgtgaagacaccaccaggcggacagtgcccagggctggggctcacagccacgagaatctggatttgaacagaaaaagcccccagccgcgctgccaccctgacgcagccttgtggggccctgagcagaggaccagctacgttgtgcccgtgcctcgacacatggaaattcttccaataagaacaggatggtgggccgggcgcagtggctcaggcctataattctagtgctttgggaggctagaggcgggaggatcgatcgcttgagcccaggagttcgaaaccagcctgggcaacatagcgagactccttctctataaaaaaaaataaaaaattagctgggcatgatggcctgcacctatgtgggtggtcctgagcttctcgggaggctgaggcaggagaatcgcttgaacctgggaatcagaggttgcagtgagccgagactgctccattgcactccagcctgggggacagagtgagactctgactcaaaaaaaaaaacaccccaaaaacacaggatggtagaacacacctacctgagttggcactgaaaatggcaagaaatgtccgccgttgtttccaaacaccaagttctctctggcttgagaggcctcactgctacccaagagcattatggaggaagatgtggaagggctgcctctcccagttggtgggt

SEQ ID NO: 17509 - DNA, 5348 bp, Human
cggctcttcgtccatgggcaatgtgagccatggagggtcttaggtagggtgaggcccaggagaggggcctggtggggtgggtggcctagctgggcaagggcaggtccctgatgacctgaggaggccgcagcagtcatcccaggaagatggtggcatggaagggctgggagtagggggatctggggaagttccctgggcttgggttagggggtagtaagagtgagagggtgggtgggtcagctgtacccctggagtacacagaggaggagatgtccaggagggtctgtagaggaaggggcatggcccatgggtctgcagcaggaggaaggcagtgactaaagtgatagctgggagaaggcagtggtcctcagagccatacctggtggggagaggccacgtggggctgagcaaagagggtatgatttccttccagcctcagggctgggcacacttgccttcagaacctccccacactaggtgagccagacgctggccttatctcatttaccatctcagagccatctgaagggggagaagggaaccgggccccaggagggagaaagtcatcaaacctcccacatctgtgaccagcctcagtgccatactttttctatggagggccctgtccaatggaactgagcacagaccagataaaagaactgggcacccagtggcctcagtccagggcctggagttcaaactttactggaaacaaaggggccgagagagactggggaaagaactactagaaaggggctggtgcccccatggggctgtgggttttggagccgcgtgcccccacctgagcctcagggggcccggagtgtccacaccagtggacctttcgagaaatggctgggccattgtgcagaagaatgcccggaaatcccgcgcctccctcctccagcaaggatgggggctcttcctcctggccaggaaactccaagttggcttccggagggtggcctgggggctggggtgccagggacaccatcgccactggtgggagggcagggcacagcccctccgtgtccctttgtctctcctgtctgaaggccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagaggtctgggaagcccctgcggcttgggagagtgggggtcgccaggcagggggaaagcccctgtgccaccgctttttgccagagactcaggctccagagaggcagtgagtggcatggggggtgaggctggggccctgggcctgacctccacacgcctgcctggcctctctgtttgccatgggatgagagagacagtgctgggactcagagcggggctggagagtgagagtgcgagaaagggcctgggtggggcttggaccccggggcgggctttctggagagcccccctacgagggcctctacggcggtgacggggtggggggcttctgcaaaccttggtcagggaagtggagctggctcgagtggaagagaccacccggctcagtcggggatgtgggagtggactgggtggtgcagactgggggtcgagcgccttctgaagtgacggggccgggacgcgcagggaggcggcccaagaagcgcgccctaggccagcccagaatgcgctcggccgcgactaggacaacggcgggtggggctgggggcggctgccgggcggggagcggtcccgcgccctcagctacccctcaagagccgttgtttccctaacttcagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctctcccacctgtgtcctgttctctgtccagccatcttccgtgtccagcagccccattcatcacccaccagccccgccctcccaaggactcctgtggagacctcctcccagggctggaggctggggctcttttccccatcctccctgccaccttcccaccaggtgggagacacagccaccacttactacagcccagaaaggcgggatctgcggtcagaagagctgctgcgtcatggggccctggggcccgggatgggacaggggcgggggcagcggcagaccccagcagaagatgcggggtgaagcgccctcaacacaggctggtgagtgggggtcctgcggtgtgggaagtgctgggggtgagcagccaggccgctggcttctcccagaaagggccaagccccacacagcacagggtgaggttttccactgccctctcagggcttgcctagtcccaagccccatcaagtggccacagaggtctgtagaatccccgaccaggccctttccaatggtgggtggggcaggaacaggggtgaatgcaggacacgccggtcaacagtagggttgccatgggaggaggtgctggcagctggttgcctggagtaccacagcttggctctagcccctcgtcctggctcctctgccagtcccagcgcagctccctacagagcctgtacccaccctgctggcctggcagcctgcccagaatggtgctcacaaccagcacctgtgccagcccctgctgggggcactctgggtaaccttcctcctccaggggctgtgtggcctgggagtcagtgctggcccctgccaggcacctcggaatgggggtgtctagagccatctaacatagccactgagagctcactgtttttagccttgttctaggcactttgaattaacacatttttgacatttgacataaagctagaagcagaagagagcagctgatgaagggggcatgctgcagggaagagctctaagcccagccggaagggagacttggtatctgccccaaactggacttgggggccctgcccagaaatgtctgggccacatccagtggcagggagtctcctaggtctggccaggctaccatcatggagcagtgggagaaccccaagaatgcaggctcagagtggcttagggcagctgctggaatgtgtggcagcttcctgggagctgctgtggaaccagccggtgggatgagttacagggagaggggccccacggtgcagaggtcctcagcaggcctgacctgtaccccacctgggcctgtacaacagggaccaagaatagtccccaagcttgggagtgtgtgatcccagagctgtggccctgggcagagccaaaaacaatggtccttacactcttgcacctggccaccgggactgggtagtaccaggtctggtgtgtttggtcagaagctgaggcccaaggctgcctgggagggcattcctaagaaagccttttcctaagaaaggacaggcacggggctgggcacggtggctcacgcctgtaatcccagcactttggaaggccgacgtgggcggatcacagggtcaggacatcaagaccattctggccaacgtggtgacacccgtctgtactaaaaatacaaaaattagctgggcgtggtggtgtgtgcctgtaatcccagctactcgggaggctgagacaggagaaccacttgaactcgggaggcagaggttgcagtgtgccgagatcgcaccaactgcactctagtctggtgacagagcgagactctgtctcaaaaaaaggaaagaaagggcatggaaaggaagctgcacagcctttgaattttcccaaatggccagggtaggcagctcaagggtcccgggaagctgtgcaaaccaccagaggtgaggggaggggcccagcctccagtccagctctcacccttttgtgcccactgccctttgccaagggctgcaccaagaccagccccacctacctgtgtgctcttttccaggccact

SEQ ID NO: 17510 - DNA, 7553 bp, Human
catcagggtgaccctttgcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatcccctgcgccgctcctcctcaggcggctcccgggcaacgccggaagtcacggcgcgcacctgccaaatcgccccggcgggaaaccgctccccacgcggactgggccgccccggctcctccgctggcaggggcttcgggtcgggcccgggcgcgggcgccccagaaagggcggttcgcctggacggcggacagcgagcggggcctgcagttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcccagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagtagttagaagtgccccgggtttgggagcattgcaattttttattttcctgtgaagtgggagagaatcagatatttatttatttatttgagacagagtctcgctctgtcgcccaggctggagtgcagtggcgcgatttcggctcactgcaacctctgcctcccgggttcaagcagttctgccccggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgaggtaaaactcaatcgagggcctgacctctgggggtaaaggtgtcagtctatgtgtagagaacaaagcaagaatgctggatgtgtggtttgcaaaattaacagcctacaaagtttctcagttaaatttaggccgatgcttttctgtttttccaacattttccaaaccatagattgttgtttgtaatttttaaaatttgagcagtttctcaagaagtaagtattctccttgaagggattcttgtgtgttttaaaggacacagcttaagtttctgtttctccatgacccttcctcttccctgcccattcggaggccctggagagtgtggggaagatgcaagtattaaaggtatttccatctagcactctcgactctttgtagatacttgattcagtcaatcttgatagtaaaggatttgatttttcttttttttttgagatggagtctcactgtgtcacccaggctggagtgcagtggtgtgacctcggatcactgcaaccttcgcctcctgggttaaactaattctcctgcctcagcctcccaagtagctgggattacaggcgcccactaccacgcccggctaatttttgtgtttttagtagagacggggtttcaccatgttggatgttggtcaggctggtctcgaactcctgatctcaggtgatccacccacctcagcacccaaagtgctgggattacaggcctgagccaccgcacccagtccacaaatcaattttaatagtaataagcttctaatctaacagtttggtattttcacttttgagtgtaatcccaaggcacacctgaatcccagcaataaagaggaacacttcccgattttataccctgatgcctcttgttgcttttgtacttttttttttttttttttttttttgagacagagtctcgctctgttacccaagctggagtgcagtggcgcgatcttgtcctactgcaacctccgcctcccaggctcaagtgattctcctgcctcagcttcccgagaagctgggattacaggtgcgcaccaccacacccagctaatttttgtatttttagtagagacagggtttcgccatgttgaccaggctggtctcgaactcctgaccttgggcaatctgcccgcctttgcctcccaaagtgctgggattacaggcctgagccactgcacccggctgcttttgtactatttcttgtaattgatggcacctacacagttctcacaagtactgtggggtggagtacctcctcaccacgctgagctcatgagttagtcatgcacagctccttcccccagtggagaggtcagtatggggtacttaccatcttgtctctcagtaggttcatgagaccaaagaggaaaatgtttaatatttgctttatctattagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaaggtaaggatccttctctagggatgaagtcctcaggacaaaggagtaatatcaacttcaggtagttgtgtctgtagttcacacctgtgatagtcattggtcagtaggcttgagctgacttggccctaatgagtccttgctccttttggaagcaggagaaagcatccttgggtggtactcttgaatggctctgggtgggaaagaacctaagacatctaataatccagatgcttaagcactgctctggagttcatgttgttgctgtcatgcatgaggagtcttggctgtttctgatcccttgggcctggagtctgaagccctcgcctcatcctaacagtagaaaacccttggcctcctgttttatcatgcagatatctttggttggtatttgttgggattctactgtgtgcagggttaacagctcctgctgccgttttgtaagcagtgtgcaccatctataaaggggcaggtgttaaaagtcttctctcacccaagggagtatttgcttgggcagaggaagtgctaccagtctcctcagatcatctgttcttttgacagagagcaaatgaccttggttccaagcatcagttgcagctgcagccacattcaacattccatttcttaatttgtcccaaacttgttttatctcctaagtcctgtctgtgtctggcaatgggaatacttgtgtcagttgcagtcacagacttacatgccagtgagattggtaacccttagcttctttgcagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaatgctcctttgtcttgtgttagaattttttttaaaaaatttttttttgagacagagtctcactctgttgcccaggctggagtgcagtgacgcaatctcggctcactgcaaactctgtctctctggttcaagcgattctcctgtgtcagcctcctgagtatctgggattacaagtgtgcaccaccacgcgtggctaatttttgtatttttaggagacagagttttgccatgttggccaggctggtctcgaactcctgacctcaagtgatccgcctaccttggcctcccaaagcactgggattataggcatcagccaccacgcccagccagaattaaaattaattcaccaggccaggctcagtggctcatgcctgtaatcccagcactttgggaggccaaggcaggtggatcacgaaatgaggtcaggagatcgagaccatcctagctaacagtgaaaccccatctctactaaaaatacaaaaaaaattagctgggcatggtggcgggcgcctgtagtcccagctactcaagaggctgaggcaggagaatggtgtgaacctgggaggtggagcttgcagtgagccgagatcacaccactgcactccggcctgggtgaaagagcgagactacatctcaaagaaaaataaaaagtttattcacctaagatggatggaggtgacagatgctgcccttcgccaggtaatgggaagaagataacaaagacatcaactgctgccctcaaatggggaaaaaaaaatgtgtaaaaagaagatcccaagggtatagtgaaaataccaacaggagtcagagtaacagaggagtggtgggaaaggaagttgccagctggaaaggcatgtggagaagcagggccttcctgatgggaaagaccaaggagccacctttgtgttttcagctggggttagggggaggcagaagagtgtggagcaggccaggaacatactagttaataaagatgctgtggcccccaagagggtgtgaggcctggctggggcagcggactctgtctcaagtgcttagtctagaatgtgaatgtattagtctgctcaggctgccattacaaattaccatagactgggtggcttaaacaaaataaatttattttctcacaattctgggggctagaactcctgagatcaaggtaccagcaggcttgttttctgagtctttctccttagcttgcagatggctgccttttccctcacatggtcgtcccaatctgtttcctaattttttatagacaccagttatactggaatagggcccacctaatgacctcattataactttaattatctctttaacgatgctacctccaaatacctccaaatacagtcacattctgaggtatggggttggggggagtgggagggtcgtatgggtaggacttcaccataggaactgtaggggacacaattcagcctgtcacagtacaagcccagtgtacgaatagagccattttccccagtggcttggatcacaacctcagaaaggatttttttttttttttttttttaccaccttagtgcaggtaaaccagggaaacatttcattggaataagaacttaggttgtcttcctagcgtgtggttcacttttttcccttttttaaaaattgtggtggccaggcaccgtggctcacgcctgtaatcccagcactttgggaggcctaggtgggcagatcatctgaggtcagaagttcgagaccagcctgaccaacatggtgaaaccccgtctctactaaaaatacaaaattagctaggtgtagtggcacatgcctgtaatcccagctactcgggaggctgaggaaggagaatcgcttgaatacgggaagtggaggtagtgagtcgagatcacgccactgcactccagcctgggcaagaaaagcgaaactccccatcaaaaaaaaaaaaattgtggtaaaatacacataaactttactatcttcatcatttctaactgtatggctcagtggtattgaggacatt

SEQ ID NO: 17511 - DNA, 44676 bp, Human
gcataactgttcagctaaatcttggccagaaccataacacaggaaatagcgtttctgggtgaacaaggccagaacagggtaggggcttgcttcccttgagtgcttctcactagccaacctatgtaagccatttcttctctttgaatataaaaggtaaatccgcacaaaggggcaacatacttaacaacctgcctgcagtttacccatgaacccgaccttctgccccttctttgctgctcccgatcccatctctcactttccttttcaatcccgagacctagcacactgcctggaacatatcaggtattcttgagtggatgaactcaagaatagaaataagccagggtttgacagtgacacacttgggataaaatctaacaatcattccttgtctttactaaaataaacaggtgacaggaagacaataccgtagagtgctttgcagccagacagacttggcttcaactctccagtccctacttctgtgactcgaataaagtacctctgtaaacgttagttttctcatgtttaaaatcatcatcatccttgcttccaaagggattgtagggattaaaagaaataagccgcgatgagggagtacaggtgttaaaagctgtgtaacaggaaatgtaccagcaggtattagcttccatcgttatcattaccgaacacaacaccgctgtacagattcgaaggcacgaacccgtaggcacggagctcacggagctggggcaagagctgggtgtcccccaagagcggggatgcccactacggattctccctggggagcgcctgattctgttcccatccccagcaaccttgcaactaactttgggtttatggaaacctgttgcgcgtccagcacttgggaaacccgtgaatggacacaaaccttcctttctttcgtcaaggagggcaagtccggctgaaacagaatgcgagccacgttcaggaccggcggacgcgaccacaggcggttagtggtcaagggtcctgcttgtgcccggtgcggccgatgagcctgcaggccggactcaggcccgggtgactcggcacctccgccgccgtcccgccccgccctgccccgccgggccctacctcaggccccgggccaaggcccagcccccgcccgctgcccgtcagcgcttaccatgatggacaccacctggcagactccgctcctctcaggcaatgcaacgaagaaaccccgccgaccgctctcccagccgccgctgccgctgccgccgcgccaagccggtacgccccagaggctcaccggaagtgccggacccgagacccggagggggggtgcccgggacaaagcgtcggctgcaaaagagaaaaggccaggcgaagacgctaggctctaaaacaccctcagtagaagcattaaaatgccctttcgtgatttatttccccttttataggtacttttaaacgttattttaaattacgtgttgacagtattcccctccagacgaatttagtagggcccattgtccttacgactacactacccacaatgcactacccagactgcctctgcttcagccatcgaggactcgggcggaactaagctacaaatccttcttcaaaccacaccaaaaacctattgcaaacgtaaatgctgccccattgggtatgtgactgagtttaatgtatggttagaagtatactttccctgagggttcccagtgggaggcagtaggcttctcttcccaaagtaaagatgtccgcccagcgtcgcttttctgggtaaaagcgagtcagagttgaagggggcaacagtgtttgcgttcggcctcagaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgcgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccgaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattctccatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgtttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcggggatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaccctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttctttttcttttttatttttatttttatttttttgagatggagttttgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcggatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaagggagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcagagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctactgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtccccattgtggctctggtctcgaggccagtgcttgagtgtgctctgagccttctgtgggtcttgggccccaggagccctcagtgcctggcaggaaatcagcatggggattggccccaaggacaagatctccttactctgtcctccaggccctccgggtggcagtggacagaggtcaggacccctcggcatccccgcctcctcatagcacctgcaccggccactgcctggtggtgccagccagcacctggctctgtccacctaccacttcctctggtccacctggcctcagccacatagcaagtccaccctctcagccatccctccacctgtgggtctcaccatccagcactcttttccaggtctttgaaggcaggagtgatttgggtaggttttaagtcagtggggaaaagctcagaaagagtggcctggaaaagagcacacaggtaggtggggctggtcttggtgcagcccttggcaaagggcagtgggcacaaaagggtgagagctggactggaggctgggcccctcccctcacctctggtggtttgcacagcttcccgggacccttgagctgcctaccctggccatttgggaaaattcaaaggctgtgcagcttcctttccatgccctttctttcctttttttgagacagagtctcgctctgtcaccagactagagtgcagttggtgcgatctcggcacactgcaacctctgcctcccgagttcaagtggttctcctgtctcagcctcccgagtagctgggattacaggcacacaccaccacgcccagctaatttttgtatttttagtacagacgggtgtcaccacgttggccagaatggtcttgatgtcctgaccctgtgatccgcccacgtcggccttccaaagtgctgggattacaggcgtgagccaccgtgcccagccccgtgcctgtcctttcttaggaaaaggctttcttaggaatgccctcccaggcagccttgggcctcagcttctgaccaaacacaccagacctggtactacccagtcccggtggccaggtgcaagagtgtaaggaccattgtttttggctctgcccagggccacagctctgggatcacacactcccaagcttggggactattcttggtccctgttgtacaggcccaggtggggtacaggtcaggcctgctgaggacctctgcaccgtggggcccctctccctgtaactcatcccaccggctggttccacagcagctcccaggaagctgccacacattccagcagctgccctaagccactctgagcctgcattcttggggttctcccactgctccatgatggtagcctggccagacctaggagactccctgccactggatgtggcccagacatttctgggcagggcccccaagtccagtttggggcagataccaagtctcccttccggctgggcttagagctcttccctgcagcatgcccccttcatcagctgctctcttctgcttctagctttatgtcaaatgtcaaaaatgtgttaattcaaagtgcctagaacaaggctaaaaacagtgagctctcagtggctatgttagatggctctagacacccccattccgaggtgcctggcaggggccagcactgactcccaggccacacagcccctggaggaggaaggttacccagagtgcccccagcaggggctggcacaggtgctggttgtgagcaccattctgggcaggctgccaggccagcagggtgggtacaggctctgtagggagctgcgctgggactggcagaggagccaggacgaggggctagagccaagctgtggtactccaggcaaccagctgccagcacctcctcccatggcaaccctactgttgaccggcgtgtcctgcattcacccctgttcctgccccacccaccattggaaagggcctggtcggggattctacagacctctgtggccacttgatggggcttgggactaggcaagccctgagagggcagtggaaaa

SEQ ID NO: 17512 - DNA, 74940 bp, Human
cgccctataccacccgaccgacccaaaaagacaccacagcgtcccatccgaaccctggtctgcgtgctgcgccctccgaacatcaccatggcgccccgacactagcagggcactacccctccctactaactcatgcggggcctcagaccgatggtcctggatccagaagtcacgtgctctcgagctgggcgcacgggcctgcgaaggccgcatggtagcacaaggactctgggtcacggcgctgcaggggaggcggctctgaggaggcgctgtaggaggaggcgctaagcaccgcagagaaggcacactaggatgggcgggcaggcctgagactggctgctacagggctgcagagtatctgcacaccccccccccccgccgccagaatcccccctcccaaacccctcccaccagccaccaaagccagattcatttcatgcagcaagagcaatccacagatccaattcccccgccatactcagcaaacccacagtttccacaaactgttgctggacgctgattcgcgccaccacaactacaccgccacttcaatcaagcacaagtaggcaggcagcctgctctgccatcaccaaaagattcccatttccactccaatcagtgcccctccactccactgctatagcgggaatggtgtgggcagaatgttaaacactaatttttgcccggggctccattttgtctaccagcaccatcatgcgagaaccgtcctgcagaaaaatagagtgggagccattccaaaaggtgaaagggtggggtcctgctccaagaaaacagaggaattgtactccgcagctcatgtcccactacggctgctttatttgtagcgcaaacggtctgcagctcctgtacctctgcagctcttaccactttgtagtgcatcttaggtgtgaattgttccgcagctcatgtacctctgcagttcatgtgcctcgcagcgcaatgaagcgctgttgtcgggctggctaatcgcatcgtttttgtagcgttttttgtagtgctactcttctgcagctcagattttgcagcgcatgtaaagcgcaattcagttttctgtctgcagctcctatatcgctgctcctcgttctggattgtagcgccactgaagcgcccatccgtcagtttgtggcacataaagcgcccatcagtttatagcgcaatgaagcgccagttgtagctcccatcagtttgtcgcccgcgtgaagcgtgcttgtagcgcatctgaagcgccagtttgtagcgcatttgaagcgcttatctgtttgtaaagcatggcacttggtagcgcatttgaagagcaaattgcaaatcgatctatagctcctgaccgtctgcagctcatcactgtccgcagctcatctctgtctacagcccgtatctggacttggtcctggaaacccaagcctttaaggcttggtttccccatttgttttggggtacagccagtgaaggcgtgacaagttttgcgtggagacattctggggtgctactccatctcccgcagctcccgataagcacggggaatgaacgtgatctttaaaaaaaaaacgtcctcaccgcatactcaccacgcgaggactcctctgcgaagacaggaaggatggggtcccacacctgagccaggcgcggtctccactgggtgctccgcagcccggagtggctccggacgacagcccgctcagcggacctttcgccaggctcggtggaccttctccgctgttctcctcagggcgcagtcaggtttcttcgacacacaccaaccgaagttgaagcgcgtgtaccaggagcgcagactgtgagccttatataggttgcaccgaggaggggggcgccaaatcccagcgtgctccgcgggctagggggtggaggggggtgcggggatggggaatggggttgggggcggtggccacgctgcagtggcccgccgctagagggagtacgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacaggttagtggcctgcgcgcgacgtggaggtcccggggccaacaggccgccgcctccccctcccccgctcgggttccgggcgcctgagcgcgccctttgggcaccagcctctctttctgtcccggaccccaccgtacccctccttcagtacaccctgtaccccatttccccggcccagcttctctctccccaggcttgacccctggcctttttttcctctccgcgcccccgcgggcccctccctgctctgcgggcgcagaaattccatctccaattcctgttcccaacatccccctccccgcccagccccagggtagtcctctcccgatccctgtagcaaagagctgggggtcgttgcctgtttttctggggggcccgtttccccgcgattgggctctgcgaccgcgatgcgagccaaaggaaatgggtgtcaagctgcgtccccgctacacaaacacatcttttttccttttcttgatagtggtagagaacacaaaaatgtgacatttaaaacaccgaatttccccctcttgctaagtgcatttctcggtgacggaaatctcggttttcttcggttttacggagcagggaagcggaatcatgaaatgctgggagctaaacagggcgttcaggtcagggttaaccccggctggaggccagagatgctgccgtaccgagtgcgctatttccagaaaccaaaaccaatttaaaacagctgtggatgcttccagtgtgtttggcgggctttgaaggctcccagctaccgacttttggtggcgattacgaggtttacacagagaccttgcttcccttgcaacgttacattttcctaaatcttgtagggtgaatgaatgcgtttagtcacggcaaccgcacgtttaatcctttccagcgggttgccgagattcggccacaaatatttgcgtgcatttgtactatgaacatatatattttatgtcagggaaaattgcagtggctgataagacgctaaaattctgatgaggaaggatgctaaataaaaccttaacgcggattcccatctaagcgcctcagtgtcaggtgcttgggaaactgacaatctgttgatgatcttagtaaaacaagtttaagttaaaagggaaaaccaaattgtctacagctgagttaggtttctgaaacacagatgaaacgctttcatatttgaagagcaaaattgagcacattttagtaacattgctacggattattttatacttggaatatcaataagaatttgacttattgtcataacaacgttgcagacaccgcactttaaaagagagcctttctaggaataaacaaaactgtagcccatttactgagattttactttttattagaaaatgcccactatccggaatatgaatgaatgaaatgcagctttttaacaaagacatttccctaggaagttgggtaaacacaattatactttttagaagtgccttttaatttaatctttaggatgttcaccctcttctgcaagatagaataattccaggatttcttatgcttggtagagtactgttctggtgaccgctgtcaaattcttaccagttttgtttgtttgtttaaattcgaaagttacttcacctagttaactgagacattatttttctaaaaattgagatttaaaaccagtatagatgaaaagcaggaaaaattaaagttcaaaaatccatcttaagactttaaaagtttgaacaagtttgaaccaatttgattttttcatttcaaaatgctaaccaggactttttttaaaaaacgtaattagtattttaccataataaaagtaatttcaggtcattgtacaaaattcaggagagaaaaccctagaaaactctaaagaaaaggtcacctgtaacctattcaccctgcaataacaccagtaaacattatagagtctgctttttcagacgttctctatgcatatataggtagctatacaataaatatttttcataggattgcagttaaatactttctaaaagttaaaaacaagatcaaattaattctcctcgattattttctttccaaagagcctttaaatgttaaataacattaagtttggagagctttctttaaaggaaataatattaattttttaattaaaattttaaatgaacaaccttagtacataaatatttaaaaccagaaaactgagaagaattttctcccatctcaccattctaacatattgtagttttttattcctctacatatgaaaatattttcactttgcttagaaatagaattttctaagggaaaaaacagcatcaatatataagtaatttagataaaacctttttgttatccaaaaaacaaaacaatactaaaaataaaacagaaagataacattaatagagcaatactttaggtaacatttttgtgttgtctagaacaacaaacattttcaaaaccaaaaccaaaaccaaattaatagataagaactttaaacatattttggatatttaatatctatgtgaattttggattttctcagatatttatttctggtgttgactatttctgcccattttgcacagggttgcatatacagcaaagaggagttaatgtgtattatttattttatcaaataataactgggcttcgtatttagacattttatctatttttatgagaatttgctgtagatctacgaagctgttgatttaacacctatatttaacttctagtatgttaagaaaattgtatttcaaaacaaagtgggattttcacttgttagataataactagactttctctttggacattttacccatttaatgaaaatttgccatgtatttataaagctgttgaatttaccttatgtatttagcttaagttctagggttttagaaaacgatttcaaaacaaactggaattttcacttgtaaaatagtaattgtactttctatttggacattttatccctttttaatgacaatttgctatagatctatgcatctgctgacttaccacatatatttggcttaatttctaatatagagaaaatatatttctaagcaaagtaaaattttcagttgtcaaataataactggactttctatttggacaccttattcatttttaatgacaattgctatggatttacgaacctgctgacttaccacctgtatttggcttaagttctggtatggtacggaaaatttatttctaagcaaagtacaatttccagttgtcaaagagtaagtggactttgtattgaacattttatccatttttacaacagtttgccataaatctaaaagctgttgatttgcttcatgtattttacttatcctatagtatggtggataaattgcatttctaagcaaagtggcattttcacttgtctcacagacattgaaaataagggacaacaccagaaaaaactggttagcgacaacctcaaggaaataaagataacatgtatccagtttctaacactagttttccactggtgaaaatcatgcagtacacaaaatattgaagtagtgaagaaatcctgacttgttaaaaaaattcccaggtcaaatattcagattgtttctgattctaataagtgcagtatttatagatcacattttctccaaaatacccagccaccttcttcctttttcttttttgctaattatccataatctacccaaatcctttccttaaaacttacccttccatattctgtaaacacctaaatgcatattctaacacttatttcctacctccagtgtaaaaaaatgactctaggggaattgatgatatgggtctgtgttcgttagaaattcttgggctggaggggagatcgcttagtccatagcttcacagaaatatcaatatgatggctgttttctttctatccctctcaacctccccagcagagacagacagacagacagatgtgaggagcatacatagactaacgcacactccattcaggcttttactaaacttcggaatccagttctccagtctgttatctccctgatttccagaaatattaagcctaaagtagcagtacgagaaacaaaaaaaaaaaatataagaagaaaaagccaatgtttctaggtatcaataagtcttttcaagtgaatatgtttctgattcaagttttcaggttgataggatcagatagagtctcaatgctcttaaatgctatttcacatggattgcttccaagccaaattctctcttcataattcccagtgttttaaattctgtaaccgtattaaagacagtattaagtaaaaaacaaatctccagtttccacagactgactctggaacaaccatttccattgatgttgtatcccttctagtctttgttctgtgtacataaatatttgtatataattataattttaatatgtatagatttcttacactttgttttgaaagataagttaatcctgctttctgcaaagcatttgtcaaggatgcaggatgctcttgtgtatgaggtggtgtgcagattaattagcagtattgctgtgtgagcgggaggcagactgaaccagcaccggcgaggtgtatacgttcttgggtttgcgtcagggtatcgtccctggttaaggatcataagcctttgccctgagttttgtcttcctcagcatttgtacgaatgactttgatgaagatctaagaggcttgctttaaaatccatggattaattgaaaagggatagctgttagaaataggtaacaatttagagttaacatggtttttaagtgggctgcaatgctgtgctgaaagcaaaaaaatattttatagtagtaaatgcatcataattcattggtatggaagtatggagatgactttgtatggtggcagttctttaggaaaatgaaggttaatatgaaccagtggcatgatatggttgcaaaagaaaaaaaaattagttaggttctggtagtagtatagtgtccatatgtcacaaaaattaatagtaccctgctctaatcaaccacatctgtagtattgtgtccatttctggctgtcacatttaaagagagattttgacaaattagacaacttccagagcagtccatggggatgttgaagggtctggcaatcctgtcatgggaggtatcctcacagggtctggaagtgtttaacttgagaagactaaacagtcaacatgaactctctgatgtttgcttcggaaagtagaactagcatcggtgggttaaaggtacagatagatttcaacatgaggccttcctaacattgcagctcaacaaaacaatcaactttatttattctgttctttaaatatcagaaatattcacctttcttgcaatgaatatttaacttgaagaccttgataacattttagtgtagacctgaaagataattgtgatgagaacattttatttttctgataaactgtctaaatagccctatgtgttgcaagttcatttcttacaacttgaaaatagctgcaacagggtaatttaacacacaccctcctatctctcccattctgtttcaaacatgaaaacctgagaagaagatgaaagattccttttccccctgcaaagtgtcttaacttgcttaatttgcttcctagaattactctttcctggaatttcttgctctgtccaagcaggctactggggctgagtggccgtggatgccgagggtacctagggctagagggggcaggctggctgctggagctcagctgcctcttctccagagggaaatagggtcccttctgcaacctcccctcccttgtgatgtatctccctacaaaacttaacagttacaatttttagcttttacatagcaaaataaaatatttttatcaaatgtttttaacttctgtctgtttcaggttagcctggtttctgcctggctgaagggcacattcttagtgtctcaaacatgtcttgaggcagatttttctttcctgtatggtgatctgcctattgattgtttatttgggttagtatatcaaactttgaaaatatgatttcttaaaatgaatttgtggattatatagggcttccttacaggaccccttttgtgagtagtttcggattctacaaaagctatttttataccctggagttattagttcttgcaaactaagaagtccaatgagagaggtgaagaaatgatagaaaaattcttctgtcatattttctaacttttccctgcagctttcacttctgcctcacacttagaactttctcctccactccagttgttaggtcagaaatgcagtcactttcactctgactgtatgaagtatatttctaatgttgaacaactttctcttttccttattctctctttcatagaagggccccatgcacttttgtgggattgtaataatgcaaacagcagtttgagatggcttgcatccctgttgttgaagatgccacgggcgttcttgggctgagttcatatttccaagacagaaaagctcaaagatgagtttctggcttgtcaacgctcagctgatctacaggcggctacttgtaattccttgaatgcagtgcttgcttgctctggctctggctcccctgctttggaagtaataatccccagtgtctacattttaaaacttaaagatgttaccttgggaaataaataggtagcctcaaaacattagttgctggcatgattattgttatattcttggaaacaatatgttagtaaaagctacagtgctgttttcttcttcggtcactctttggtagaattttattttattttttgtatcttcatgtaagaatttttgtgcaatgtttatgcaatagcagtttaagtgcatttgattatttaaaaaccacgcatgtttagcacatttcactttgtatctaattgtcttagactaatcaattttttggaatagatctttggcatcctgtaccacgggaatcgccatggtatctgttgtgacatgtacgcagactcttttctgataaatgaagccgctcatttaaaaaatgtataggagttaggcagctctggtatgaattctttcccattctttagcttttcacttccttatctgatcaccactttgattattatggagatttggggttcgctgcaaatttgaaagaagggatcacagtaattttcttacagcagttaaagtggaatatttgttacctatttcttcagcagtatgcatggaagtatagttgctcttttaccttggaaagcaaaataagagaaaaaatagccctgaggttttttgtttctccttcttagcaaattcatgtttcttgctgtgcagtaaaatgacattggcttttctcttctatgaaatagttaatcagtgtagcacttttaacatctttcattttctgtagttactgggttcattctcatgaaagaccagtactgccgaagtagaaacagaacagatgactacatgtgcttatcagaatttgaaatgtacagtattatttttcatctaaccgttttactgctagaagtctagcttagagatataatggtgaaggtgcttcaaagatacagataaggatttttattatagtgttgataatcataataagaaaactagaaaaaatcctggtcatctttactaattagtaattcttttttttttttttttttttttggagacagagttttgttcttgttgcccaggctggagtacaatgatgaggtcttggctcactgcaacctccgcctcccgggttcaagtgattctcctgcctcagcctcccaaatagctgggattacaggcacccgccaccaggcccagctaatttttttgtatttttagtaaagacggagtttcaccacgttggccaggctggtcttgaactcctgacctctggtgattctcccacctcagcctcccagagtgttgggattacaggtgtgagccaccacacctggccagtaattcctttattcattcatttttttgagtgttgactagttttgagaccccatgctggatgctagggaatacacagctcggctatcgtggaactttttacactagtggggttgacaaagaacagggtttttttcaagattatttgattaatcaaacaattacacatataaatgtgcccttaaaactatggtaattgctatgaacctgactagaacttgtaagtagaggatttggccagatagggggtttaaggaaggctcttccaaggaagtactcagatcttaaggatgagtaaatattagtaaggagggacggtatatatgaggtaaaaggaagacctctgtagaggccctggggcaggttgaatatggtcaacagaaagtgctaaaagaagtccagtggcgttggagcagtaaaagggtaagcacaatgttaaatgaggctagacaggaggtcagggaacaaattttgcaggacctggtagacaaccttaaaggatttaatctttatactaagagcaatgggaaaatctttgcagggatttaaccaggacatgatcagatctgcatttcaaaaagagcactttagctgtttgtgaggaaaaggttggaggggtcagaatagtttgcagcagactagtaagctcctttagtaattgaggatagagttgatgaccttgtgggctagcgtggtgatggggagatgaagataggagggatattttagggggtaaaaaccaacagaagtgagtgttgcattgaatttggtgctaagtttgtcgggaggagatttcaaggatgatttccagatttctgtcatctacatgaggacagatggtggtgccacacacaggatgaagagggctggaataggatcagtttttaagggaaagagtatgggtcctagtttggacaagcttagtttgaggtgatgataaataaattatgattgagacacatagcagaaaatgatgtagccttaaaatgtgctatcatgtaaacatgttcaagatatattctaagtgaaaaaatgtgatcatattatgcaaaaaagagcacggtatgtgtttttgtgtgtacacacatagaatatggaaagacacgaggacgattaagggtagatacgctaggcagtgacattggtgggatggcaacagggatatgagggagaacatttatattttgtaccctcctggttatactattggaaagtatagtacaatgagaatgtatggatttttataattaaggaaattaataacaatttaaagcaaacatacaatataagaatatttcttttttagaggttacttagttggaaagagcatgtgagcattgttatattttttattgtgaacagaaatttttcctgcagctttacgtccctaacccaatagctcatacacttggctttttaatccttttccactagattgcactattacactagattttatagtgcctgtatactgttttgtattctgcttttcactaattttattattttcacaatagtccaacattgtgcaagtgaggacattaaattgtaatggtgcatataactgttgcttatatgcattgtttttgttaaagtttccactggtgttcctgtttcatctgagatatatagttctgttcccatgagtggaaacccagacttatcttctcaggctatttgagcaaaggagcagaaaataccaagagaagtgagtaaccttctcttctccattaactattctgtcaaaccaaaacttcttatattgaacgtttaactttccactcaattttgatattgtgtttaatgcagttgagtcttgctcacacataactttttgcttttgctgcattgcttcctctgaataaatatctaaaagcttatgagagtcagaatataaatatcgatgtaattcatttcttactacatcaggcttccctcaaaagggttaaactgcagccctcaacttggctaagtgcagagaatgaggattggctgagatgccatctttttagtccttggacaacgagtgtagtggagtttggtatggctgtcgcctcttctgagtagcctctacagttgactctactatatatttctatagaatatcatttttcatatgtgtcatgattgtggaaaaaaatgagagtgcagtattattatataatgccacctgtagtgatgatagttttttttcatttgaagatatatttttaaaaacgattgtatttaaagaaatccaaaattttcttcaaattagttgaagagtaaatgtaataatagttttcatttttgggggacatcattatatgctaggcattcttctaaagttcttaaatacattatgtcatttaatactcaacagtatgtcactgatatgggtactattctattccagatgaggcacagaaacattgagtagcttgcccaatggacaaaaattaggatttgaacccagacactgtctgtaaagactgatgttaaacactacctttctgtactacagttttatttcactctaaagtctcttatatctaatttttttagcttcttctggcattcttcatttaaagccttgctgtaacatttcttttaggattatcttttcccaactcctttcagaggttggggtaaacagtcctcctcagtaaagccatttttttccccataggttccaaaacttaaagctttcttctttcaacaaattgtttttgttcttgttttggtgcccatagtgcatgagattaatttccactgcacagtagtagcatagtaatggtgatgggaactttggctttctatatgaaaaaatatatataaataaaaatgtgtatatcattttgtgtaagtacattctttgactgcacaacaaaatcacctaacaatgcatttctcaaaaagtatctccattattaagcaatgcatgactgtatttgggggtagtattgatgtgttcatgacatagactttgcagtcaaccacgaaatgggttaaaaattcaactctgccacttagtaaacataagacctggggtgagttaacataattttcttaaacttggtagtctcattgtaaaatagagtgaatactgcctacttaacatagtcattgtaaggattacattagttaatatgtgtacaacccttggtgtagtatccagcacttagtatttaagacattgtagctaaagaaaagtaatggccaacttacattttttagagagaaaaatgtaaaaataatgttttgatgtaggaaacaattttaaaagaaatgaggagaattgcataaaagaagggaagagaaaaatgtagagggtcagggagcagcgtaacaacttggatggggatggtaagagaagggaagggatgccggacacgtgagctatataaccaacttctgaaaacaaagtctttcatcccccttacagtggaatatgaaagagacaaatgaagtagtggacagagaaagacttgacagtttgcttttaaggtgagtatgataatcagattaaatttcatttggcatatccggctgtttacttggacagtgatgtctgaataagttattatttattatttcccttccttgatattctgattagctcatcagcaatcagtcactattcacagctcttcaattacttttattaaatagcaatcctctcctcccccagtcagcaaattattcaggtttgggaaacagtaatatctcttcagagagtgcttgccccaggccagatgaaatgtagtcatgccgctacaagactcaaaatgaatcatggaatcttaagacaaactttaactgtcatatggtttctagggaaggtgaaggcatgccagccacctttggattaatttaggctttgatgatttagaagggggaacattgaaaagatgattaaattatgtacagtgatatcctggctaattgtgtgaatgccttcttagcttgggctttgtaaatgcaagatgcatatgatgttttgtttttgtgtttatgaactagagtaaaactcacacccagatataattgtaatgtagattaccatgaacctggtgagcacagtggcgttctcttccttttaagattcctgaggatagtccagtgtctttggaggatgtccaagaaccagtctctacaaggttgacatatctttacacattagatttaatcttgaaaagttgtaggtaggatacatattttaaatattgagtcatatttttccgtcctagagaaatccattctcacataaaaaaatgcattggtccttttctaatgaaaattaaactttaaaatactagcctttttcaatgagtattctgtacttgtcaatgtacagaatacaatacttttctatacaagaagttagtcaagtggatccatgatattggacacacaattaaaaataaatagttatttccctattattaaagtttctccctcaatatgtgggacttggtttaagcacatcattcgtggcatcgtgtcttgcctttagtgatattgcctggggagtagagccataaaacattgtccttttattgggatttattggacttcagtcttctgtggtcaaagtaggacttcatctggatcaatacaaacttttaaaaaatgaatgtgttcaaaagcagtgctggccttgaaatacagcaatatctgtgtgttgtgtttaaactattctaccctgcctctctgtttaaacaattgagacaccaattcaatttgctttttgaatcctgtaaaagccaactagactgcccttatgcaggacctggaaagtatgagcaatgatgcattgattcactagccaaggacatgtagtggtgttaaatcttatgctgggttagtaggattctaaaagcaagagtgtaagaaaaaattccatagacctaaaattatcctagtaaatcctttaaatagcccataaggtataatatgtgtaattttgtatataaaactctgaacaataattcttatgcacaacatagtctgagaaccactgagctagaataaaggaaggaacaaaagagaagctgcctgggcactcaccccattctttctttatggtaactacccagttcatggagaaatggagagttctatagagtgtctgcttgcctgcaggatttacttcattatgctttaagattaagcccctataatcttcagacacattaatagatgatttggttttgtaaggattgaattagacagtatatgtgaaagtaccttgctcaggagctggtgatgggaagcagttaaatctaaatgttgcttgtcatatccacaaatgcattgttctttggaacattgtagagaagaatttggccacctgtttcttgtccttctagttgggatattccactatccagcaaggtcttgcatgtttttacaaattggttgtatctgtaaatcagttggaggttggaatgggtagggttttcaggtaatagtttatatttctttgggttctgtaatggctcctctgtcttctagagttcacagttttgtatgtgaattacctgacggaattgtgtaacccatctacctagactctccatggtggagtcatgaatatgtgttttagaattttttactatgtatattttgggggtacatgtgaatatgtattttgggggagctgcctacgtgcttcctatgtaaccagcatgttgcttttggaacatagccatcaggaaaaaccctgggggtggagtattttgccacaagagactattagcatttctgatcctgttttagcttaaattattgggaaatgcctcctgtattattcatctggatttaaaaatacataacttccgttattaaataagccatttattagagaaattcataagattggtcatttagtagataaaattaatattcttaatttgacatatattttaaattgaatacaaattcagtagcttattttggggggtgctgtggattttgatttgtactcctaggtgtcactgacatgatcacctgaggttttgtttgtttttaataacctgggtttaacaactttttaaaattttaattatggatatgtaatagttgtacatatataaagggtgcctgtgacattttgatacaagcatacaatgtgtcatgattaaatcggtagcctcggttttagccggttgcagtggtcccagcagtggttgtagtcctagctacttgggaagctgaggtaggatgattgattacttgagcccaggagttctagtccagcctgggcaacatagtggaccccatctctaaaaacactactactactactaataataataataatctgggttttgaattgtattcttttctcattttgaagggttggatttttcataatttagcttaagttcagatttttactgaaaattcagtttgaaaaggaaatatgccttttacttctgatttattaaggtggggagctcttttaaagttaagtttgctatactccactaactgttgctgtcttcactttcctttccttttctcatgcccaaagtattttccttacttccacatgcttggtcctacccattctaccttttcttggattgtatcttatcagttatgctcctgttctttatccttaatctcttccccccttacatcttttcctctatttagatacaaaatatgtcatccctactaaaataaccaaccttctgtccaccttgctactcttcagtctatcatttgatctttttgcttccctattctgaccagtgttcttgaaagattaactgtaatttctgcatctacatcttgaccttttgcagtttggcttctactctcaccactttatcagaactccactttcaaggagtcaccagtaacttctcacttttcaaatctagcagtcttttctaagctctcatcctctttgacctttttgcagtaagtgaggatgttgatcacactctccttcttgacatctctcttctgttggcttatgttactcttcagacttcatttttcaacctctgtgactgcttctctctttctttgctgaatcatcctctgcttttgatatgttaatgtatttattaacatgttgttttgcttttgctgtccctcttaccttttgagcattctttcttactgcatttcaggtccagaagttaggacaggccgggtgcagtggcccacacctgtaatcccagcactttggcaggccgaggtaggcggatcacctgaggcctggagttcgagaccagcctgcccaacatggtgaaatcccatctctaccaaaaatacaaaaattagccaggcatggtggtgcatgcctgtagtcccagctactccagaggttgaggctggagaatctcttgaacccaggaggcggaggttgcagtgagccgagatcacgccactgcacaccagactgggcaacagagtgagactccatctcaaaaaaacaaaaacaaaaaacaaacaaaacaaacacacagaagctaggacaaatcccatgggcagttcttgggctgagctgaatccacaaggaacttacctaaagtagcccaagggagaataggatggagagccaatattgtaatcagaaaaaactggtgcccaaatctatcatgtctaaaatgtaagggtgaaaaatcagagagtagacagcagattggcagtttggatggtgaaaaacaggatcaataagaacaggaacatatatttgctccagatcactttctatgtaagagcctgatgtatgtgttaccagggacatggtatctttaaggaatcacactagggctttggcttcaataatcatttctctggagaagaactttaaatctgtatgtgaagccccattacattatcttcttcttctcagatagtttcacctagatgtccaactagtaccctaagtttaacatatcctgaatcaaattaatcatctttctcttgaaactgacttttctgaggttcctaaagtattgctattctatgtcattctagataaaaaattcaaaggcgtctttgattctccttttatccctgcacctagcagtttgaaaaagtattgtcagtattatctccattatctccatgtcagtattatctccattacaaggtgtcttgtaattggcaccactttttgtttccttgtgcttcaccctgactgctatctgacactcttgcagtagcccctacttagtattccttaacccctatgctagtcattgctgccagtgtgaggaaaattcaactgtgaatttaaaaggtactttaaacttaacaacattcctagccagagataattgcttccccattagtgttcttatagcacgtatgctttctaccatttgtgtgtataattagtatgatttattatatatgtgtgtgtgtatatatgtgtatgtatgtatatgtatatgtacatgaattgccaatccccatagattgtaagctccttcaggggcaggaactatgccttggttgtcttgtatccccacatactccttgtattgacatacaacaaatatttgctgactagaattaaacagttagctgggctggaaggaatctgatcccagttaattgtaggtgatctgtgacagtcattttaaaaaatcatgacattaatttcatttttttgtacatttgttttattctgaaaagcttttttattaagctgtgctgatggcataaatggaacagttaactggaagaccagacaggccaacaattttattatcagcagaaaaatggctgctgggatgaaagatggtgagtttaggttgtaaatctaaatccctttgggggagccaattaaatgtctgcttccaatagtctcttcccttttttagtcatgtgtggctttttgttgttgttgttagtaagtctgaaaaactaaaattttgttttcctaatcttctaaaacttctgttttagatcccgtgtgttcttattccattatttttcaagtcctcttccttggctgtagctttgccctttttaaagaaaaactaaaaaccattcctatgtttttaacttaccttttatccagtcactagcttgccacttataaaaattgtcctactgtggttactataacaagttatttataatactgaaaaacgtacatttaacatgtatcattttaaatagcagtatgtaaccttggaaaaactcatattttggttaattttggatgattcttgttgcaaaaccaaattgatatgttttgctattacttagtggcacttgttttctattggaaagatgacttgacctgtaaatgattgattgatccttctaaatttttcttcagtatctataaatgtgaccatcagcaatattccaggacctttgaaataacgcatttcattatggagaaaaggcattacttaacagtcaaaatattagttgttttcaaaataccagttaccattatgaacttgcacttaatatttcttttttttttttttggctttatgatccttcacacagaatattaactacatgtgttcatgaacctcagcagaatagtagtttctctaacttcggagcaaccaaaatgtctataaaaataatagtaatattaaaatgttttgaaaagaacagtaattttatgtgataagatgataatgccagatgaaacctgctgggtacttgtaggattgattcctggcttacttcattttcttcatacatctctgaagttgggcatcactaacatttttatagctggaaccgaattattcttcagctggacacttctacccccagatctctttcacaatgggacaaagtttcccaacatctattttctcaagtgactttgaaacaaacctacaaatacctgtgtatttctaaggaattttccttgctaagatctgtaagaaaacatagagtttcatacaaataacttctcatgaaaagatcacaaaaatttgttttaaaaagcactagatgcacttgttccaggacacaggcccatgatctcatagttcttttccccacattctctttagatattgccatcagattctcccaagttccttcaagggaatcacccctgattacacccttatctggctggtttcttgagcaagctgagggccatcggcttctttgacacagtcactcttccttttttctaatctattttctggttatgggtccccggtgtccttcactgttgcagtctgcactgcacttctgctctgtcatctccaaaggacttgggacatgccctggttccttgtgcctcaccgaggatctctgaagactcttcctctggacttcacatcatttttcactagattgcagtcatcccttttcttcagtctttcctctttagctttgatccctggaacctctgttctctctgagcatgcctctctctcctcttgctgtttgatttccaaaaacaaaaaaatactctctcaacagctgctgcactcagcagagtcatctattatggtgctgttctcagggaaatgcatttcaagaccttgacatatagtgtcatctagaatctctaagagacgccagtctcttcctgtttcaaacttcatactgtcattgaacctcacactgattttctccttgggacccaagagataactagagttttcagaatagaaatgatccctccatcttgaatctactgaggtaaagagtttcgattatcacattttcttatttcttcagtttagcttgatctcatcctttagattatttttctttcttctcatcctatttatatcctatcattatagttctgaattatcaagataccttatacagggagtaagttttgtcaactgtatgaggagaattgtttcatcacttttaaaattataataacaaatactagtaacttgtatggcaaggccattttaaatgctgtctcagatatagaatgttctttgagatgttcttgaccatgaatcccagttatctcttttagaaaatttcaagagagcacaaaagatgataggatcatttatatataaaataaatttgacaaatatatgttttgtgtagctttttttttttttttgagatggagtttcgctcttgttgcctaggctggagtgcaatggtgtgatctcagctcactgcaacttcctcctcccgggttcaagtgattctcctgcctcctgagtagctgggattataggcacccaccaccacaccctgctaattttttgtatttttagtagagatggggtttcaccatgttggccaggctggtcttgaactcctgacctcaggtgatctgcccgccttgccctcccaatgtgctgggattataggcgtgagctgccaggcccagcaaagaatattccaattcttagctaaagcggtaggatggtacttcttctgtaaataggattctaaggaatttgaatgccttaacttttgacattctacctcagcacccagtaagtggttacaaaagcaataaggaatactccagatatggactatggaatctcttctttttttccctggaatgggagtaggggacctacttgagcaagctgagggccatcagcttctttgacacacccactcttccttttttctattttctagttatgggtcctataggcttgaagcagtcacttagtccctctacgttcaattttgttatctataaaatggactgaactctccaagagagcaaatgcatgcaaactctgattgttagtaactgtcaggaatcctgggttaagtaggaggcagaggccatatgcaggtaggaaataatgttatgatctgtctcttaataaagaaatatatttggcatgcccagacaggatgacatataaagctcttttcaatgtagcatgctatgacactaagcttattgatcaccaattagcaatggtttgcaacctttttccgattgacatttaaaaaacacacacatgaaatcacacaataatcaagatgtttagttccactttggaaaaactgaaagtaagtggttttagttggggaaaatatcatgaagaaactcttctgcttttttgtagaagattcaagtaatggtttcctctcctacttcatgtaaagaaaagtggccatatctcctagagaaatgaagtttacaaagacactgtaatgccttcttagtgatggattccacagccaaggcatggactatctgtgactgaaaaaaaaacaatagctggccaatgccagatgaatggcctgcagtactttgatgttgagtgaattaaaggtgaagggcagactgctgagaaaagcttttgattcaaagccaagattcataaagttgtattgataaaacacaaggtaaatcttagtgagaaaaacaaaaacaaaaacaggttgtctaactggctggatattgatctctcttaaaatatttctctacagcaattacctggcttaataattaaatttcaatttgactgtagtaacaacatgttaaaaaaataaattagaaaggaatccataaatgtatcaggctatgcaaactttgaaatgagttcttttgatgcagagacagcaagtgagatttgcctcttgttcaattcctatgtatacagggactctgaatctcataaagagtttttagatgttaaaactataaaatatgagacgagaagtattattttttgtcagtacttaacatttttaattatcagggatgatgatacctagttgcttaggcaacaatttattttaaaagatacagcagataggtggctgtttagtactctctttgtatcctcaacataccttaaaaccttcttaatcattcttatccaaaacatttttttagataatacttactgttaaggcaatacttaaactaagttcaaattacttgaacaactaatttcctagctgtgaaatatatactatcatatttaaataatttgaacttagttaaaacacctttgcgatgcttcccaatgaacagcttccatcttcaaactcttcatgtgagaaacaaattgataaaattgaaatgcttttagaaatagactttaattgcttattaataagttacttattaattatattgtgttatagtatcttaggctgatttagctataactaagggcaacatatcatttaatccatagatctcttcgtttaaattgtgcagtgtatttcccacatatcgaatatgtaagtgttttatacaatgcattcaatccattttttatttgacagttcacagttatgtaatatatgggttgaattaagactttcaattgtacacctatttatttgtgaatgtattttataacagagtttctgctgccatcaccttaagtaatggctctctctcaagtatagtaagatcatctattcagaagtgtactgcgtcaactaagaactaggaaatacgccacaaaagagtctttcggcagccaaaatagatgctgcgaatgcaggctcctgtcttttacatctagcagagccctatgtgtgttaaacagcacgcatttgtttttacttcaatgtgcaaccctgcctcatttggtagtctggtttctaaacctgcagccgattaataacagcaaattagaggggatagagaagctgctatgggaaacatactgatagcaatgagaaatgacagctgacaacttgtctacaaaagagaaaacaaaatctgtaaaacacacaaccttaaaaagcattagcagactgggacccacagtgtgatcggtaaatgacaaggcaaccaaacagtccatacgggtatcaccgtataatagagcagagtgcaacaattgatgtacaaaatgatgatcttataccatcatgaaaaagaatcaactgcagagtacttcagaaacatcagctctgtggaacaattcatttcatgtggttctggtaaactgagattttattagatccttgtaaaccttaaaaattagaaaatgatgatataaatggacattttaaagtgattagtttattaataaagcatctataagagagacctaaacatactgggtacctaatcaaagtcacccggacataaatattgacaatactttatgactttcttctcaaagatttcagaagacagatggctttaagatttaaaactagctcaaacttgcagggtcttatactcagttgttattttatctttatagccatgtaattgttcttggtgatgcagaaaaagaactggcaagtgttctctggacatttttgtagtgaaggggctgtgtgtgtgcctgtgcttatgcacatgccattaagaataatcattgtgagaattgtgaagttatatgctgtggattcattggcagcgtaccaccatagtactttcaaaatttaatgtttactaaatacattcaaacttgctttgaaggtaattgtaataagcacacgtgcacacccatatattttcattatggagagagagtttccactggactattagtaaaggaaaacaagacattgtttagctagcatgagctccctttttttttgctactgctttcgtggtctgttatttgattctgggctctatgctgtcacataatatagagttgttgaaatggctgcagattctataccctgtgaatgaaacatacagataacagttttgtgaacaaggttttggtaacatggtgatgagataaattggatctatgtttagggagagcgagataatgatcccagctacttgcttacataaccctttggctctctctactcagatatgtaattattacttaaaaaattctgttccttatgactacctgtcttcagaagtttttaatctttgtaaatctagctatgcttgctatttggagatgatatttttgacctcttgcgggttggacttttggtctcattgtttttcccattaatagtgatagaattgcatggatttaaccacccatagttttccagtttcatttatatctagtggcgtatgtttgcagaggtaatggatttgcagccgtagaagattgcaaaaccatgcgatacacagagaggccagaccctgttaccttggcttgattagcatggcactgtacacatgtatatttcagagattattagatcttagtgttgtggattcttagagtgtttaaatttgattttcaagacttgctcttaaggaaaacaacatgctttaagcttatggtttgtgagtgctgcctgggcatatgtgactgcaacatgtgttaactgttagtaatagcctctgtaggtgttggagtggaccccatcagctttatttatatagctcacgtttagaacaagaacctatagcttcgaattctctgtgtcatttgttgtttttgaaaggaagcataggtgtaaatactgcctaaattgcctctgttgaagagctatttgttttgcaagtaacaaatgcgaaagggaaaggcaaagggcactcctctaaaatgttgtgtgggtgcctgtaatttaaactgatgctacagaaaggaagtattatttttacaaacaaaacatagtggcttagtcattttccatttctagatgatgaatgtgtcatacatctgtatcatgtttttctcaaagtgaatggcatactatacttaaagtgaagcagcctttactgtggagttgccaaggtaactgaccagcaagtatgcagttcagcagattgctgaaaggcaattgagtacacatgaataaagaaatgtgcttgtcatcttcaaacccaggagggccatggtagattgtgtcttggctctgtagaacgcagaaatgttttttataaaagcagaaactgagatgttctatgcaagttcttgaagtgagatgatatggagtggcaggtaccctttctttaatggttccacttcaggacctgtggagggcaatgtagaaaatggaatcatttcagtattatttaatatgaacaacctttcattttgctttgttagctagcttttaccaccttatagcagcaaatactaagggagactattagtttataatgtcaatgaaggatgataatctacagaatgctatccctctaagtattatatatatttagttcactaataggaaacttgtgtttacctctgccgtactttgtattagaatgtactcatccattccataggcattgatacaattattcaaatataccagactctcttctagctgccgagaaaatagcaaggtaaataaaacttagtgctgtacttcaaggtatttttaatctctagaaagaatgaattagataattagataaactacaaagagattcctttagattatttgtaatgttctctgctttggatgtagggttgtgatcctgaatttaaatactttgatatacagagtgaaatgactttttagcaggagttcaaaactccctattttaactcttcttttcttcccagttttgcctccccctaccttaaatttaccccaggatccagcattactgacttaattcccttccccgaaaggcccccacagtatccagtattgtatcttgcacatatgttcactgtgaaatgctgaaattccacatctctgagtttcagaatcctactactgtagtattttaagagccatattgaattccacttcttccataaatcttttctgaatctgtccaaccttaattgctcctcccatatttccaggtgttgccaaagcagttttacctctgggataatacctagttaggtggatgttggtctcccataccagatggtgaactcctggaaagcagtggcagggtctctttcatcttcatattccccatagcacctcacattcagggtacattgtggtatcaaactggtaaaaaaaaaaaagtataaaattctcatctttactatttttctgtgattcattcattcttgtttcgcggaatgggattattcctgctggtaagtacattgttcttgagtagaagttgggtactgtaaatgccacaggggaagatcacttatgaatactagtacaaaacaaatcaggaaagaatagatctctctgcatacctagtttaaacataacttgtagcttccttccctctgttacacagcctttgaagttatgtttttagtagtaaatctgtagatacgtgaagctacaagtcaaatattttagctcagttcccccttttctggcagccatccaccgaactgcagggacaagttttcacagataaagaaacattttgtgggagtttttatttttgtgctgaaaaatgtagttcagtgatcttgctatccaaggcttttagtaagttgtgagcttggagtgagcagccttgtggttcataaggttaattaccatatttacaaatccattaatgacttaaaagaaagaactggcctgatagggtttatctctctaaaaattgcagccactagccaatcaggaatatagaaacccaaaagagatcgtagaagtgacaagagtaacggcaataatgtgttagtggagaagatgctatcagagcaaaaacaataagtggaaactaatcaaaacaattggtcattttaatgtactcatatcatatgtcttaagtaactggtaaatcatgaaatttgcttatttcacttaaattattttgcctgaattttattatgtaattgttattgcttatttaggatgcagcataatataatagattatattgtttgaattattaaatatcaagatcagagaaaattgaataaatcatttctacaagagatgcgaggaatgaatacccagaaaaagtatccaatgcatttttataagtatacgtaaaaaccgcattacatgtattgatagtgttatatagtctgacatgctttgtctagaaaacaattagtatagtatggattcttaccacttaaaaattactctgtactttgctttaaaaaaaaggaaagaagaaaaaaatctgtagcaattatgtagctggtcagttctcatgatgtattttgttggtaataacttcaagtaaaaagaaattaccaaaaagatattatggatagcttcattatttgataacagtctaaaatattaaatgtgcataattttgtctatgtagtgtttgaaaaggctgtaaacacaaatcaaaagaattttttcccattttgtcctgaaatcacttccatttaaaacaaattgttattaacagtttccttgcatgttgcttcagtttttccagaaatgtctacatagtgagacccctctttataaacagcgtaagctgaattatcaagggcgtatctcattatttgtctttctgtcacttatctttcctctttgttttcagtgtacagtattttctccaaggtacactccgatcggaatgtatacccatcagcaggtgtcctctttgttcatgttttggaaagagaatattttaagggggaatttccaccttacccaaaacctggtatgttctttgtgaggaaaaaaaagcagttaacgtactaaattttttgtttaatttgcataatatagacatatatgataaaatatcattaacattatttcaaatggtctaaatatgtgataaattgttgtaggatatttctcatttacagattagaaatttaattacagacaaaaataatttatttttgaatgttaaggaaagcatatttctggattctcagtcttgagttttatgtctctgacaagtgatctacctatattcacatggaaataattatagctgtaaacttatgattttctatattaagacctagattctcacatagtacattgatttttggaaaactatacatatgttgtagaggagaatgaaaaatggcattaggtaagagcttttaaaaagcttttacaataggagataattttatataactccataataatattatggagattaatttttccttttaagtgataccaattatgaagtcttacttaattcactattggtttaaatatgttattttgagtgatcataaatgccatcaagttaatgaagatatacaaagaatagcaagagaaaacatatcattacagctcttccttaagcagcaaataaaagtgaattttctgaaaattatattgtataagaatgtttttagcattagaattgatataactattctttttgaagattatatgatgaatactgtacctgaaaactcttccacaatatagttagccatgttcctaatagtattcaagaagatgaaatacggcttgtaaagcatttaacacagggccaggatgtgctaataaatgatgctgttattattgcttgtgattaataaatgctgtcgttagtacagttgttatggatttgtaacgtctttttcatcctatcctccagtgttttaaaattacattatttttgttttgatgagacttttataattttggaatatctttcatactcatatgatagtgtccagagtttcatgaacggaatatttcgcaaaagaatgagtacatcagcatgattagggaattctcctgaaagatagttgtctcactggcagaactatatcactgttaggtgaccaaaaatatatttccaagaaaattgtatgaatctgctttctttgttgcatcagattttgaaacaaattaaacaaccaaaaggattttttttaacgtggtgccctaatttaaattcccagatgggttttgtatgtgtgtatttagttggctacaaatgtaagaaaaaaattttagacagaatgttttgattgaaactaccaaagcaacatgtgtgaaaataactgtcttatgtcttaattctctgtttcttatctaggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgaggtaatttacacctagaaagagcaaaactatacatatatgtgtgtgtgtgtgtgtgtgtgtgtgtattgtaatttgagttttaagtgttgaaactaaagttacctgatggtggtttttaatattttgtgcatggaaacacagtagataacatttggaaatgtgccattcttctctgtttataaagtttttgtttcagcttttatattaaaaatgacagtctaaatttgtgaaaaaaatatgaccttaaaagagattattataatatgaattctatttgagaaaataattgtagacttgatagacttatttgctctgtattttgaattcaagttttatgttcattgaaatatagccatcaacagacatatacccctgctacttgccaagcattgtgataggtgcttagggatagaatgataaataataggtgaatcttgcccagtcttcttacaattcaggggttggaggactgggatgtaaacaaatacttagccaacactgtaataactgctatagtaagaaggtgctgtttgatgcagagttgtaagaaggtaaagaatttacttgacaaagtagaaggaaggccatcttgggcggaggaaacaacacatcaaaatcttagaggtataagaaaagtcacatggtctcagagaactataagtgtggctggaataggatgtaccctagtaggtaaatgatgggaatgggaggcgttgatgctggtaggggcagatctttgagggctctgtaagccatcctggtacgtttagcctttattctagaagtgatggtgatgttaccattcatcaggtcctcaccagcacctagcattgtagctgggagatactagaaattaacaacaacaaaacaactgttacattgaatctttagtaggaattaatacaatactttaaaaaaatgaatggatgtataaactaaaagaatacagcctttcagaggattacatactatgaatttttctccaaagttttagtcagctgtgtactgtggatgtgagcttccacattggccaattcagttggaattgaagtttgtattaactgttcagtgatttctatctataaatcatattccttaaggcagtgtaactataagatagacaggtacttagaagaagcatgttagtttgagctattgtcaaattaatttttttaaatattcagtaaaagttataaaagaaatatataaatgcaattcaccacattattagattaaagaaggaaaaacagcataattgtcatgatagttatggaaaaagtgtttattaaaatttactacctattcttgataagaaaaaatagctcttggcaaactaggaatagaagtgaagttccttaatttgccagtttttaccaaaagtaatagcaaacatcattcttcatagtaaaatgttagagaaatttcatttaaattcaggaacaaaacaagaatgactctgtctgataaatctattacagaatgtattggaggtcccagccagtacagtaaagaaagaaaaagaaattaaatccctaaggatttaaaaagaagaaatggaaaccatcaatgatataaatggtctgtagactattaagaatcttaagaaaggctagcagtgaactgtgagatcattataaattactgttatatttctacacatgaatagcatgtattgagaaaatacacgtttttaaaaataccattgttaatagcaacaaaaatgttgaggtactaggaataaatctaacagaatatatgccaggtctcaagtctaggtagattagggattacatgtaaaatgcaaatttttaaacaattatattaaaatgtagaaaaatctctttgacctatggatagggaaggatttgttaagtaagacctaaatatttttaagagaaaaaatttatcaatttcactatatgaaatttgtgaatgtctgtttatcaaccattaaaccagagcatgatttaaaaagacaacccacaaactgggagaagatattttcaacacatatagctgactaagagtatctaaaataaaaacgaaatcctgcaatttaataagaaacagatatttcactaaagaggagacacaaacgccaataaacttaagtagcttgctcttatgggtaatgaggaatattcagatggagatcacaatgaaaattttgccatcagtaaaatgcattgcaggtggatgtgggagttggcatcactactttggaaagcagtactgaatatctcatacagttgagtatccctgtaccttattatctggcagtcctacttctagcaatatgccccaaagaagtacttgcaaatgccctcctggaggcaggtacaatcatgctcatcaagcaacatttgtatagcacaacactggaaagccacaaaacaatagagacccaaaagtctatcagcaagagaatatattaatcttggtgtattcacacagtgaatgttcagagcaatagtgaacttaagcttgcccagcaatatggataagtgttttaaacacaatgttcaattaaaaaaaagtactagaagaccacctgtaatagtttgccattttggtagagctcaaaaacaggcaaactaaaccatatgctttaagcattcatgcaattataataaaactgtattttaaatgaatggatcgttaaacaccaaatccagaatgactacttctggttggggagaggtaagggcttaggctaggagagaaacacatgtactgggatggtttcataagagttcattgtgagtgcattcattatatactttatgactaacatactgtgttatgaatatgtataaaaatatagtaaaaagataaaaaaaagaaagtttaccatatctttcatataatatagtgacttatctgtaaatagctcattttcacattcatttatagtaacaggtatagtattttaaaatattctatttagtcaagaatttttgtatcttaaatatataatatttaatcatataagtctactaattcattcagtagatttttatctgaaatatttagattttaagtatctaaaatagatcagctctgttttagaaattggggaatcaaaaataaagtatgcacacgtagacactcacattttcttctgctttgacggtcttcacatcatcataataagtaaaatctgaggatattacagcagttaaatgtctcattggaagtgatagaaggactacattctgttatagctgttaaaattaagcatcaactataaaatcaggtaataaaattcttcctcctgatatgaaatattcttcactcccttcaatagtctgcattatttaaaaataaagacatttattggaatttatgaaacttataataatgaaatttgtgatgattaagggaaggctacccataaaaatattgctattaatttgaaaaaatctattttttttctaagctgaagcttcatgatattgtaacaaatagtagaggatcatactttttattgaaaatgtgattaaattttttgcagggtaaacttttcaaatgattaagtttctcaaacaaaatctattttgcattttttgtatgtttcatttgagcaaaagttcctagtttgtttaatggctagtcttaattttaatgtccggtgtgaaattaattgatcatgtgtcccaacagataacagcaaggaaataattaaatatgatggaaatttggcaaatcctggagagagaggttcttttaactttatggagtaatatgcctttcaaaatatataccttttaaacattgttaaaagtttaaaattatttatttcaaaattcttactgttctaactcagtattttcaatgactgcaacttattttttgacacatgtaatgtataaaaatctttgatatttgttttaaaatgcacaagatatttatttttagttgaagtcagttttatcctactcttttgtctcagtgtcacctccagctgcaatcattgccagaaggttagtgctgggattctaagattttgacacaatcatttgttttttttttttttttgaggtactgcagatgtgtccgaatgatttaatatctgttataaagttaaataggccttaagttttgaagccatatcctgttgttggcctttgctttgtgtgttgtttgcactggctgtttctgaattgactttgatgtaagtctattggctctgcaaatgtttactaatatttgcccgtatgaagggattgatttgtgtttttgagcatgttccataagcttcatggactatgatccttactactttactcccatcgtaagtgagatatgatttccaaagggttatttatgacattttttgactgattggggtgcagtttagtactaaatgcaaaaaaacacaaagatatgcttgttttaaagtgtacttttcattataattcttaaactccatttaaaagtacaaaaattattgttttttttttgaaatcttagaacatcactggtaagtaattcataatggttaatccatttactaatgatgcatctgcattgctaccagtgcttaatggccttctatgaaagagtctttctgattttaactttttgtttcagtatattaaatagacctgactaattatttattttcccataatattgctaaaagctctgagttctcattgcccagagaaggaatattttgtaagtatatcaacaaataatgaaaatggaaagaatgacaatttgttttcattttaatccttaatgaatttcattttacaaagaacatttcacttctttaatatggttttccttttataatagataactgcctacaacaggcgcacctttgagactgcaaggcataatttgataattaatataatgtctgcagaaggtaggtatgaaaatatgttgatcatttcttatttataagaagtatttcattatgttttataactacataaaatatagtcaagaattttaaaatgccacatacctaatataactgatgaaataataagatatagaaaagaaaactaagcaatatgtaatttattatgaaatattatggtgtgttatgatggtgaaaactcagataggaagccaaacagatagtcctcttatttctctaagcctttttcattaccttaaaatgggactaacagtagcatttctcttataagtgtggggtaaggattcacaagttaaggctggagcactgcactccagcctagctgatagggtgagagcctgtctcaaaaaaaataattactaactagttttattattttatttaaaaatttactgtaggtaatagtctaagtatatgtgataatatagggtttctggaaaacaaataaaccataacttagggtacaatttccttcctaaatagtttatagtgtattagtaatttgtagagtctttcagcaatttaaagtttcatatgctcaaattgtaagtgatttcctaagaattttgaaggttagggataaggaagtattctcagaattacactctcaaatattttaatcaattgggaaaatatcaccaaatactttgtagttaattttctttttttttttttttgagatggagtcttgctctcgtcacccaggctggagtgcaatggcaccatctcggctaactgcaacctccgcctcctgggttcaggtgattctcctgcctcagcctcccgagtaggtgggattataggcacctgccaccacacccggctaattttttgtatttttagtagagatggggtttcaccatgttggccaggctggtctcaaactccggacttcatgtgatccacctgccttggccttccaaagtgctgggattacaggcacgaaccaccacacctggcctgtagttgaattgtataaatcatggaatgatcctccctatgttagatatcatttatgagaatgacaggagggaaactgatccagaattttttccctctaaaaacaagaaaacaattgtgcattcttgataggggaatttttgcttctatttactagtgcaactaaaaacaaatgagcaaacaccaaacattttatcagaacctactaatttagcattaatgataatgcagtcaaggctgggttaaaaattacttttacacgatatgaaagaaggaatttctgtaaaattaaacgtgtatggagagattgcttgaacacttaaacccccttaagtgaatgttttcccccaggtgtttaccggtatcaattgtagacaacaaatgtgcaagtttaaaatttaaaatgaccttcatatatgaaaagcaagtccaagtgccagttctgtgggcctggactgaagactccctgtccactctgccactccccaaaggcttttggtaggtatttatgtttggatcagggagatttttgttcttgactacagtggtgattggatgcttacatgctgtctaagctggccctgtagaattggaatacacttaatgagcagaataattgaaaagtttccttcctccttaggaattcatcattacagttataaagttatactacagtggccttggaccatctcacctcaccattatgctctcaaagggactcgaaactctgtcaggtgtgagagtccctacaaattgaaagcttgttctatagtttgaacttcttccttctcaaatctagtctcagtgctgtagatacagattactcaaggcatctcaatagatgttgttgttgacgtatgaggacctgtggtcaagtagatactaatggaagactgctagacaactgtaggattgaaaattggcagcagggctctttgtctaaataacgggtttggaaggtgtgctagtgagaaggagtagtagacaggttttagaagcctccacctttactccaggcagtgcttgttcctctgctttttgtgtagggttagtggcccaaacctatttgaaccactgcactaaagtccatgcatttgtccttgctggtctagacagaaatgtatatgtgcagtaggatgtacatgtttgagcatggcctacactcatgttatttatcccagattagatttaggaaaagaaataacaaaagttatatatcagggtaatcatgctctgtccaactccctgcccagctgtctcctgttctgagagatctaatgggaaattagtcatgtagactcacaccgcatgaagctcaaggagagtacataaagtgattctctaaattgggtttagtgcctcagaggcctgccaccaatctgttggcctactgttctcttggcctctgtgatttccaaatatagcaggcatgggatttccccagagttagaaagctgctgtgactcatctctgggaggcctggcagcagctcttggatgggtagatagcaggcagctgcccagctcaaagcctctgaggggtgtggtggcaaccacaggctttgcagcaggtctcagaaaaggagccatgaagctgggtcacgtggaacaggaaaagccagataataattctccaaaaagtagcactgatcataagaaaaaagttttagatactttttaagaaaactggatgtaaaaacattgaatgaaatgaatagattttagacttctggcatattcaaaagctgtatttgtattatttataaatattttattatttattgccaagaaactttctcataacacatttctgcatgactatttctaggtatgcagataaatgtagcatgattaagctatttatctgtataaaacaggaaatatgtctataaaacgaaatttatttgcatatatgagaataaatatattttaaattgcagatgggctatacattaaggaaatctaacaaaattgtaagcagaacaagtgacaatataggagataagcaaagaactttctatgattagggctttgaaaaactaaatctttaaaaagtgatgaccacactctagaaaactctgttgaaaattctgaagcgttagtttcttctttgacttcatctcaggcatcaaatgtcctttaataggatgcttcataagaaataagttaaccaagattttaggtacttaatgtaatttttattttttgttcattaaataaaagtggaatatcttacagatacatgaattttattgaaataaatgagaggatatacatagtgtaattactactggggactttaaatctgtgtagcacctagaaacattttcttgtctttttaaagtaaaaattcagataatcaaccttttcatattattataattagagctaacatttaatattttataggctcctactatgttttgggagctctgctgagcaccttatatatgcagtctcttttagcatagataaaagtcgtacaaggtaagttcacattatgagataagcttctggacctctctaaagataagctttcacgtatgaaagtacaatgaaaaacacaagcagctacacaccctcttgttgtgagaattaaatgttctaattcacctaagtcccctagcttggcctgcctcacagtacatacatttaaaaaattaacctttattcttacagaaatattattaaataaacagaaagctattatttatcgtaagagaacaattagaatatagagagtgatgatttgtaattgaagagtagcatttgagtaacaaattatatttacttacagtttctcatattgaaaggctgaatttgacatggggttgttttaagatgttaatcatgaaatatttagagggaaattttgatgacacattgaggaggaaaaaacactaaatctccaacaatgtgaagtggaattccatgagaactttataatttttctagaatatttaattatagtgtgattaaaaactgtggaattgttctggtttttagaattccttttggacatataattgatttttatttcagaaaaagtaatattttagcatgctccccaaaagatcagtaatattataaatttaaaatgtagatttagcttttcttagttgttttgccaaattctataactataaattgccctgatgagcctctgatgagccttggattttattatattgtagataaagttctgtttctaatgtcagttatgtttttagatacatcctctgttaaacagaaagcctttaaagtcagtattaatattgcttcctgctgccaggattatgacagaactcaacaaatcgcaaattgttcttttgtttcctttttaaaagactacttcattaaagatatgcatgccctttttcaccaaaattagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggaggggtaagcagatctttatctcattgccttaaatatagatttttaaatacggtgatcttatcaaacttattatagatggaagatggcctattgcatttttcgttttaataagaaatagatattgtaaagatatgaacatactagtaattttctatattggcaaagatgttgtgttagtggttttttatatctcaagttcctggtctgtgaaatctaattgtagatgaggatcagcatcataaattatagcactaagtcttttgtaccttccattaagaagctgattatttagggccatgaatttcaaaggaaattgacgccccagttattagctgcagaaggatgcacagactgctgtaactttattctaggaaactatttcttcatctttaacattctttccaccatgtgtcagtgactgatggctggggtggatttgaaacccattcctgtgacacaaaggcctaaagcctgaccttgtcactcacaagctgggtgacactgggcaaaccctgaactcctcagtgcctcaacttcctcatctgttcctgtggggatatgttctccctcagagttgttataatgattaagtgagataatgcatttgaaaggtatttgtcagttctgaagctgtgcagatagaaagcatgacttctgaccttgtggaggtcaagaaagaatcctgcctgggtaaagttattatcaagacaaactttgatctttaatttttaatctgtaggttgaggcagatttgcttttcctacctcaatcctataaaagtatagtctgtggaataaatcacattttgcatagcatattcccctttcaacttcttcgcccataatcctggaaacacttttatacaggtgatatctagaattagctagaatacctggattagtaagaattaaatttaaggatagctttaaaggagaactatgtacacatggatgcagtctgtgggtaggtaaaaggcagatggggaaaaacagtgagctgtaaagtccaacttaaaaatttcagaattaaattttatcttctgttttatagcaatggattttgaaatcagtcaagcatacatagaagtcctttgaggaaaatggttgctttatctcttgtctatgtacctagttggctttctatatgaaaacataattctagagcttaaatttttacttcatagttacagttacaacatggttctctttcctataaagtaattaaagcagaaccgtggaatgagatgaatgggggtatcttccctgaaggcattctccaaatatggggtttttaaaacagttttcttaaggtaatgtgttccacaattgttaaaacaatgaccaaataatgttggaggaaacagcacaaaaacaaggcattggtagagtttttcattgttgtgctttattctggtctcactttttctcgttagtagtgcaggtcccacccgtcgaggtacttttagaacctgaactaaactaaattgaaccaagcaactccataaaccaaactgtgacctaaagcactgctttccaactatgtctagcctgaaaattgccaatagaacattactaaaaatatagataggttcctggcctttgttccccctagagactgattctttgagcctagggctgggcctgagcatgtgactctatattaagaacagaatttttgtcctacaagtacttgtttgagaattcaatcactaactgactgacccccaacacccaacacctgctagagggtggcacatgccgtcagatatttgagagaatcagtcccgtggcatttatttggactcttgtctcagatcccttcccaacttgaaacgctttccatgagttttaatttaatgttaagccttaacctttacaaaatattcatatggagtcttttaaaatagcatttctataaattgtacgcaatgccagctctattactccagtgtgtctgtatacaaacactcataaaataaaatcttacttgagttataattcgaaaaaaaagtttgtcgctgcaaatgattttgcatgttttctttagttgttatataaaatcatggtaatagaaacaattttttagccctgttgccttaaatttagaaaaaaaatccaatgcttaactaatactttatttcctttttacctgtgtatattatgatttttaattcacttaatatgctttctgcctttgtatattcttttgaaaatatcaggggctataaatcctttaaaaatgaaatattaaaaagatcaagaaataggttcagagctagcaaaggaattatatcccttgtaaaaatttttgtttaaaaatatattcatacacttcagaagtattaactaggcacctaataaatgtgctttgtgtaatacttagcataagtcttagtcccagatttaagaaaaagatctccatgaaattatttcctatttattacacatgtcagccacaagtaataagtgcaaaatttttcatatttcatatgtatagtcagttaaacagcagatgaccaagagtagccctcagtagtagaacctcagagtaaatctactaccgttctactgcctgaagtgtcattaagtgtcagtccccatgagcccaacctgcagcatctgagctcctcatccttcttgatgagcattttttttaatctctgcagaactcactgacagctttcaaacttctcctaaatcaaacagaaagtgattatgaagatttacttcaaagtgaataagctcctgcaaaggaaggctgagccctctgaaaagattcattttcacttgccagactgataaccccaaggcaactgtgctgtttctgggcatggtcttggtgctacttttcctcctgatgctgagccagaggctaaggccttgtggatgtatttagcctgggataaagctggtgggaagaagagcaggttcatatttcattccaggcatgtcatggctgccaaccacaggcgagtgatgtagtgtaaatggtggctatgaagggaatgatggggtgtgaggattaaagaatatactcacttttcctaagagattgtcaaacttaccactatttcctctggttaccaaagcatgtggatccagtttcaatcaacaacagagaatcctattttattctctagaccatctcacaaagtactcccactgattgtctgctttttgctgtatgtcaaaggcctcagtgagaagttatacttgaggaaaagaatggaagtcaatggctgcccaatattggtctgatggaaagtcatgatcctgggccaatttcagtagagttctgaaattgtctctatctatggtaacttacagaattgccctttatctatctatctatctatctatctatctatctatctatctatctatctatctatctatttattttgagacagagtcttgctctgtcacccaggctagagtgcagtggtgggatctcgactcacagcaacctctgcctcctgggttcaagcgattctcctgcctcaacctcctgattagctgagattacaggcacctgccactgtgcctggctaatttttgtattttcagtagagatggggtttcaccatgttggccaggctggtctggaactcctgaccacatgatccacccgccttggcctcccagagtgctgggcttacaggcgtgagctactgtgcctggctgaattgccctttattcttaaatgatgtccctcctataattttggtacaaatatcctttattttatggaatagtggtgatatagaaatatttgcaaatgcctttaataaaattggaaacctgtatcaatttttataacaaaaaaacaaatgaagtcaatgcaactatatgtttaatatctactcttctgagttctatcattttttctttcatagtttaatgtttattcagtatttttttaatgggagaatattttattagtctttggagtacagtgattttaaaaacacaatctaggcttgcagtctactagggagcaggcaaataatcagataattaaaatcagtgttttaagtaccacaattgaggcatcacagagagggctcctctctcactacatttctacacctgaaaaaggtttatagaggagctgaaggctgactgagttgaaaatataagtacaaattagcctgctgagaaaatgagaaatgggaacgctatgcaggggaaagggcttgggcgagtaccgaaggtaggagagagcatagtggattcagaactctacttagtgtggaaatggagaaagagatccagaaggggcaaagaccagaccatgtaagacgttgtcttctgggaaaagttatttggatttcatcctgaagcattagggacctgtgcaggaaatggttgatactaaaatttttgttttagagagatcacacttgtagaatagggaagactgaatggaggaaatgctgtgtggatataggtgctgggattttaggggacccaatagcatccattttcccctgccagaggatacatgaacaagaggaacatgaacacatgaaaaaattcttttagaatttagtgccaataaaacatttaggtctctaaggaatagtcatgctttcccctctctaatgatgagaactatgacatttactgtgtttttttttttttttttttttttgatttcaatttgggtacaagaaaattaagtgccaaatgcagtgctctggcttgcaagagaattattagtcctgtcaagttttcaatgttttcctaatttctggtgactttttcacttgtttattttattatatgtgttttgctataatcccatacatctttcattctttattttgtatcttactttttgattgattaattgcaggtatgtacattagaaagaagttgggtggaggaaaaggcaggaagttttgtgctgctgcttttgagtgctcaacatttcccaggcaacatgtaacatatatggacatattcttctctaaactgtcttttatcttctatatacataaaataacaaagtatattcattaattgggcaattaggaaaaaatacaatcattggatccatatatttggctattgctggaaacagtggagtttctacttaaattgtttaccattacttgtttcttcacattataaatgtaaaggcctcaataaatgcattttacctcaaagaagagaaattgaattgttgggataaaaaaaattcttcacaagaaacaactctatctagtgcactccagtctctagtcttttgaagtaccaggttttgttagcattcattgagagccttatacttgataatagcctcctgtctcatctgtttatacacatttgaaatttgaaaacatgtgctagggtcataaaggtaaagatcattctcattttcacttcatacaaattttaaattttgacaacaactagctgaaaggaaaacaacattatgaaaaacataattttagcatgtgtagcatagttattattattacacatggactcagacaaaattacatatttttaaaagccagtgtgttcaaacttagtgattctacaaaagaagccataaatatactttttaaaaaaacttaatgagacaaatccaatatctcctgcttctgagcatgacatctgtgttccgtttgtttttaaactggtataatgcttttcattcatgcattcatttagccagtaggctacctgaggacagtggcaaagactgggttcaaggagcaccattaaggggctgttccttcactccctgtggaaggtgatggtgactagaactacagttgtagcagtgggacaaaacaaagtggacaggtgtgtatgagagttatttcagggtaaatgtcagagactgatgatggattgaatatgtggagagaaggagaggagtcaaagagatggtgcttgagttcatgacttgagcatttggggatgtcaatcaccaagagagaagaagatagaaggaggaacaggtggaggtggggtggggtaatgatgagctcagtttggaacatattaagttgaaaagcttatggatcatccaagtagagatgaaagtagtttggcagtatgtgtcaactgtcataaaaatgtttccacttctagacctctcttttaggatagtcacattaaagaatatgcagagatagtctttgtaatattatttataacttcaaaaaattggaagcaacttagttgtccaactctgaaataattgcggaataaatcatgtgtacttaaaaagaaattatactgccataaaactataattacaaagattacaatgtggaatatgcttatgatgcaataagtgaaaaagcaggatacaaaattatattttagagattattgcaattagattaaaatatatgcatttgaaaaatattctgcaaggtacattggaaaatgaaaatagttcttttggcaatataaatgagttttgtttttatacctcaggttttctgtaatgtttttatactggttttataatttaagaaaaaaaacatttcaaagcatgaaaatctcttatgcccatttatgttaccttgagaggaattaattaaaaatcttactaattgcaaatacaaatcaatgtcttgtctaagcaagagggccattaacagttgtaagaaacattcatttaatctcggtccttacaaatatatttcacaattaccaaggaaaaatatggtgttgccttggtagttactaaaaggatagaaactgaatgtatgcaaggcttaaaagtaataacttgttttaaatcgaatatgtttatatcctctgatcatctaaataccaatggtttctcatctctacttttgttctgaatttttaatttgatctttaattttgcccattatttactatttgtttcccaaaggtacaataggttttttaaaagataatctttcaaatgagtcttaaatcctaatataaatttgatgtgtagagcaaatgaatttgtgtgaacatattctcgaacacagttgtcatctctggcttggtcatgacttcatatttacatttacatagctttgaacttttgtgctgtacttttatttcatttcattttaaaaaaataacagctttattgagatataattcacatatcatacaatgcacctatctaaaatgtacaattttaaatcgtgacttttagtaaattcacagtcatgcaatcattattataaccaattttagaaagttgttattatcccaacaccacacacccacccttgtacccattagaagtcacccccacccccacccctacccctaggcagccactaaggaacttgctgtctctataaatgtgcctattctggacattttgtataaatggaattatataatatgtggtcttctgtgactggcttctttcactttgtataacattttcaagtttcatctatgttgtagaataaatcagtatttcatttttaatcatggaataatattctattttatggatatgccatcttttgtttatccatttataagttgatgagcatttgggttgttttcacttgttgaccatgaatgatgtcattgtgaacattcatgtacaagtctttgtgtagacatatattttcatttttctgaagtatatccctaggaatcgagttgctgggtcatatggtaactctgtatttaacattttgaggaattgccagactgttttccaaagcagatgcattttacatttccaccagcaaaataggagagttccaacttttccatatcttcaccagcactagctattatctgcctttttgattatagccatcctagtgaaagtgaagtggtatctcattgtggttttgatttctattttgctgatggccggtgatgttgagcatctcttcatatgcatattagatatctgtatatcatatttggaaataggtctattcatatcctttgccatttttaattgaattattcattttttgattaagttgtaagagtttttatatgttctatatacaagtcctttattaaatatatgatttgcagttattttctcctattccatggattgtcttcacttttcttaatggtgttctttgaagcacagaacttttttattttgatagagttcaatttattttttttctgttactgctggagcttttagtgtcatattttaagaatcattgcctaatccaaggtcatatttacacctgttttcttctcagagtttaatagttttagctcttaaagtctttgatttttttgtgcgtatactatttttaagagaatttttaggtttatagaaaaattaagcataaggtgcagagattgcttttgcatcgcctcccccattatcaacatcccccaccagagtggtatatttgttacaaatgatgaacctacactgacaactcactatcacccaaagtccctaccttacattaggtgttactcttggcggtttatattctgtgggtttggacaaatgtataatgacatgtttccatcattatagtatcatacagagtagtttcactgctttaaaagtcatctatgtcccacctgttcatccctccttccccccaacttctggcaatcattgatgtttttactgtctccatagtggtttttcttccagaatgtcatataattggaatcatgtagtctgtagcctttccatatttgcttatttcacttagtaatatgctttgaagtttcttccatatcgtttcatggctcgatagcttattccattttagcactgaataatattccattttctggatgtaccacggtttaattatcattcacctactggaggacatcttggttgcccccatattttggcagtcatgaacaaagctgctatagatatccatgtgcaggcttttgtgtggaaataagttttaactcctttgggtaaatatagggagagtgatagctggatcatatggtaaaagtatgttattttgtaagaaactgccaagctgtcttccaaattggctacaccatcttgcattcccaccagcaatgaataaaagttgctgttgcttcacatccttgccagcatttgatattgccactgttctggattttggccaatctgtgtgttgcgtatctcactgttttcatttgtctttccatgatgatatgtaaagtggagcatcttttcatgtgcatatttaccacgagtataacttctatggtgaggtgtctgttaaggtctctggctttttgttgttgttgttttttagacagagtcttactgtgtcacccaggctggagtgcagtggtgcaatcttggctcactgcagcctctgcctcctgggttcaagtgattctcatgcctcagcctcccaagtcaagtagctgggactatagaagcatgccatcttacacagataatttttgtattttcagtagagatggggtttcgccattttggcgaggctggtctcaaactcctggcctcaagtgatctgcccaccttggcctccaaaagtgctgagattacaggcttgagccactgcatctggcctctggcccatttttaattggattgtttgttgttttatgttttaagtgttttttgtatattttggataacagtcctttatcagatatgcattttgcaaatatttccttgtagtctgtggctttttgtactactggcagtgtcttttgcagaagagaaatttttaattttaattaagtccatcttgtcaattctttctttcatggattgtgcctttggtgttgtaactaaaaaatcatcatcaaatccaaggtcatctcgattttctcctctattatcttctagaagtttcatagttttgcattttgcatgtagacctgtgatgcattttgagttaatttttgtgaagggcatatgtatctagattcattttttacatgtataagtctagttttttcaacaccatttgttcaaaagactgtctttcctccattgtattgcctttgctcctttgccacagattagttgaatagatttatgtgggtctatttctaaatgtgtattctgtttcattgatctattttgtcaattatttcccaatactacactgtcttgattgctgtagctttatagtaaatcttgatgttgggtagtgtcagtcctcaaaatttgttcttctccttcaatattgttttggctattctgggtcttctgtttctccatataaactttagaataagtttgttaatatctgcaaattaacttgctgagaatatgattgagattacattgaatctataattaatttgggaagaactggcatatggacaatatttagtcttcctatccattaaacatggaatatctctccatttatttaggtcttctttgatttctttcatcagttttgtagtcttcctcatacagatcttgtacctattttattagacttatatttatatttaagtattttattttggagggtactctgtcgcccaggctggagtgcagtggcacaatctcggctcactgcaacctctgcctcctgggttcaacccctggctcagcctcctgagaagctgggactacaggcgtgtgccaccatgcccagctaatttttgtatttttagtagagatggttttgtcatgttggccaggctggtctcaaacttctgacctcaggtgacccacctgcctcggcctgcaaaactgctgggattacaggtgtgagccatcacacccggcctctgtttttaatttcaagttctacctgttcatgctggtatataggaaagtgatggactttattatattaatcttagtatcagctctatcagctcttgcctcatgtattttgatgctttctgttttggaaggttattactgattcctgcaacgttgctgtaatcactcactagttttaggagtttttaatcaattcttttgaatcatatcatctgcaaagaaagacagtatttaatcctttcaaatctgtatactttttattttctttttgtcttttattacattagttaggacttccagtatgatgttaaaaaacagtgatgagaggcaacattcttaactttttcctgatactagtaggaaaacttcaagtttctcatttagagtaatgttagctgtaggtatcaaattgaggaaattcccctctattcctagtttactaagaattttttttttcacaaattgccattggattttgtcaaatgcatttcctgcatctgatgatgctgtcatgtgatttttcttctttagcctgttgatgtgatattaactgatttttggatgttgaactagccttgcataactggggaaagtcccagttgatcattgtgtataattccttttatacattgttgaatctgatttgctaatattttgttgaggatttttgcacctgtgtttatgagagatgctggtgtggtgtgtagtttcttttcatgtaatgttgttttctggttttggtattaaggtaatttgggtttcatagaatgagataggaagtattcttttggcttttgtcttctgagaaatattgtagagagttggcataatttctcccttaaatgtctagtagaattcaacagtgaacccatctggacctgatgctttctgctttagaagattattaattattgattcaatttccttactacatataggcctgtgcagattatctgattttttttttcttctgcttactttggatttcatttgttcttctttttctagtttcctgagggggaggtttcaattattgattttagatctctcttcttttctaatgtatgcattcaatgctatgaatttccttctaagtattgcttttgccaaattgtaaacattttgataagttatggtttcatttttatttaattcagaatattttcaagtttcatccaagatttctcctttaatccatgtgcaatttttgaagtctgttgcttagtttcctagtagtttgggatttttcagttatcttttgatactgagttccagtttaattctaccggggtctgagaacagacagtgtatgatttccattcctttaaatttgttaattttttatggtctggaatgttgctaaatgtttcatgtgtacttaagaagaatgtgtattctatttttggatgaagtagtctctaagtgtctattaaaacctgtcgactgatgatgatactgagtttcactatgtctttaccaattttctgcctgctggttgtgtccatttctgatagagagatgttgaaatgtccagctataatagtggattcatctatttctctttgcacttctatcagctcttgcctcatgtaatttgatgcactgttatgaggcatatacacattaaggagtgatttatgttcttaaagaattgacctctttatcattatgtaatgcctttctttgtctctgataagtttccttgctgtgaggttggctctgtctgaaattaatatagctcctcctgctttttagttattgttagcatagtatatctttctccacccatttacttttaatgtatatgtgtcttcctatttaaagtagatattttttataaagagtatagttggatcttgtttttcaatccactctgacagtctctgtcttttcaatggggtatttagaccattgatgtttaaagtgattattgaggccagccatggtagctcacgcctgtaatcccagcactttgggaggcagaggcaggcagatcacctgaggtcaggagttcgagaccagcctagccaacatggtgaaaacccatctctaccgaaaatacaaaaattagctgggtgtggtggcgggcacctgtagtctcagctacttgggaggctgaggcaggagaattgcttgaacccaggaggcagaggttgcagtgagctgagatctgcactccagcctgggtgacagggcgagactgtgtctcaaaaataaaataaaaataaaataaaataaaatataaatctactatatttgttactgttttctgtttgttgcctttgttttttgtttctatttttgtcttccactcttttcccactttttatagttttcattgagcattttttatgattgttttctctcctcttttaacacatcagttgtattttttaaactgtcttttactgattgtcttagagtttgtaatatacatatataaccaatccaaattcactttcaaataacactacactacttcctaggtattgcaggtatcttatgataaaataatccctgtctttccctcatctctcttgtatcattgctgtcatttattttgcttatctataagtgtatataaacatatatgtagatatatacatttatggatatatggtgaatagattgttgctattattttaaacaagttatctgttagatcaattaagaaaaataaaaggttttatcttcacttattccttctctgatgctctacttttctttatgtagatctgagtttctgacttatatcattttccatctctcaaaagaagttattttaacatttcttgcaaagtagtttcactttattcattagagccctctgcatattagtcatagttgttttaaatttctggtctgataatttcaacatctctgccatatctgattccggtgtgatgcttgttcagtcttttcaaactgtgctttttgctgtatagtatgttttataatttttttcttgctagctggactaatgtatggagtaaaaagaatgaatataagtagatctttagtaatatggtggtcaggtgttgtgggaggggaagaattctgtaattctatgattagttttcaatcttttagtgaacctatgcctcaggaccatgaatttcacatatgcttctcatttgccttcttaggtaggacgggatatgtggatatccagtttttccagcaccattagttataacaactattatatatatatatatatatatatatatatatatatatatatatatatatatattccagcaccattagttataaaaaataattctatgattagttttcaatcttttagtgagcctatgcctcaagaccataaatttcacatatgcttctcatttgccttcttaggtaggacaggatatgtggatatccagtttttccagcaccattagttataacaactattctttcctttttgaattgtcttggtacctgtgatgataatcagtttattaaatgtgagagtttatttctggattctcagttctattccattgatctgtctgtctgttcctatgcccgtaccagatgacttgcttactgtagctctgagtaagttttcaaattgggaattgtgagttttccaaatttgtttttccttatccaaatttgtgtgtgtgtgtgtgtgtgtatggctattctgggtgctatgaacttccttaggaattttaggatcagttagtcaacttctgcaaagaaggcagctagaattttgatggttttacttcattttacattgtcatttttttcctagcattgtcattatgaaaaggaacagtatttacttgtagtattttcctggttttctcttttcttttgaaaggccaatgagattcctatcttctcaagctgctccaagattatttaaatactgttgtcactatttcctgttgtgaaatctttttagccagttaagtagagatctttccccataattcccccaaaccaacaaaatattttgtttgcctctttgtgtttaccaaacaatagttttacccttatattaatgtcttagataaaagattgcaaggccttctaatgagagaccaagcatataggggtttgtgtagtagaaaaactaacagaactgataggtaaaatagtaatgtctacccaaagctccatacctccagggatgtaatttaaaagttttattacaagaaaattaagtgaaatgtattacttagttatttattattgtagtagtggggttatttcctaatttaccttaaggataatgttttaatgtaaatatctactaaatatagtaattactaaatatagtaatcagaatatgatgcatgtttatattgaatgaaaataaatgggatgaaataaagtttttagaaattaacatagaatggagagagtatctggtataccaaagcactcagtaaatattggttgaataaaggaatgaatgaaaggaagcccctacatgaatcattgtttttagagccgaggcccctacctcagggatgagtctagttaatctctcaattcaaaaggctaaatcctgcttttaaggtggattgttttttagtgttttcaattttcttaaaggataacctgagagtttcacatttttacagcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggtaagtttttattttgtttttgcaagtttagttaaaaataatgtggctggagttaacgtttgactaaaacctgaactgcttttaggaataaatcctaggtttactttaactgcagttgacttcccttgagattaaggatctggtaagctcgttgacagtgcatccgtttaggaaagaatatatccacttttgtacttattctatccttgattaattgctggggctggattagcttggcaggtggtccaaatgaaccccttgggcatccatatagctgctaatgagcacagatagtggagttagtatgatatgtgcagaaagattcttcttaaatattctgccactaacccactttggaaggaaaggatggagtacaataataaatctgaaaataaagcagtattgtgctatgatttaatgttctgacaactcaaattatagggaaagtccaagaaacaagagacaattccaagtgaagaaagttagaatcttacccataattcataaacataatatttctttccaaatcacattttaatttgcatgttaacagatttaggaaaatgtaaggtttcaaatatatgtaagatatgtgtaatattttacatatgtttgcatattttatattatatgtctgtatataatattttgatcctgttatctgaaaagcaggagagttgtttcaattctttgttttttttttcttttcatattaatgtatccaactgatgttttaattatttagtgatcttttagatataacttctgtcaattctttatgattggtggtgagtgaattagatctaagtttaaagttgacatttgaacaaagttattgacacataaacacaattatcacttcatgtcttagagagccagctgcatcctggagaacatattactcacattgcaacacttagcactccttgtggccttttgccttgaactctccttctcatgcctcttgtctcatggcctttagaaaaatggccttctttgccttcctaaatcaagtaaaattattattataggcaaatttgctcaattattataggaaaatttgttcaatcatggtgctaacgatacaagggtgcaggagactgagcagctgcaaccataacttaggttcctctcccagcatcatcagtggccaacagaccctaacaatgccattttacttgtggttgttctggaaaatgagtttatgtttaggactattacccagtctctaaaagttaaaaaatgatatactccttgaagatttttgtttatctgttaaggctttataagtggaaaggttgggaatttttattttttattttacatgtatttatttttatgccacatcttgccacaaaagatttcagaaggttaaataagattcatacagtaaacataataaataaaatataaaagaaatggaaaatcaggacctaaatttcaccccccaaaaataagcacaaggctgtgttggacaacaagccgccaatgtgcaggacaaaaataaatgaaattcatatttagttctcatttttaaaaaggaggcacatcaattccttggcagaaaacaaaagtttttactaacactgtattattaacaaaatttttcaagtggagttttttgggagaagatactgaataatgctgcaactaattctccccagcattttattttagtagcaaatgtagtagcaaatttcacatggctatatttttagtgtccttcaataaaaaccttagcataattaaatgcaactcagtgaaagcagctcaattaatgtggaggtaaattaacatagtgcaactgttgtagttttttttttttttttttttttttttttttttgatactgggatagaattaagtaagactgggataggttccatattccctagactatcttccataaaagttacttctgtcagctggaaggcagaaagatcaaggacgacacgtttggaaattgtccctcttttttttttccttttttcttttgctaaacttagaaaccatacgtgcatacctggttttcagccagttttaggtttggtaaaatctgcacttgagctttgccactaggaaataagacatttacatggtagtgtaaaggactactgctttagaggaaggaaactgaaaaagaacaactacacgtataggcacacacgttaaatatgtacacatgtaaatgtatatgtatatatgttttaggaagaacatagaaagtagaccaaagtaaagcctttattactttcatttgttacattccctacctccaataaatacttgcaaattcaagaggtgataaagtaattggaaaagatggctttttagataatttgtcaaagaatgctttagtgtatccagatcttaaaatctcataatgtttgcaacgattaatttgttgtgtaattgtcttcttttatatcaggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtgtgagtactttaaaactaataagataattagagatcctgctaagataacaacatagaagattccattaaaagcaaagtttcatttggttcataaaacactttgtaaatgaattgaaattgtgtccaaactgcaatactttattcctttaaaatgaattaaaatagttttgagtctagtaaatcaaattaggggatataattactttattcaaaaattattaaggctagatgtaaattcacactggcaaaacagtcccaagaataattgaggctagatattttggttatacaagccatcttgcatgagcagagactgcagaatctactgacatggtaattgcacttaaaaaaattgtgttagtttgatcagaagtgatggtcaaaactcttgaaatcattctgctgtcaaacagggtaacacaatttaatgtttaaaatatatttttaaaacccaacttaggagtaaattaatgaaaataaggtataatttgagtaacaagtcttcacttcatgaatagttagtaccttcaggacatctatgtcaattaaggtaatctcccaagattatctggaagtcagggcaacaaagcaaaggataaaaaattaataaagcagcaagtaacaaattctttcatttttacatgtagcttgatttcattatgtcatagaatttatttcaatcaaggccttgattcttaatctccatttttttcatttttctatgtgtttctcatcagtattccatcgctgtatgtgtactcatccaagcaatgtcataaacctggtggcaaatgctgcctggttgcatttaatagtgacaatgtcagcatttccacatcatgcaagatcccatgagcatatagtcttaatgttccaaatatcaatgctattatttaattcataaattttgttttgtttctagggaaaagagaaacatgcaaacaccagagtaagtgtcttctttcctgttattttcttcatcattttttcccacctctcagttgcccatcatgctccatacatgtgtgtcaagctttttttcatttgtcatctttcatagtttatttcataaatgtgaaagctgctttctaaatagagatatttaggaggggtagaaactaaaactaaaaagggtttgaaaactaagattacacagataaaaattaaacctaaaatatttcagattcagaatattaacttaccatttatattatgtgatttccaatctgcatttctataaaccagagaacagatgaaaagacctttcatacaagttttccagaatctacagtaataacctaccataaaatgaaacttctgtgagtatttataaatgccccaccagaagcaaaaatataaaagctatggtagttttatcttaaatcatagaaaataaatagaaaactagttggttacttaggacagtaatattaatacaatgcttcatagcttagtttaataaaacacctatgtattttaaaatcagtttataattttcagttttgttatattaaaagtatgtgagatgtatgcctttctgaaatagtttattgaatgcccaaagtgccataatgtcttattattttaaaagataaaaatacttcataagtttttcaaattgatgacccatcaggctaatatatgattttaaatatatgttgttttatttctttttgacctagcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagtaagtgtccacttagagccataattattaatatgcatgtatatttttactaatatctgtaaagaacagagctttctgttgttgtgtttgtttgtttataactggaagagaaaataacaaaaggacattgtgtaaatctcacccctactctcctgaaatatacaatacaattacttttaggaaatgcactttttttcccccactgatccaaacaagactacatataccttaatatttaagaaattgacactgatattaaactcaacattacatgtttgctcaaagatgagttaattataaaaaaaagaaccatatcctaagcatttcaaattgattatttttagagatattagaattatttggtttaaacctattaaaatgttattaccatagacctttgtaatctaaatttttgcctcagaattaagggtgtttgggttgttttttatgatctgcttgtatgtcagagcaagcagctccaatttggactataaacacctattttattagtgcaaaccttgtctagtgctatagggatcagggttagaaaggctagaaggactttgtaaggagtagacaagggtgaggggtgaggaaactgtacagttgcatttgggagaccatgctatataatgctgtaatgcagcattatgctacatcatatattgctgatataatgtagcctagtggccacatttttatataagggaatggtgggtaaaactgttatttataagaatatgtctctttttttcttttttttttttaagatggagtttcgctcctgttgcccaggctggagtgcaatggagcgatcttggctcactgcagcctccgcctcccaggttcaagtgattctcctgcctcagcctcccaagtagctcggattatacgcacctgcccccatgcccagctaatttttgtatttttagtagggatggggtttcaccatgttggccaggctggtcttgaaatcctggcctaggtgatctgcctgcctcagcctccaaagtactgggattacaggtgtgagccaccatgcccggccttttttctttttaaccaaatgttaaaatgagttgaattcaattgccctaagcactagaagtcatgaagttggcttttgaggtcctcctctttttcactttacttttatagatggaatggctatgcagaaaaatctctctttctcactctctcagtctctctttctctctctctcatacacacagacacatacacaccccttaggatataatattaaagtgaacacatttacctgggaactctgctgggtacatttttcccattgagtgcttattctgtaaccaggtagaatgcatgtggtaatttgaagattaaataataattaatataagtagtatagatagactagataagtttatccagaatacttcagaaacccaaaagtattatgaatatttttctaaagttctctaacatcacttagggtcatacagactaaggtgcctgtttatgtgcatgtgtgtatgagagtgtaagtaatgggtagtgggtaatttaagaaatgggtgaaattgcatatgtttacaattttgaatttttgaaacattaatatatcagggatataaatattaaagtctacaaaatttagttgtactgaatgcaacggatgggtttctatgctctctggtggtcagtagcccacctattatgggtcatcataaaacccagtttaccgggattagatactgatgagaaaaattggtaaaatttcaagaatattgtaataattcagaatttaacaacctcttatccctttttagatgaaaattatgaaatggctttatcattcattttcaaaatgaaaagaatttgtacttattctttaaggttattatttctgatattgtttaccctagcgtgccagtgaaatgttgacagatatccttcaaaaaaatggaatgatcaaatacacttggaaaaaagtagtagcaacactgcagaattctaacatgaaacaaatcctgtagctaaccaaattgtttatgaatgatgaattcagtatacttagtatgaatgtgaagatgaaatgcatgcccttttaagaagggttaattaataagtacaaggcagcattatccaagcatatacctggttatcgagtactgtaacgtaaaggttttatttctctgttttttaagctacaacagtcttcagtcccttagtgtgttgatacactttgtgaatccataggaaaaggtcagaataggtaactcttcaaagaacacagtttgagaaatgcttctgttgataatgtaacaaacagtgctgtagaattttagagtagaaaactagttataatgagtaggggaacttgaatatgtttgtaaatcaataaaactctattgctagtgaaatttaagagcggaaaaaggttgctgtcattttaagataaccctttctaaccacatatattgaaaataagaatagctccttaaaaagtattttgattccctgtggttagaattttgcaatgttgctactaatatacaagcaaaataaaattttctatctagtttacaccaaatggatctttctggtccttccataaccccatcaagactgtcattaggttgatcagatctctctatttgcaaatgcaataggctattatattgaacttgcaacaatttaaacacatacgtatttttaagtccagaaaaccttcacattattcagatttctgctaatggaaaagctccattaactagcacttctatataaatagggtacacagataattgatgatgttcacaatgattattctgaggcactgcaggatcatcaagtgcgtctgactcatcagaggaaaattaaattacattcggtgtcgtttcagtgttgagtgtatattatctttcttttattcttagaaatggataatatgtgcacagtctctatggtaactccctataagccagaatatgtgattaacctcattttccagccatgccagataatagggaatttattgtatggggttcatcatagctgtcctttatgcaaattcaacttttactttttaccagaaaaacagctatgttttaaaagttttacttcagcactgagtagacacacacaaatattttggtcatttggattgaattgaattctcaagattaaaatgtgatattatattttgggaggcattacagtactcaataaccaggtatatgcttggataatgctgtcttgtacttattaatttacccttcctataagggcatgcatttcatcttcacattcatactaagtgtactgaatttatcattcataaacaatttttagctagccaaaggatttcatgtttattcttcagattgataccggaaatattcagacatggatatggctaaaggtttatattggcttctaagcaagactcaagaatattcaaagctttctttcaaaactgcataaaactagtttgttcctttaaacaagtcaatttacatcaaagttatagagaactcacaatgttatgtaatgaatggctgccaccattatcaattacatagtaatattttctttttggtagaatgtttcacagagctccagactggcaccataaattagtcagtaagaaaaaatgtttaatcatttgcagatgataaatttgagacactgataagagacaaagttaaattaggtcagaactgagattagattatttacctatcctgatatctaggcagggatagatagtgtcggtcattgacctcagaaggatctctgattcaggttataagcaaaatgaataaagaggcagtggacagggaagctggagcagaacctggagatgtagcacatgcctagaaatgaggtgtttcattttgtactgtgtttcttttgcttttcaaattacagagacaatataaataggctgttaaaactatcacatagtctagaaatgtaaggccaacttaatttgatcttggctaatgtgtttattctttaataaactttttattttggaatgattgtagaggtacaggaaagttacaaagataatagagagttcccagatacgcctcagccagtttctcccgttgttaacatcttacagtaccatggtacatttgtcacaatgaggaacccagtttcggtactttactgttacctagacttcagacttttttcagatgtcattcgtttttccactaatgtcctttttctgttctaggattccatctaggacacaataatcactatgtctccttagtctcctcaggtctgggcattttcttagacctttcttgtgtcccatgacctcgacagtcatgaggagctatagccaggtattgtgtagtatgtccctcatgccctcatatagtaagtttttctgcatctgtacttagttatctttgtagcctagtgaataagtgttgccattaatagcagtaataattttttcccctatagacatttgtcttagttattaaaattcattcctggaaatcacattgtaaagtaattcttaaaagtaaattgactttgcccaaagaatcattgttgtgactggtgttatgtttgtgaccaaagacttcacatcaaaaatctattacgtatttgaccggtgtacctcaatgattgccctttctaattatttaaatgaaaaaaatttaattccaagtaataacattttaggtcatcaaaggaacgtcaagagagagtctagccttgttcccaaaccacgttgtgtcagaatcaccatagagcttttacagtacacattctggggctctgagtatgggaatttggagtctggtggaagtgtatgttatggtagagctcctgcagagagcttctcaacaaagattgagaattcctggcttaataatcaaaagacttaagtttcaggattggaaaatccagagctctgagtaagaagggttgttattcacattcctctacatggagttttaaaaggggaacagtttttcctaaattcccccatgtgaaactgaaagaatagcagtccatgcacattgtctaggaggttggagctgtttgggagtttatacttctcagcctctagactcttccatacctccttaaactgcctgaggaaaatggtgtggagaggttgagagatgagagctaatcagaaaacagtgcctggaacagctaaaagccattgaaaaaatgttattttgtagtcttatgcttggggaaagggacattgactggaggatcccaaatatttgattttctaaaaaataatttattattatattaaatttgtagtgaggtatgctgtcttttggggaaagatctgcctcttcactactcttttcttatgccaacatcaataccaattgatttttttggagtggtaggcatcttcatgaggccccttaggtaatgaataattggggaatagtactccacacatttttcaggaagatattaatttgctacacaaaaattttccttattcattattctaaacataattcctaatccaggataattgggtctctctcaaaacaggagataggttgtacttaatcttttgaaaattaacaagtataaaagtagaattaagtcttctaattgaagacagtatctaatcattttagcttttatttaaatatttttccatttgtcctgcttttggtcacaatgacaactaactttatggtaaaattccataaataaaaattaagttttaataaaagttaatatcagttgaagacagtgtttcaggggactaagattatggtgtcctgttgagaagtatcaggcagccaagaatatttcagagccattgttttccaaaaatatataactatttcttattgttaaatgatgtcaccatactaactgaaaagtgaaatgttttgtatttcacacaactagtgtcattttctttgaactctggcatggattctgtggctttatgcaaatcatcattttgctttttagtttgaaacaagtagcaatataatcagttgataatcatcaaccttactcacagaattacggtatagggtatccaagaatgtcaaattactttaaaatggttgtacacataagaaataattgtgtactccccccaactcacttatttattaatttgcaagttattactcttgcattcttaaagaatgaagtttgtgcaatgactaatttacacaattttctatttaaatgcatgaaattaatgaacataaaatgagaaaataattaatgctaataatttagttacagttttcttaaatttctacataatgcagtttacacataataacttttcacttagtctaataatcattaaattgttttatgacttcattaaggtccctccttggaaggattatagggcctctatttgaagtcgaccccccgctcctgtataattgcctttagcagcctgctctcaccaaagatgagaatttgccactttcttcctgcattctctgcatcttaactagcagagttgggattgaaggcattttttccagtatgcctgaagcagtgctgttataaagtatgtcccttcaactcttaaatgaaatacacagttttaaatatgcccatcatagatacattcacactttaatacttacaggttcacatttagttacaagtttgggaagccacaaaaacagagctatgtgcacacatcttggagactcaagggtctccttcaaaacaggagataggttgtacccaatcaggggatgttgaatctcagtatttttttggttgagcacctttttgcgcacacaagcatttttaatataactcatctaagtttcctttgaaactgcaaggagtgcatgagcattgttcaaacacaaccacttagaacacccactatggatacttttcagtctctaaatcaatataagacacacagttgctttcttatgcatcttctccgaatttcttgctagtttgtgtgtggcatttttctcaaccagccatgtcttttcacctagcccagcccattgtgatttagaaagtttagcaatgtagcaaaagaggaaaaaacggaggctagaaaagaaacgacagggcataggttgactttgatcagtggtttccaagctaaattccacagaaaggtcagttgggagggccaacaagagaagtggggggcatccaactacctcatccaaatgctgattttgaatttggaggatccttaatctagtgcttttggaaaacatgtgtctttgtttactaaccactacctatgttagaacacctacattctatattttctttatcctgtttgatttttgtattttgtcagaatgtgttgattcaatctgctgacaggctaggtagagctagagatggtaaggaatgaggaagtgcttgtgtgtggtgtgcgcctatgtgtagaaggtgcactgtgttcgttttgagtgtagaatagacccagatcagttatacctgagtaggtaaaataaaacacatcctcccaccctgtgtgagatgcccatctaattgcattttgacttctgtagtaaagatatttgccttgccatctttaaatgtagaacttattccctctttgtagtttataaattgatctttttacttttgtgaccaaaaccaatataaatacattgtgtgaaattctgaaagaacaaacaagctaaaaaagaaatactcctctagcctacacaaggataaggctgataagtaacaataaaaacgaatataatcgtcgggatgaattattaagtaacttcctcaaattgtgttagagttgagtttattatttccctagtaatatctttaaagtggaactgaaacattaaaaaaaactctcaaaggtgttacctatagattaagagtttaaacagcatttaactagcacgcactgttttccactttagattgttgtatttggaacataatatttgcctggctgaaataattcatatcaatggttttcaaactgttttttacagatttcttagaattgctgtaggggccagcatgagggacaaagaaaacaaagctgacaggattcctaactcccttgtttcaacccaggcaacctcacatttatctcttttgtacatcacagttctgcttagggtttcaattaagaggaatcccagtgctaaagagaaaacaaaaaactgaaaatccccagcttggatcaaactttattacaaaggactgactcctggagtttcttccatacagaacctaaattgtacattttcataaactaattttagtatcaatatgtgaaactaaatctgtaagttaataaatgtatatactttataatgcttactgctgaggatactaaacaaaatatgatggttcttattcttaatatactttggggcaattaaatattatatacagagaatacaatgacaatcagcatgtgaatgaaagcatgctaaatggtaacctaatttgtgggttgcttagagagtgaggatgcataggaaggtggttcttgagatttttttaattaaaaataatatgttaaaaattttaataacatttctcatgggaatttttaaactataagagtaatacctgtatgctgtaacaagttctgagttgagttagcaagaacaaatgggagctgattgtgtacaggacatggtagttggttgttggcttcaagcagacatggggcactccatgtaggagtgagatatattgtggctttccaggccacattaagaaatctgaaatttaatctgcagatagatacaaggaaatattgaaatgtgtgttatttaaatgacataatcagatttgtgtcttagaacagtggtccccaagctttttggcaccaggaactggtttcatgtcagaccaggagtgggggatggtttggggtggtccaagtgcattgcatttattatgcactttatttctattattacattgtaatatataatgaaatattatataactcaccataatgtagaatcagtgggagccctcagcttgttttcctgcaactagacagtaccatcagggggtgatgggggacagtgacagatcatcaggcattagattctcataaggagtgcacaacctagatccctcgcatacgcagttcacagtagggttcatgctcctatgaccgtctactgctgccgctggtctgacaggaggcagaacccaggtggtaatgcaagtgatggggagcacctgtaaatacagatgaggcttcgatggcttacctgccactcacctcctgctgggcagcccagttccgtgtcccaggggttggggacccctgtcttagaagattattctgacagcaatgtgcagagtggattataaggggacaagaatgtaaatgaggaaacaagtcaatccccttacaaggatccaagtgagaaatgatgatggcttcaaccaagttagcaatggagatggggaggaatggggcagatccaaatgagacaaaaagaaatgtcaaaagtccctaagtgattgaatgtggggactgaaggagagggaaggaacaaggatgacttctgcattccgccaatgcatctggatgcatggccagtgtcattcctgacacgaagataaaagagcacagatgtttgggatagtgaatgaaggtggttatatatgttgttccatgaaaatgtgtgatctggatctgaaagtgtataggttaagagcacaagccactgtgttcacatctttacctaccatgtcctagctatgtggccctggatctccaaggctatttcttcacccataaaatgggaaaaatattaacacctacctcttagggttgttgtgaggtactttagagtatagcccgcagtgaaaatttcatgcatgttatcaaatattgttaatttttattctcctcagacctcagtttcctcatctgtaagctcatgaaaggggaggggaattgtgctggattacatgactggggtcatagtttacccgtaaagtttttcattctagtatgtctgctctctgtttacaagtgtgtaaacaaacagttttactcaaaaatgttcatcatttctaggaacttgccacatcagactcagattccccaacagcagactacaggtgagtgctaagaataataaattaatgtttatgaatgaatctaatagattaaaagataattatggcactatataatttatgaagctttatcttcaccaaataaggcaaaacacttgtgtcattccttaatcagacttaaaacctcagaataatagcttagattattacatagattggcatcagaatgataaacacagggtaaatgatcttagagcaaaagcatccatggaggtcctgtctaattaaggaagactgaatgaaacccctttccttcagtgaagttccctattcttccccttggtatgaaagattcttagcttggatgcatccaggatttgtctcagtaagtgagcagcttgaagtttcaagctctcttacaaaaggaaaccattgtgactaatcactgaggcttcagggggataaatgagaaatggctggcctggttttaaagccgctttaaaaagctgttataacatgaccaatgacaacaagatggcggacaattctccttggattattctatttccctaagacttgctttctttatttctttcaagtgtccctaaaaattttccacagccaattatttcattcatctctatactgagtagataacttattcatgattgtcttctaattagtggttgattcctagttctaattgccagggaaccattaatgcctttgtagctcttttggaaaagcaagagaagttttaaaaatgtaagttgggtgtggaattctgagtatgaatagcggcattgtggtagggaaactattaagtaagtctcttaaaaacttcaggcacattcagaaatgtgttggatgttttcattcagaaattatcttctctattactgctttcgtgaatttaaggagattttcgtttgacaacttttcaaagatttgaggcaagtataatgaaattgttcatcagatttcaattacaagatgtttatcagaatttttccctacaattttgattacttgctttaattaaatgctaacatgtttcaacaagactgttcaatatattgatgtgttggtgctactttgtaagcattcaggagattgatgaaggaacaaactttgttataaaaatgagtcacctaaagagagaaaaaagataaatgaatccctactaccactaatttcacagctattttttaaaaggaaaatttctaaaagaatacttctacgatagaaatgatagaacttcttcgttattaaccttgtagcttccatctcgcctaagatttctatcttctgattcttaattatttcaggcatggagtgagtaggaagcaggcaatttctagaaaaacagtaaatatttattttgagtatttaaaaatccagattttacttacttacccactaggggaattaggaaacttgagtagatgatattagggcaatttgtttagtagtcacatagattttttagcaagtactcttgttaacttgctacattttagtaatacagagcacttccaaatacaaggacaatttatgcctaaacaaatataagagccaaagagttttcctaggggattttaaggttgtttaacctaatttataaaattatttttctgaaacagattttagggagcaggtattttgcttgagtcaagaaagctttgctctcctttttagttaacactagagcctattaccttcttgttttcttacatttttctgcaatttggatcatattatagactaaagtacagtatctcctcttggttgttttgttgttattgttttatttagtgagtccccaaaatatcttaagtgccaaagggagagagaccaccctagcatttttttttataattatgcaagattggtgtgtttgtgcctctggtacatttaaaactaaatggaggctgggtgcggtggctcacacctgtaatcccagcactttgggaggccaaggcaggcggatcacctgaggtcaggagttcaagaccagcctgcccgacatggcgaagccctgtctctactaaaaaaatacaaaaattagctgggcatggtggcatacacctgtaatcccagctacttgggaggctgaggcagaaaaatcacttgaacctgggaggtggaggttgcagtgagccaagatcacgccattgtactccagcctgggcaacagagtgagactctgaatcaaaaaaagaaaaaaaagaaaaaagaaaacctaaatggaggcatgcctcctggagagaagggctgatgggcagtttacattccttatttccattctgttcatttaaatgaaaaagtttatttctcaatttctaaattcttctatctgaaaatgcatggatttagtgctgtttatatatttttgtgagtacggcagcttttcttttcttttaccctgattatcctaatactgcatagaggcagctacatttatgcatgattatcatcaaacagtaactggagttttccaagtaccacagaacattatgcacatgtcagttttctttatgaaggtaatttaggcacaagagtttgcgtcttggataccaagtaattttatttgtagctacctatatggaatttatcaggggaaagtatatcttgaagttgttggtttttttttttttttttttttttttcatttagttccttgttttcttttaaattcctatcaaagctttaagaaatgaactagctgctggtgttgtgttcctggacttgagcactagctgggataatagagcagttaaaagctgacaattgcactaacttttggactaggcccaaaccattaggtttgatgccccttcaggttttctcattttctctgccctaccagcccacatgatatttttttaaaagccacgattaaaaggtacagttatacatcctgcagttaacctccattctttttgtttattgtgggaggaattttcagactgtacctcttgggaaatacaaaatattatagctttggtccaagaaggagaagactaatttagaattttttcttttgttttctgttttttaaaaaaaccaaatacagagaaataatgcaatgtaattattttacattgtattaagaagatggaaactttctccttgccataatttgctttgctcaaaatctaaaagtatccatgccctgactaactcctgcccatattcattcttacacattgcaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaatgactggtgaaatttacttcagtaaactatttgcttcctatttagtagaaatcttttaatcgctagaaacaggtttatgtgttcattctcattccacaagactttagtgcttcctatgaatatataaaatgcctgtgcctccgtgttccagttgagcaacccatttaaataatactttaactcttgtggcctgtaaatcctgttgttttatataccacttgggagtgttttcgaataaacctagttttatggattgtgaaactgatgacacccaattcatgcagggcagcccacgctgcgtacttacttgacttcataatcagatatttggtgggtttttttttctacagctacacctactggaatgggaggacatttggatctagaagcaagacaggagctgttacacaaaaagagaatagttactgctaatgtgacatcagttagctccaaaaccccagagtaccttgcagtaactcttttatgttcaaggctctcatgcatcttggatactactggatcagtgtggctatcatgtcacctggcaggacagctttccttgcagactggactagctggaaaaccttctcttaatctactttgggcaaatttttgtgtcacctattaggtgcccagaggtcacaaaaattccaaaatccagaaagattccctgttaatgttaggtaccgtaacttgttttccacttagggagaatactctgtcatatcattgacattagaacctccctcttctttctaggacagaggatgtaggttctcttatttcttaaagatgtatctctaatttcttcctaagttaactagggcattgccacttgctgttctccaggagtaatcagcttgagattgtaaatgtattgcatcagtgtcatggcctaggaggaatgcaatgttgtcaaggctccagaggaccagattttggcacagacacagagtaaacaaactgttgctcttaccaggtgaaatcaaactgctcctaatagtccaagtgagcaggaataaagtaatgcacaatcgacatatcatggacaacagatgagaaatcaggaactttattcatctattctagtaaagaagccatttggagattgcaaagtgcagttggaattagcattggtttttgcactgaccatattgaggtattgaatggggagagaaatcattggccagcatcttacaaatctttaataatagctttaatcgctgcagttccccgtgaaaaagtgatcttgtttctgacttaacattttgatggggaaaagagtccagataatttccccttggttgatgctaccctaatagtccttaaggactattaagggtttttttgttttgttttgttttgttttaacaaagtgaggattctgccacatgctgaggactgctatcccaactgtactctcctagtgggcaaatgactatatggtaagttttgggtcctgatggtaaacttaaaacaccttttcagttagccagcataatcccttgatctaaaatactgactgtagtggttctgtacattttcagcaattccagtaaactcagatttagattccaaatatcccctaaaagtttgtggcttttccatcctccagggtatatttacccatacacatgacagcctctctttgaggaaggtctaggttcaatttccacatggtgtgtacctaaggttacaagatttcccaggttccaggttccacaggttccatgtctataaattggttctttagaattgactaagggaccatgattcttttaaacattgaccttagtaaggccttctcccaccaagcttgtgtgtttatttctatcccccttcagtacttacttggaggctacatcagtaatggtactgggcagtgagcaacaaggaattgttgatctttagacagaagtgccaatggcagtaatgaaattgaaagcccctaaacatttatttaggtcaaagtatgcattaaaaattcacatctgtaagtct

SEQ ID NO: 17513 - DNA, 121049 bp, Human
aggccttggccagcccagaaaggggctcccacagtgcagcggcaggctgaagggctcctcaagcgctgccaaagtgggagcccaggtagaggaggcgccaagagcgagtgcgggctgtgaggactgccagcacgctatcacctctcaataccaactctgaactgcccacatttagattccagagaaataaatcttaagctattgtatttcgcattttctgccacatgtgagcagtgtttatcataattaatacaaatattatcacaaatttagacaggtgatacacatgcatcttagattaccagatccgtaaaaataataatgcttacacggtagagagtagtactaacattgtgctccaaccggtgacatgtgaggctcaccatattttataaaagtttaattctttttttttttttttgagacgaagtctcactcttgtcccccagcctggagtgcaacggcactgcacgatctcggttgactgcaacctccgcctcctggattcaagcgattcttctgcctaagcctcctgagtagctgggattacaggtgcctgccaccatgcccgctaatttttgtatttttagtagagatggggtttcaccatgttggccaggctggtcttgaactcctgacctcaggtgatccgcccacctcggcctctcaaagtgttgggattacaggcatgagtgagccactgcgcccggccaaaagtttaattcttaaaatgctcgacacaattagaagcacttaactactgtatatttaaagcaacgtaacattattactataaagttgttaagaaatgaaaatagagaaatacattggctcatggagtcaatacaggatgcatcattaacaaagggttaacatcaagatccatttttacaagagggactagttcgttacatctctgatttctagacttggagtttccccagtcatgtgtttactcttccgtgggtgggaagataaatcagaataaccaagtgagcttgctcttgaaatattttatttacaatgatatgataattgtagaaaatgaagtatgcgtacttaaatagaatttaattgacaaaagacaattttctctacttcaaaattgtaaacatttgcaaagtaagcctcatttcaaagtcaaagccttctactttaaaagcacacattagtaattctatttttctttatactgaagtatttcaatttttggacatacaagtcaaaaatcattcaaagcataaaggaaagtttcaaaataataagcgcctcatcctgcactatcctatttaaaagagatcaactaactttgataggtgcctctcaataaatggtgcctttgtctcaataaatagtaaatgcgtggagtgcacaacggaatagcatcagtaagacgaaacataataaacaggatggatcgggaaaggctggataaaatgtggggaagaaaaagaaagacgtcacaaagatggggtagcatttctttgtccaaaagagaaccagtaccaccataagactttaaacaaaggacattagcaacacttatcatgcaactagattctagaaggaaaataaaatgccactactaaggtggaggctgaagtttcaagacaaatctcctggcaccacctctgcgggggttcaccatggcgaatgacgcctgggaagcggggcgagtggccagcccgctcctggacgcgcggacaggtggacacgaaggcggcctcgctgggcctccctccgcctctcccggcccgggcgcgcagccctgcggtggtctgacaggcgggtgcgcggcgccagccagcggaggttgccatggtttccgggggtcacgtgggcgcgctctcctgcgccccctcccgcgcaccgcggcggggcgggggcggggcgcccgggcgggggagaggcgcggccgcggctggagcgggaggagcaggagatgctgccagccctcccggggccgcgctcgctcagccgccgccaccacacggagcagacgcgcgccgggagccgcgggccgggccagccgggccgccggggcccagtgcgccgcgctcgcagccggtagcgcgccagcgccgtaggcgctcgctcggcagccgcggggccctaggccgtgccggggagggggcgagggcggcgcccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctttccctaccttcccatctcgcccaccccctcagcatccatttctgtctctcccactcgcccaccttcctactccgctctctgtcataccctcttcccttcctctagaggtgggagagctgggatgttacgcttccctcttaccctttgccccctctgcctgggccggttggggtgggcatctgctagaaagacaactttcgctgtggttggaggtatttcgcttagaggataccattgtgcataaagaaactggcccgcttggcgtcttctttcagcccttgtatttattaatggaatgtcgaaagagaaaaggagaaccgtgtttaatatgattggctttactgttgttaggacggtagattcgctaaaagaagcatgaaattggactcactggggcagaacaaaatttatggccagtagctctgacattcttggaaataagagttatctattattttccaatttaccaataccgtgttgtgttatttttggacacgtaacaaaggattctatttagtctgaaacccacgggggtctttggaacgaggaaatgggttaatggtttgctttttatataaaagacatattgaatgatttggtgctttatttttttaaaagtgtatgagaaaaacactgtaggaagttctgaaagcttgttggttgtctttataatgaaaagccagtgagtaattgtaaggattgtgccagacagtagagctagaaagaatgaatgggaaagaaaaaggaattttctcaaatagctgctcctggcaagtcccaccccttctgcttacaaccctctttccctaacacacccagacacacaccctcatttacagccccttgtattacacaacatgcccaaatctcatttttatggcaacccaagctaaaataccatggagtgcagtgtgcaagtgttttctctttgtggtgtaaggcaaacatgcatgcagcattgcaccagcttttatttatttacactgcttgtggtttgtgtgtccgcagtgtatttcataaaatgaaaacatttaaaagtgtcatttcatttccttgtgtatgctcctaggaagatgtttcttttctttgcaggattacatgttgaaatggattataaaattagtgtatttttagtttgtccaaaagaatcccagaaaccctggaaattagtgcgctgtgaagataaaagtgaagcttgttacttacaattttaattttggacttctaaatgtttccccaagaggataaacatagtcttaataattctttttgcacaagaatcgaatcaaaagcttttcctaccagaaacgagaaagagaaaagaatgcatgttttaaataggtaagaagcagcagccagtaacggatgacagaaagggcagagatatctaatacttcttttatgctcctgacatgttcgtgcacacacacaaaggggaaaaaaaggactcttttcccaggttggagaaaactaggaactaaggggcttggtaaagaccatatatatatatatattctgtatgatatgttgttaatataatcaaaatattttgtttgtataatgcatttgttgaagtactttgcattgatgattgcattttctccttataacaatatattgcgcacagaaaagattccattttcattttgtagtgaagaaataagccgttaacttctgaacagcaggggtcattttatatggctttatattctccaaggcacctttgctgtaaaaattgctcagtgtgacttaaacaagttaaacttgttaaacaattgcactatttactccctagcctcacccccaaggactttaaaactttttgactgcaaccaaatacaatttgatcattatccaggaggcacatacatctgtataacagaaactttggcaatagtacaggtacttccttctgtcagatgcagtgctttttgatatttcctatttgaatcagttatttctccctattttaaattgtattgagacctccagttgaaaaacatttaattataggctacaaagtgattggcaaggtttcttgtaaagggccggttagtaagtgttttagacttagggcaacatgtggtcttgatcacttcttcttcagtttttttttttaaacacatacaccttctgagggttgcggttgtacaaaattagctgcagatcaaggccatagcttgccgacccctggttagaagaaaaaaaaaaaagtcaaaatagtaccattgggggaaaaaacaggagtgatcctaaaaagtatgagcctatcagtttgacatctatgtccagaaatgtgtctcattagaaaagaaccccagatactgggcaattctggcatagtaaagaataaggattggaaaacaagtcttaatttactatgacacagcacaagacctgctgggtcagtaattctgaaattttcatagatatctcaaggaagtttgattcagaaatgaccattaccctgtaccatttttggagagcttttttaaataggttgagatgggacatgatatccttttcttccccctcagtagacatcccacccaggtcattctgatatcaatagttccatgactgtactttggaaaacattaacagatagtgataatactatattcttcttaacatttaaaacataattgccgttagttgacaattgctgtgtgctgtctaaatgctttaatttttttgtctcagctttatgagaacgataaggccatcacttgcccagtgtttcacgtgagctgcaaaatcaagattgggatacaggtggacctggcttcatccctgtgctcttgactgcccgattctatctccagatggggctggggctagcataacctgagtatcccttatatgtcaagctctatttgggacccttaatgtgttttattgttaaagctctgaaaaattaacttgtccaaggtcacacataaaacgagtaagtagggaagcctgatttcttactcttatgtatctaaccttgaagcccaggatgatcagggagttcttaaatggaatttgttctgtgggctgactcacaagtcaggttttcctgtttttttttcttttagtaatgctgatggatttgcattgttggttcatatcctctcttgtgaatgtctttaacgtaagtgatggtatttatgagaggttggagttaaaaggcaagtttttgaccatgcaacttgtgcccattgacaaacgtaggacaaacgtagggatcaagcatgtgaccttgaccttataatgtggtggtttaatcaaataagccaggcacctgcagttagctggaaaaaatgttgtctggccaggggtcggtgatttttgagggtcaggtggtgtggctgtaggtggcgctagagcaaacagtcagatgggtgaaggtcatcttctttcctacctttccaaaggatcccttcctcttctaatagctttcttttccctctcctattctcttccagtcttataaattctaattgttactttccatttgctatcaattctggtcgaaagagcaagctttagatgttagaatgatagtggcttatggtgaccctttctagggaaactctcaaaggccagaaagaagccataatggaaacctcttggcatctactctgtctccctcttccccgtcctagagaaagcaaatacagtttgacatgtcatgtctgaaagggtagcatccctaggccttgaatttcttagaaggtttacggtaggctatagcattgcatcagtactagtttggagtaaaatctgtggtaattcatgattttatataggcatcatcaagagatcttgtgttgccccataatttcttcagtggaattgctgaaacaaaaaatgaagtaaataccattcagattactctgataaatggacaagtggtcagaaacaaaattaactacacatgggcacatgcagagcagtcaacctgggagaaaaaataactaccgtgatagaaaataaagagctgattttctgagttatagaagaaaaagatctagagttcaaagtagatacacataccaaaaatatagactcataccccataagacaagcatatcaaaagtaataaatagaaatttaccatgtaataactgtggcttaatcctcttaactctgtcccatgtccagtcttgttggaatcttacctaccttttggtttttacagttcaaagggaatttggagaatttacaaaacatccttaaggtcaagcaaaatattgtaaagtttatatcattgatataaaatcttacagagttatatacttttttttttgcagaatagcaatttcattgtgttttatggaaatgaatccagtattgcacttcttggcgaggtgaagcagggaatgagcttatgtggcagttttacttaggatttaatgttatacagtaataaaatccatatcttttcagctcataatttgtagctaagagctccaggattttgtaattaatgagactttatagtttttggctattagagatttacatggtggttttaaatcctcctgaaatggattaaatcattcatgacaatggctaaaatattgaagccattattttagttatgagcataaaacaatagtgtcagaaaagataataaaaattattttgagttagagatagtgattgtgattttcaaagcagaagttaagaacattattcattttactagtaatagtaggtggattgctttaggggttgaaattgggaaaccaaaaaacctcttctcttaccatctattactttgggctttggaagaagggtggtagagggagaaagataatgaagtcagaagggaaagggggagggagagagcaagagagaagtaaaaccagttgtgaaggcttgcttgagtaacttacactttgaagacatacaatggaaacacctaaacagaaattgaagcattagtactttaatttttctatcaaaaaccaaaccatttagctattattttagataagacagttaccagctttttttttttttttttttttttttttttgtggatgcacataaattgatgtgctgtgtctgggtagaacaggagtgaatattgaatggttattttattgttgcaaatctcattccatggattccagtaaatttccagccgtcaagattttgttaacagctatgttgaaaaacaattgtgtttctttttcagttgtgcaaatacaaacaggggacctatgaatccatcaatttggggtttatttttgacccattaagaaaatcgtttgtcagtagtagtagtaataaagtcctacagtggaggttggggaatgatggaatattttaaggtgagagattcagtgaagaagactgaagtgactaactgcagggtctactttagaagtgtggagaatcacagaaagtgctgagatctgggatggcctattagaaacaatgtgtgaaacttggaaggtaggatagttcttattttaagaaaaaagaaatgattcgtcttacatttactctctttagacttcatttttttctgtttttgtttgttttttggtagagatgggtcttcctttcttgcccaggctggtcttgaactcctggcttcaagcagtccttttgcctcagcttccgaaagtgttggaattagaggcgtgagccactgctccctgcctagacttaagacaccatccttttgtcagagatggcctcatagatagtatgtatgatcaattttgttaatagatggggcaggtgagagacagagaagttccttatccaaatttggtaggttttggccttataaatttgagtttgttcatacaactgttgccaacattttgtgcgctatttatattaacttacatcatatgaattttttctgtcttccatcaagttgattgataaggtttaaaaggatgggctaaagaaaagtacttttgtcttcagaatttccaggtttttttgttctttgattctttttcaatgaagtgaaatctaatattagactatattttcctatcacttgcttaagaagagacaatggaaaagaaacaagaatgcagtgatttttctgaattgaatgaattgttactgtgttcttgatcctgttcttgtccttcctgtcttatctatatcatctagttgtggttgggacagtcacaaaatcctactctaaaaacctcactatgatgcttatcattattttatgagagcgaattttgtgcttcacaaattcaaaatgactcagacggtttcattatgtaattttatggaaagaatttgagctaaaattttcaggtcatggcttacatgacaacaaaacaatcaaataagaaaatcagaactataaacagttggtgtaacatttataaatgtttcagcaataggctctgccatgtgtagcttaatatgtttggaaactaaaaaaaaaagtctttccagttgctgctgtttaaaaatgtttcttaattaaaaaaaagacaaaaggtcaaaatgtaaacacatgttccacataaaagtgaagccaagaagatatactgtatacagttattcctgtatctgtttgactaaggatgacattgtttaatttacattagctgttccaagacaaaatagtccatgggagtgatgttgaggggaatttggggggtaaaaagagaaggaaaaaagccgtttgttccatttgttctaatatatttcagttacacccaaagagcatctttttcaaaggtcatgttgaattaaaacatgattcggctgtttcgttctcattattatagaaaactaatgtcttttaaatggtgtccttttaggccgggcacggtggctcatgtctataattcccagcactctgggaggccgatgcgggcggatcacctgaggtcaggaataggacaccagcctggccaacatggtgaaaccccatctctactaaaaatacaaaaattagctgggcgtggtggcgggcgccttaatcccagctgcttgggaggctgaagcaggagaatcgcttgaaccctggagacggaggttgcagtgagccgagattgcgccactgcactccagcttgggcaacagaggtatactctgtctcaaaaaaataaataaatggtgtcctttttatttaatactagttattattaacatttttgactactgatgtatcagatgtggaacagtgctttacacattgtcatctgaacagatgctttacacatatgtgatttagtcttccccagagtaattggtggaatcaaggtttgaacctggtaatctgacttcagggtcttcctcttcaaccacggtttatacacttcatttcagtaattcttttagcagtaacgtggttgaaaataagcacatatcaaaaaataagctacctacttttccctctaaaagtttgcaggctagccctgcattgatctctcccttttacaatttgcattctctgtctattcaacccaaattagcatttcatgtaccttagaaactcagtacatttgtttattttattttattttgtttttgacagagtcttgctctgttgcccaggctggagtgcagtggtgccatcttggctcactgcagcctctgcctctgggttcaagtgattctcctgcctcagcttcctgagtagctgggattacaggtgtgtgccaccatgtctgcctaatttttgtatttttggtagagacaaggtttttccatgttggcaaggctggtctggaactcctggcctcaagtgatcccacctgcctcagcctcccaaaatactgggattataggcaagagccaccacacccagcctacatttatttattttagaaataatcacctcatgtactgagctgcttaattctctaaatttattttattatatacctttattagcaaaatatatttgagtgtacaccccaatatatgttgataaattttatacatgtgacaatatattgacttatatgtatgataaagcttcctacaatataaattttgaaaggagaaagtaaaaagcaattctaagcaagttgtaattttctcctacatcccaacatatagccttatacactgttttggcatacatgaaccccgttttggagactacagctgtaaacaataccacttaaattgatactctagtaatatataaagtagccatgatcaattttggttccctgattcaagcttctagattataaagagtgtgtgtgtgtgtgtgtgtgtgtgtgtgtgtgtgtgtgtgtcttttttaaaagacagtcactcggtaagttaattgactcaacagaagttggcagaatacagaggaaaattctatcttataaaaaggaagtaaaactacgttacctgaaggggaaaatccaggctttttcttttaaaacctgttttcctgtatataccttgaattccaattgtatagtggtaatgtttttggtgcaacatttgtggatgggacaaagagaatcgtattatagttttctggttaggaatcagtaaattatggaaataccagtcagaattagaagaaagtctaaagtttagaatagttgaaaagaaatgcaatttcatagagtatttcaggttattttgttaggagagagatcgttcactatttgctttcttgtaacttttgaaaaatgtttagcatgtgcttggattacctattaaataagtgtaaaaatacatgaaagaaaggcaattcttttgtaaatatgcattaagtagtaaataaaacacagtaggccgtgtgtggtggctcacagcctgtaatcccagcactttgggaggccgaggcgggcgaatcatgaggtcaggaaatcgagaccatcctgactaacttggtgaaaccccgtctctactaaaaatacacacaaaaaaattagcctggcgtggtggcagttgcctgtagtcccagctactcgggaggctgaggcaggagaatggcgtgaacccgagaggcagagcttgcagtgagctgagatcgcagcactgcttgacagagtgagactccatctcaaaacaaaacaaaacaacaaaacaaacaaaaaccacggtatatagcggcacatgacatgattctaaattgatatagccaaatattcttgtcttaagtcattctcttggtcctgaattctcactcccctctccctgtctttctgctaaatctcactcttttcccaaaggtttagtttatattttaccctaccaaatatttttgcaagtttccctccttgacgttaatactatcaatatggtaggatgaatatggcctccatcagtcaactttgcagatgtcaagggtcctcagtctaggtaggcaagaatgtgcaggaatataccctctctttctaagtctttcctgtatgtgttgtgctttgctcacagtaggtgtgcaaatgttttttaaaatattgaacactgtctaatggtaaatgtgtatgaatgtaaaatgattgaaaacttcttaggcatgtaaatattttaaatagacttttttttattatactttaagttttagggtacatgtacacaacgtgcacggtttgttacatatgtatacatgtgccatgttggtgtgctacacccattaactcttcatttaacattaggtatatctcctaatgccatccctcccccatcccccaaccccacaacaggccccagtgtgtgatgttccccttcctgtgtccatgtgttctcattgttcatttcccacctatgagtgagaacatgcggtgtttggttttttgtccttgtgatagtttgctgagaatgatggtttccagcttcatccatgtccctgcaaaggacatgaactgatccttttttatggctgcatagtattccatggtgtatatgtgccacattttcttaatccagtctatcattgttggacatttgggttggttccaagtctttgctattgtgaataatgccacaataaatacatgtgtgcatgtgtctttatagcagtgtgttttataatcctttgggtatatacccagtaatgggatggctgggtcaaatggtatttctagttctagatccctgaggaatctccacactgacttccacaatggttgaactagcttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgtttatatcctttgccccctttttgatggggttggttgattttttcttgtaaatttgtttgagttcattgtagattctggatattagccctttgtcagatgagtagattgcaaaaattttctcccattctgtaggttgcctgttcactctgatggtagtttctcttttgctgtgcagaagctctttagtttaattacatctcatttgtcaattttggcttttgttgccactgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagcttcctacatatggctagccagtttttccagcaccatttattaaatagggaatcctttccccattgcttgtttttgtcaggtttgtcaaagatcagatagttgtagatatgcggcattgtttctgagggctctgttctgttccattggtctgtatctctgttgtggtaccagtaccatgctgttttggttaccatagccttgtagtatagtttgaagtcaggtagcatgatgcctccagctttgttcttttggcttaggattgacttggcaatttgggctcttttttggttccatatgaactttaaagtagttgtttcgaattctgtgaagaaggtcattggtagcttgatggggatggcattgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagttgattcctaggtattttattctctttgaagcaattgtgaatgggagttcactcatgatttggctctgtgtttgtctgttattggtgtaagaatgcttgtgattttttcacactgattttgtatcctgagactttgctgaagttgcctgtcagcttaaggacattttgggctgagacgatgttaaatagacttttaataatagtctcctagtaatgttttacattactgtattttaagatgtttcataaaatataaaagctttagcctatcttcagttcagtctcatagatttggacttcgttgtattaaaaatacaacgtgaggcttgggcctgacatttgaacactacaaaatgcacagaacgcacgtgcacaggcttcttttgcctgtaggatttcatattgtaattgaggtgacattctggccccccacaaaccactaatgctgtatgtcattgcatctgcttatgtgaactctgtgcttaatctaaaactgatctattgccctgaacctgctttgtccatttccatctttttgcgtttcctcatcattcctgccactctgcaaggcaagctgccttcctccctctgttgcttgaattctgctgacccctcaagacccacttgctgtttggactcctccagtttttcctctagctccagcacagacctgtctctttaagattgaaatggacatatccacccgcttaccaaatacctttgcttgcatgttcttcagccacctccatacaattttatcctaaactgaatgtgttctctcgttcctcagttcttctctcctgtactgtgatgtcattcttttttttttttcccactccactaattttcataaacgtggtcactagagctccttttcctttgcctcatactttttaaacctggcaatttgcttttatggaaaaaagcaaaaataaaccagattgcttttagttgccaaaaatttaagagtaattatgtgaaacatctgaaatagtggaagcttttttaagagtgtgatttcattttggtatagactctagatttgaagcctgactctgccatttataacttttgggaacttgaataagttacgtattttatgatgagtgcctcattttcctcatctatgaaatgggaataaagatagtacctatctcagagggatgttttgagaattaaatgaattaacagtacctggcatacgctaagcattaatgtgtgttaaaaaaaaacacaacaaaaccaaaaggaaacaaacaaatacaagttttagaattcaatgagaacacgacagtttaaaaaaaatgaaatttgattagaaatataagctagagattgctctcaagccagtatagtaatagtacttttaaaaagttattaatgaaaaatatgaaagtaaagtctttaaatcttttagttaagtgtttcaaatttttaaaaacttgcagttctttaaaccttatgtcctcctttaattccatttgaaatttgaggtaaatagtccgacttggaaaaaaaagtaaaaaaaaaaaaaagatgggataaagctttgctttgttttcataccatcctttcccctgagaaacagtgtttaactgatagagtaaatagatgtgtgtgtacacagtctccaagtttatggtcttaaatttaaggtttagcaggtaatttttgaacaatttaggaacctgtaggtagaagtattgaaaattgttactttatttaaatgaggcagatgcttgtagaaaaacaaaactgtgtgcctgaaatacaaattaattggcaaacaattagttggcattaaattgacagcttgttgccctttcctcatgtcataatatttataaaagtaagctcatggtgggacaaattaatacatctccaagtcttacattagtatgtgtttttattctgaaaacttataattctgtacttattcaactacaaattgctaataatttatttttagaagaaaataaagacaatcttttgagatctttgtttttacatgaagtttgttcatacgtctttgatttttttatttgactgttaacagcagtttaccagccaagcaatattaggacttttgatgcataataattccttgaaatacctttcttgtaattccttaaatggaatccaaaaggtattttagtgtttgaattttaacaaaaacccgtttgtaaaaagaatattttatgaaaaatattttaggagcacattttacattaaagtacattttgaactaatttggttgggctgatagtatcggagcatagtgagagatttttatctgccaaaactgagtagagcagaattttttttctcttttacttgttgtgacgtattttcaatatagagaaagacacagataaatgaggaacactcatataagcagtcctctagctctgacagattttaacattttggcacccttcaaggttttttattttttttcctggccacgcacggtggctcacgcctgtattcccagccctttgggggagaccaagacgggcagatcacctgaggtcaggagttcgagaccaccctggccaacatgatgaaaccccatctctactaaaaatacaaaaattagccggatgtaatggcacatgcctgtaatcccagcttcttgggaggctgaggcaggagaatcgcttgaacccaggaggccaaggttgcagtgaactccagcgtgggtgacagagtaagactctgtctcaaaaaaagaaaaaaagttatttttttttcttttaaaatataccacatgtgcagtaggaggaggcccctcgtgtactctctcctgtcccattccatcaacttctctctccggagataaccaccaccatgatgcatttagtgtttgtgtttctggtatgtggttttgtagtattactacataggcattaggttagaaatttgtataaattttgcacttataaaagtttcttttatgtaaattattatccatcaacttgtttttgagaagggcatttgagatgttacattgattcatgtagttctagttctctagttcatttattttaacattacttctatgtagtatacccttgtataaatatacactttatccattctttggtaaatattttggttgttcccaattttttgttatagtgctgtagtgaatgtgtgtgtgtgtgtgtgtgtgtatgtgtgttaggcaaatgtagtttttaaagatagttttcagtgtgtggtctggatacctctgggggaccatttccctctcttcccagaccttgcaagagtccataggatgaaaattataataatacttctaagattttctttgcctttttttctctcatgctctcagcgtgatagcttacggtggagttttccagagggtatatgatgtatgatattgcgacagattgaatgcaggagcaaatacgagaacccagccatcttctatcataccagatttgcaaaaatgtaaaacaaagtcattctaaattttactaagttttgtttgttttggaaaatatagtttttttaatcaaaatatgttattagtaacgtgtaagttcctttaaattcatattttaagtatttatcagttttaatttataatacaataaatatcaatggatataaccatatacacaaataatttttgagagtatatagagattttgagatcgaaaagtttgtggactgctgctatagggtatgtacctaagtgtggaaaggttgattgtaggggtgcacagctttgacttcacctcacattgtcatatctgctttataaaggtgttgcaccagtttgtactgtcatcagcagtatgagtccctgattttcacattgaagcgaacattcaatattgtcagatttcaacaagctttgacagtaggatggatgtcaggtagcatcttactgtgaattgaatttgttttcctcttattgctagtgacattgaacatcttttcctgttcattgactgtatttgtagtttattttctttgaaaattttttgccatttttcccatctggctgattgtgtttttcttactgatttgtagaaggatttccctccttccctcccgccctcccttcctctcttccttccttccttccttcctttaatgttctggctaccaaccctatgttggcaatagtcattgaaaaaaatctcccaatcttaggtttgtcttttcattttgtttacaataactttgaacataatttttaattttaatgtaggctaatgttaatcattccttttgcttgtgattttttttgccttgtttaaggatttcatcactaacccaaattaaaaaggtaatctctttattttcctgcaaaaatttgtaagtcttgagtttcatctttaaggctttaatctataatttattcttatatatggtatgaattagggaatctcatttcattattttagtatgcatcatgtattgactcattttttcccccactgatttttaaatgttaaatttccatttatctgtgaatgtacaaatttccacatacatgtgaatgtacttcaagcttctgttctgttctattgggtttgctgtcctttcctcaatgcctctttcccttaattaatgtgactttaaaatggtcttgatatatggtatggtaactctcacttttttttttgctttaaaatgatttaatcatttgtaggcttttattagtccataaaacttttaggatatgcttcttcagttttgtagaaaatctttattggtagttttattggaattgcttgaatttataaacaaagttggagatgacagatattttaatgatactgagtcttcctatccatgaacatgatatatctccctttattcagtcttcctttcatattcttcaataatgttttataattttctccataaggattttgctatcttttcttaggtttattcctatgtaacttatcacaactgggatttttaaaattatacattttaatttgctgttgctgagaatatataacaggaactggtaaagttcaataataagaagaccctaatcaaactgagcaaagacttgaacacgtcaataaagaagacctaagaatggctgggtgcagtagctcatgcctgtaatcccagcactttgggaggcctaggcaggcagatcacttgaggtcagcagtttgagaccagcctggccaacatgatgaaaccctgtctccactaaaaatacagaaattagtggtggcacatgcctttaatcccagctacttgggaggctgaggtaggagaatcggttgaaccgggatggcgaaggttgcagtgaaccaagactgtgccactgcactccaacctgggcgacagagtgagactctgtctcggaaaaaaaagaagacataagaatggccaataagcacgtggaatagtgctcaatatttttagttatcaggatagtgaaaaaaccactgtaagacaccattaaacacacacatcattaaacacacacaagaatggctaaaataagacataccttatgttggctggaactcctatatggtcctggagggcataaagtgatataaacacttaggaaaactgtgggtatgttataaagttaagcattcacccacctatgaccaagcaatcccactcctaggtatttaagagaaatgaaagtaacatttacaaaatggttgtaaacatatgcttttattcaaccaaagttattgtaaacaaaatgaaaagacaagcacaagactggaagttttttcaatgaatattaccaacaaagggttgaatatttagaagaatattaaagaatatttataaaagctttattcaaaatagctcaaactggaaactgaaatgtccatcaacaggagaatggagatatatatattgtggtatattcatataagggaatactactcatcaataaaaaagaacagtacgaattaatcttatgtttgcatgaagttcaaagacaggcaaagctaaactacagtggtagaaatcctaacaagtaattgcctatgagatagtgggaattgacagtaagggggttcaaggaaactttccaaggtgttgaaaatgttttatatcttgattggagtgttggttgtggatgtatatgtttatcaaaactcattgaattgtacattttattgtatgtcaatttcacatctttttttaaaaaaaattggaaatgtggacactcttgaaatcttttttttccacattttattgagaaatgccattgccttctgctctgattatcttgtgaaatctttcattattcttgttagagactaaaaccaggttacattttcataattgtggggcataaatggtactgcttttaataatactacttgaaaaaaagccaaagactagtcaagctctagtgttaaaagtctattttatgtttttagccagtactatatattttaatttatgggtttcagaaactcaatacttgtatacataacatttgctgtttttttttgaaactgtgtctcactctgtcaccaagactggagtgcggtggtacgatctgagctcactgcaacttctgcctcccaggtttgagcgattctcatgcctcagcctcccaagtatctgggactacaggtgtgcaccaccatgcctggctaatttttgtatttttaatagagacgggttttaccatgttggccaggctgaactcctggcctcatgtgatctgcccacctgggcctcccaaagtgccaggattacaggcatgagcctccatgcctggccaaatgatctttaggtgccacccctattatattatttttcattagcactattgcttcagcatttttgaacctaatatatattgtagccagcagtgttctaagccttggggatacagtaatgaagcagacagacaaggaaagaccctgccctcatggagcttataatgtagcgaaggaggagacagacaataaacataaaacaggtctcttttgccagctctggagaaaaggaaacgggatgataccatggaaaggaacaagaggggcaactttaaactgggtgttcagggaaaagcttcctgagagggggttatttgagctgagactggaatggcaggaatatcttcattctgggagttgtatgaggaaggctttgaatatgggtattttctataaccgtactcttattagtaggccaaccttaatcacatccctgattattctctcagttgctcttcatttcaaagtctccctcctgccttttcccatttgtttctcccaaattacccttctctggagctgttttgttgtgactttatagacatgtagcaatttgaactctttgcagcttccagcttttccggtgttcttagcctagtttggattgtttactcttacaagcagaacattggtctccataaatctgctctttgcatgaatctgaccgtacagacttaaaagagacagttttgtgtatggagaagcagaaagtgaatttatatcgtcttgacagtggcgtttcccactcctttctacttaactctgagcccacatttaaaatcctgaaagtatttgggaacgtttttcttgacattgttactgcctcaaatctctgtgtagttttataaaaacttagtcattttaggatttttctagctgaaactgtatttttctctctttttctaagagggcattgttggtaaaatcctcatgaattaagaactggagactcatgttcattcacaagcaaaaatatgtttttttctaatttaatcattctattactttcatgttctaaagtgtcagttatattttgaggaattcggttagtaaatataaagaaagtctttgaagttggcactttgtaaaagcagaaggagcatcgatatttcgtcttactctgccccacctccagccgtaatccacgtgtctgagtgggttggacacctgatctctgtgcttctttgctgtataatcaaaaaggaagaagaaaagtggtctcccaagtgctggcttctcaaacagctcccgttatgtctcataagaagtgccttgaggtacatggttcataatctgtgtctccttgagaccaagaccatgaagccttggagggtacccgccaactattattctgtccttgtacctttgagccccttcacaggctgaatctcaacaaattcctaggcactgtgtatctagaaatacatagtatttcaagggcttacaagacagtgatgagtaaagtatctctgagtattaataattgtggtcaaggttcagtaccttttaacaaaaatgtagaaaataagtggtccttttcaataccagaaattatgtatgtattaaaagtttgcaagttgtgtgtgttaggttaatcagaaaaattttcaagttttgttgtttatttgcctgtttgctgttgaccttttaaaaaagttaattattccttggttcaagggtgagccttacttcactttaatttttgaagcacaggcataagagaaattcatttattctgcactaaatatttactctgtcaaaaataattatcttacatggtttcaatttacacagtttctagaatattttatttagacagttaacagattcagaaagtgtttgttgctagaaaaggtgattaatgggaggataaggatgctaaaattattcagctgaatccaagattattgtgtatatttcacttagggtatacgaacacttttctgcaaaaggctaatttaactaacacagctccagtgtagatagggtagtttgttttttatttttgtttgctcggggtgtgtgtatatgtgtgtgtgtgtgtgtgtgtgtgtgtgtgtgtgtgtgtttatgactgcagatcacagctcagggctcttgtttctttaacttggagtttccctcccaggagtatgctcagagatgcaaactgtgtgtactgctatcaaccttttagtttcatagattatcttaggttttttagtcttctactggatttctctttcacctgcggtatttctaaattaggtagctacttgcagggtgtaagtctttgaagccattgtatttgaaaatacaactagacttaataagctcttcaagggcagggactctcttacaattccagtgcccagcatccacactcaatacagcaacaaaattaatggggagagggagacttgctctgtttccttgcagagtttattgatgcattctgcaggtatttactcagcacctttatctgccaggcactgtgataggcattgggcatgaagaggtgagcagataagcagttcctgctggcctggtgcagaactccgtccagcaggtatgggaggctgttttcactgctgagatagagacttcttcggtttatccaaagtaatggaggatttttcttgtaaggacacggaaggattaaagaagacttgaatcagttacacttctgggtctcttgggagcgtaggaactaaacgaatctagtggaatatagtttggcaacagaagatatctctggttatacaagcacgaagatattcataggaacataggactcagtgttccactgcagtagtgttggggagaaagtcaaaccttatataaatatttttgtcttttttccttggggattcactaagatcttaggttatattctcttaaaaatgctaggattttactctgttcttaaatcatattgtttgtttctccaggcatacaatatgtttcctattttttcgttctatcctagtctctagttttctctctatgtggggtgtgtgtgtgtgtgtgtgtgtgtgtgtgtgtgtgtgtgtattcaccaaatatccacagaataagaaaatctaaaggtaaaaaccaaaagtctgagaaaatttaatttgacttgtcacattttaagataccttcatctgttaacattttttgggaatttgtattgctgtgtattttttatatttaaaaagtggtaatattagtttacactaaataagcgtcagtctcttacatttgaataggaatttatagttgacaggtacatccaaagatgtttaggttttttttgtttttgagatggagtaccgctctgttgcccaggctggagtgcagtggcaggatctccactcactgcaacctctgacttctgggttcaagcaattctcttgcctcagccttccgagtagctgggattacaggtgctcaccaccacgcccggctaattttttttttaatttttagtatagagatggggtttctcttatgttggcccggctggtcttgaactcctgacttcaggtgatctgcctacctcggcctccctaagtgctgggattacaggcgtgggccaccgtgcctggccaggtttttttcttcagaaaaaccccctgaaagaaggagggcagattttactctccatatatcacaagttgaaaatttaagtcaaggttacatggttcatctacgccatcagaaggcaatgtggccagtattagagcccaaggctcctgtctgccacttgggtggtctgtccatgccccatgcttcaccccctccctgccagtgatgtggaaggtcgggatgttggcggtgcccatcgtcaccttcctgctccccttccctgacttactttcctgagagagaggaccaggcatagcttggccagatgcacatttctttatttccagcaaggcctccaccctgaatcccagccttcttctctattttggtaattagactaaaaagcttagaaaaatgatgaaggtgaccgttaacttgctgaaagtttgtacaggaaacatttgtgtttcatccctgcaagtggaaatggagggatatgggcatgagagattggatttttggtgattgttctcaaaacccagtatttaccttaattactgcataccacttgcttggtgcacccatcttcttaactgtccaatcctatgccccatttactgtcagaaaatgaaaatcatagacttacaacctgtctactcacgatttagaaattgatagaatgtctagcaaaaatatcaaggagaaataaattaaaataatttatagcaagtaaaatgtatttcagtaggtatgtgtttcagcatgtactcaagaagacagtgtagttagattgtcccacctagatgtggaggctctatgaatataaaagctgcaaacggagtctgatcaaaaagcattgtactaggaatccaaataccataaggagcattgtagtagtcgcatggttttctgaaatgatgaacatctattagtaaaattccaaacaaagcaagaaacaaaacccaaatttgatgttgtcattgtgttgtagaaaatttgatgtatattaaaactgcataaatgaatcaagtgtatataaagagctgtattaggatttaggcccagatggttataaatggacttttttttgccaatgtgaatgcccagtgggatgttttaaaagttatgcaggacaaaagttgaaggttgcaggacagttctttgttgtgcaggattgttgtggagtttgcctgacaaaagccaaggaagggtgtcctctgaattaccgtgacaatcaaaattgcccccacaaatttagaaaacatcttctagatagcgatgccacctttgtggaaaacctttaccttaaacacttcagaaagacacagaaacctaaggaccccaggaaaacaaagacttcccgaccttttaaaccaggagctcatagtcctgtggcttcatcgtctaaagaggctggagggggcaggggggcagagaatgtctactatatttttgccccaaggctgggagaagtttttaaccttcatcttgcctatatctgcttgcactctccgttctgcattcctgtggttgcatttttttgcattttgtttccattcactgtccttgtagcttgctggggtggcactctttagactaactttaatagttgcaaaaaaggggtttgaaaactgatgggcctttgtgtgtatgtgtagtaaaatatatataacacaatttatctgatgcaagtttttaataagtaatttgtgactgtgcaagtatatgactaaagtattgtggtatataaatagtaaatattgtatgtctttcagtcactttggaggatataattttgttataaatgataatatcttgataattgggtttatgaattatttcacaaagttaatctttaatcataatgaagatcatgaaggaagataatattcacctcttattgtatgatttcaggaatctgtattttcactttctgttctctctgaggcagcgttttgatgcaagatactcgtaaattcagattctccagctgtgatgaagagtgactgtgtgatctaaaacaaattaataattttctctgagacttactgtaaaatgtactcatcagttgtttgaagatgctgattttttttttgtttgagactgagtttcattgtgtcacccaggctggagtgcagtggcgtgatcttggctcactgcaacctctgcctcctgggttcaagcgattctcctgccccagcctcccaagtagctgggattagaggcacctgtcaccatgcccggctaatttttgtagtttttagtagaaatggggtttcctcatgttggccatgctggtctcaaactcctcacctcaggtgatctgcccaccttggcctcccaaagtgttgggattacaggcgtgagccactgtgcctggccgaaggtgctgatatttgatagcatgattgtaaggattaatgcactacacatctgacatagttttattatagtacttgttcctgtgcatacatatttttcatgcagtgcaatcatactgctgataaaaattttgtcttctctttttacttgacctagtgtttccatagtgtaaacaaatttcataattactcttctaaaagtattgaagtagactcatgacattctgttaccaaaatactgcatagtacattgtgtcctttctttatataacatgagccagaaatgtacctgcttctcttgagaaaggcatgtttttaaaaacctcagttcttgagataacgatgtcatcaaaaccaagaagatacagagctgagttgagtcggaggagtgggcagatggtaggcttgccagctgagtggtgcgcacaccaggatgagattgcagctttcagtggacagatttgcgtgttatggacatttggattgcacaaaaactgtcagaactataaatctgagactttcaaggatatactatccttcagctaaagatgatttcaacatacatgagcaatttctgttctgttttctaattttatcatttaagaaatgatgctgctgaatagatttattcatacattgctctttccttcactagtagtacttctttaggttaaatctctagtagatttaccctattaagtgacacaagtcttttatagtacttgatgtaattgccaaattgttgtttaaaggtattgtattgctttatatggttcccagttaagtagttttagctgtctgtaactagggatttttcttttaatttaaagtgctaatttaataggtaaaatactgatttcaatttatatttatttgattattaatgaatttcagcatttaatttttgtatattcatggtatttcctcttatttattcatctttttctttagttaaattataagatggtttaccaatttgagccttttcagggttttgggaaaattagacttttaatctaatcatattattctgctttttcttttagctccagtaataaaccgattcacaaggcgtgcctcaggtaagtctgattatattatggattttgtttattaatggtgacatttaaaaaatgataatattggacaagaaggtacaaagaataattgctgtatagtaaacctttatttgtcagttatttttcccagaaaacacaactatctgatataatcactatctaggaagcaattgaaaatgccctacctaggaagcaatttcaaatgcaattgaaaatgtgagtggctacactgaaagtcacactgtgtactaaactggtgggcctttttaaatggagactctcagcccagggtgttattcttgctcttgatagaattacgatctgtatggttgtctgatttaccagccataatctagaaacagtgatttagcagatgggtaaaggacaccttagaaacagtgataattgagtgagtgtttttttgtttgtttgtttgtttgttttcataagagggtttttaataagggacaggagaactcttaaaatgcaggtataagaacttgtcattatgggaccatttagaataggagcaaattgctttacatttgtttgtgcccctgaggctattgctggtttaaatatactacagtaccctaatgtagtcagcatgataggccttagccattaacaagggcgtacattaacttcaatatactgtgtactatttaaactgctggggaagtatgagacagaattaagagcatttctgtccaaaatggcttaagttaaatgattttgggcattgagataaactattatttagaaaattcaccatatggcttatcttctctgtgtaagaggacaaatgaagtgagggtaatatttgatttgagaaaattactctttaagtatacctggaaattttttgttaaacccaagataaacatttcacacagatcatctttggagttgatataatacaaatgggtcatttatttcacaaaattaccttatttccacctgtgctataatattaaagacattttaatgttgaattttatttttgatttgtcagcagttactggtataatttactcttgttatgtagtgaccaggtctataaggataatatgctatattggaataacatctactttatcattctgagctttttgtaatctcaaggcgtgtttattttaaatggtgaaaacaagtgtagattgtaatgccttttgtggaatgagacattatgtttatgtcagtaaggcgtcgaattttatcccaaagaactatcaagtgtgatcatattctagtgtagtagtcctttatgagcagtggtgggaataggggaggaagaagagagaatcagtattgtgatgccttgtcttcatgaggtgaaattctttcaatagaaacacagttaagagtcatagaataaataatcaccatttctacctcaaaccgtatgacatgtgacatttatttctgggcacgttccattagtatttgttgtacattatacgtatcattggctgggcgaggtggctcacgcctgtaatcccaacactttgggaggctgaggcgggcagatcacgaggtcaggagatcaaggccatcctggctaacatggtgaaaccccgtctctgctaaaaatacaaaaacaaaatgagccgggcgtggtggcgggcacctgtagtcccagctactcgggaggctgaggcaggagaatggcgtgaacccggaaggcggagcttgcagtgagccaagattgcaccactgcactccagcctgggtgacagggtgagaccgcatctcaaaaaaaaaaataataaaaaataaaaataaaaaataaatatatatatatataattgtagagatgatgtaataccacaaagaaatacacattaaaatcaaatgttgcatttattcccagaatgacaggtaataagaaatgtcagtgaaaacaacaggaaacagtttggtataaataagatgataccaagttcaggagtcacgctgtatacagcagtaagccttaaaaggagtaaaattgttatcccaataatataatatgctggaaaccatcaggagaatgaatcttgacattaattataagaaagaaaagagaactaatttatggagtaccactgatggatcaggcactgtgctaagcattttatatacatttttagtctttcaggcaaggcaaataaaattatttaatactttgaataaaaaatgtggtataagaaaaaagggaagaggatttatttaatcatctacttctctgtattttatttgagactttcttaattcttataaaagtttgtgtaaaatgtttttgacaaagaatatagaaacagtcttaagacatcctgaggaggaaatgctacagtttttttgttaatttaatttagtgctaacatgaagtttagtaatagagatgtacattaacttttttaaaaagtaacatttcctgaaaataaaaaagaaatgattattttctcaaaatgcagtcaattgtatttgataattaaaaagatttcttatgataccttttctgattgagttttcagagatactttttcttttcataacccataaaactttaatgtaagaatggtaatttaggggaagaaagtaagtcaggtaaaatcaactggaagtctgtacgacgtaagagtttgttttttattcatctgtttttaaattaaagttacaacagtaaatgctatatgtatatattacaacaataaatacaaaatgtgtagtgctaggtgttctatcattgttgattgaaaagaaaaaattactatgaattataattaataactcattaactgactttcctaaatcttttgaatttttggcttttgatattcatactgcatctatcaaacataaatatttcaaacctgaataatttaaacaaaacatttcccctttggatacctttttcttttgttatgaaggtgagaggaatatttatgcttaacaaatacattctttaggattatttttacacttttaagaacactatttgtgctatagtctctcgtcttcctcatgtgttcagtgctggcccacaaacgtgtcagtttttatttttgtaagtgaaaggaatcagtttcactcattattttcaaacagaattcctagcatcttaagagtttatagaggcttcagggttgtataagccagcatcctacttggtacaggagtggaaggcatgtagaaagcatgactaacgaagagaagcgtagatgggcaccagaagaataggacccaattttactgattagattggatgagttccacaaaacatgatgaaaaactgtcagatgtcttctgaaatccagatatatctctgatagcatcctgacagcaccccataaccttatttttaaacagtacctcatggtcccatttttaaacaaaagaaaaagaaatactgcttttgatctcttaaaatgctcttcagctcttaataatcccttcttatcagtacatccttaagacagagaggcctggtgtggtggctcacacctgtaatcccagcactttgggaggccgtggtgggcggatcactagaggtcaggagttcgagaccagcctggccaacttggtgaaatcccttctctaccaaaaaatacaaaaattagtcaggcatggtggcgcgtgcctatagtcccagttactcgggaggctgaggcaggagattcacttgaaccctggaggtggaggttacagtgggctgagattgtgccactcactccaacctgggcaacagagtgagaccctgtctcaaaaaataaaataaaataaaataaagtaacagagaaatcattatccataatccattttattttatttgtatttgagatggagccttgctctgttgcccaggctggagtgcagtggcacgatcttggctcactgcaacctccaccctcccaagttcaagcaattctctcaagtagctgggactacaggtgtacgccaccatgcctggctaatttttgtatttttagtagagacgaggtttcaccatgttggccaggctggtctccaactcctgacctcaggtgatctgcccgccttggcctcccaaagtgctgggattataggtgtgagccactgcgcccggccacataatccattttacaatatgggctttttgttttttggaagattattctttttggtggaaaatggaaataatatatcatttgttgttgtgagtattaaaaattagtggtggtggctgggcgctgtggtacacacttgtaattttgccactttgggaggctgaggtgagcggattacctgagattgggagttccacaccagcctggccaacatggtgaaacgctgtctctactaaaaatacaaaaattagctgggtttggtggcgggcgcctgtaatccagctacttgggaagctgaggcgggagaatcgcttgaacctgggagacggaggttgcagtgagctgagattgcgccactgtactccagcctgagtgacagagggggagactgcgtttaaaataaataaataaataaataaaaatttagtggtggtagtagtagtagcagctcagtaaatattttaagagtaaacctttaatcaagaaataatcctgttgcttcactgttcacctaatatatagaaaagatcctagggtttgaagttgtactgactagagttttcccattttctctgtgaatttgtatgtaagttgtttacttctttgagtttaattttatttattttcttttctttcagcttgggatcttaatagctatattcaagcttgtgagggttaaattggatgatttttattatttttaaattttttttttttttgagatggagtctcgctctgtcaccaggccggagtgcaatgacatgatcttggctcactgcaacctctgcctcttgggttcaagcgattcttctgcctcagcctcctgagtagctgggactacagctgcacaccaccatgcctggctaattttttgtattttaatagagacagggtttcaccatgttggccaggatggtctcaatctcctgacctcgtgatccgcccaccttggcctcccaaaatgctgggattataggtgtaagccaccacacctggcaattttttttttttttttaagacaggatttcactctgtcacccaggctgtagtgcagtggcatgatcttggctcactgcagcctccaccttccaggttgaagtgatccttccacctcaccctccctagtaactgggagaacaggtgtgcaccacaatgcctagctaatttttgtatgttttatagagacagggtttcgccatgttgcccaggctcatcttgaactctcgagctctagggatccacctgcctcagcctcccaaagtgctgtgattataggtgttggatgagtttaaggaagcccccagcagagagtctaggcttttcaaaacgttcgctctcagccttcttcttatgaacgtggtttaaaacaaagccataaacccctcagctttttgccttagcctgtcagaataaagccttagagagtcataatactgtttgatagtaatcctttaatatgggcatctttttattgtttatacattataggttttctaaaaaattgtaatggttttcctctgtggttttgtctctgaattggggaggggctagaaatgtccagttaatcttaagacagtgccttgcatcatgaagttggaactctgaattttttttttaatcctaagatactgttttgaaaaagttacccttctagaacagtttaaagagttcagtgagcgcctttatctaggctccccagatgttgatattttgccacatttgcatgctctctcctctccatctttacacagacacacactcttttttattgaaacttttaggaatcttaaatacttcagcctgtatctcctaagaaaaagggcattcttctaggtaatataacactgaaggaatttaacatcgatacgatactattatctcatacagagtttagagtcagatttcctccattgtcctatcatgtttttttctctctctcttttaaattcaagctaattcaaggattttttattgcatttaattgtcatgactcagtttttcttgcctttcataaattgactccctgaagtttttgaaatttgctttttcagagttttgaaggttattcctaaccataagacagttccctataccgcctgttatgcattcatagatggcattagcacagctgctgtttgttcagtatgccccaccgacgtccatgaaatctttgcattgacatttactattgctttcaaggactacttgaaagcaattacttgttctaataagtaattatttcttataatagaaggattttcttttctcatgtagttaaccactctttaattttttgccatagtatgaacatataattttgtggtatatttttaacagaactaaaattttataattttctgtaaactatgatgtagaataattcacaggtgaaattaatctttaaatttcaatctcacacacctactgtgtaaaatgtgatattacaaatctcagtgaaatcaccctgaacagaaatgattattccccaagaaattagtgaaatagcagaagttcacatcttgtcttgaatctgattcaaggaacatatgcttccttgattcacggaacatatgcttccttttgttttgtttgggaaatatcttgtagccttggtgttcattgtttctactttaaggttatttgacgataacagcttttaacccccaaactatttttttccagaggtcatttctatattgtcaaaccaatttgctggtataattatagttacattcatattttgttttttgaaattagcttcatttttaataagcctgttaatcaccaatacttgggaatacatattgggagaatactactttaattaatatactagtttattcagcaaacatttaccgagtccctcttgtgtgtcaggtacagtgctggggatgccacgaataataagatacagttcttacgaagtgcgcagtctagcagggaagctgatgatgactcatagtgtagtaaatgccgtaatatcctcaaagtgaaaaggagaaaacatacagtttttccagggcctgcctcacaggaagggtactatttgtgctgtctttaaggtttataacataggttttacgaggactataaggagagagactattctaggtatttctattcagtattactgtaaaaagtccattttcaccatatgttgctatgcagtttgcctctgccatcaagcacctatggcatggagtgagcagatgcccactggctatggatagcagggacttaaggccaggagttatttcatcctttaatttaccattgcttcaaaatgttaacatctgccttaccaggagaggctgtataggctctggaatcagaccagggttagagtactagctctgttactcacctatctacgtattaaaagtgtctctgtgtgtgtgtatccttagttacctttctaaggcttagtttctctgggtataaaatggggataatacctaactcacaagatgattgttgtaatgaaacagtagataacccatgaagaacagattcttgaggccgggcatggtggctcacgcctgtgttcccagcactttgggaggccaaggcaggtggatcacctgaggtcaggagttcaagaccagcctggccaacatgacaaaaccctgtctctgctaaaaatataaaaattagctgggcgttgtggcgtgtgcctgtagtctcagctacttgggaggccgaggcggaggaatcacttgaaccagggacgcaaagttgcggtgagccaagattgcaccactgtacactccaagcctggatgacagagtgatactccatcaaaaaaaaaaaaaaaaagaaaaaagaaaagaaaagaaatggcttcaggactgcagagcttgacatgaagagttagtcagaaggatgacacccagggtgaggctgaaatcaagggtcagaaagagaatttgactgaggcaacaggatgaaacgagaggtgtcagtcttgagcaagggaggtgggaagacaggatggaaggtgggactgggacctaaggaggttctctgagatgccagggcacaggcctgggggcttttgtccaggcttgttccttgggtgggatggaagccatttagggggcctccaagtcacttcatgcacctgttatctctcagtgcccacactagtattataataaaatgggttcttccctgtgattcattatgaataatccaagtgaacagagcaagtactgctcctggctcatttccagccacttgcccctcctgctctacactctagcagcgcttgtttactgatacttaagcaaccttgggaattggaacccagtggaatctgtggcattgttgagtctctggttcttttttgttaggccctggaatgctgataagctacctcaaggctaatgagaaattagattatctcttgaacttaattgcattttcccagagttctcttagagccccccagggaaaggagaaaggaagatagtgaaagcagctgttcaggttggggcatggtgggaagggaggatctttctgcgcctatagtgtcctcagactcttcacactggtggttttgccagtcgatgtggaagggcttggaagataacatgggaattatgtaacccaccaaaccccgtgtgccttaattacaggaacactgccactgttggggaaaggggtcggggagttagatctataagatagtataaaataggtatgagtagatagaatagacatttagatgtagtgcaaccattctttaattacaagcggagtttaggtcactacttcaccagctctgtgtgaaggatcagtttttcgtttttgttttcccagtgcactgcagaccagcacttttgagaaatataaatttgccacagcaatatcaaattgctataattgtatctaaacactgttttactctctgtacttatcttattgcagattgccatggcttaggtgatacaaccgtggtgtgtgctacatgagataagaaacttctcacaaaaagcttttataaaggaagattgcacatttatctaaaagaagcgattattaaaaaaaaaaaaacaaacataccttattttgctaacttggcattttgtcaggacagcctgcatgaatgaatggtgcccttgagttgtcgaatggtggcgtgtggcagccctgcttcaggcccgtggcgtgcctgcgttctgcctccatgtatgcctgctcatattcagagcatgccatgggctctcttatctaggccttgctatagctcaccacattccctgccatcagcttccttcctctctccctccctcccttccttccttccgataccgttactattacacatcgtttgatgttgtagttgcttgttcacatgtctttttccctatgcttaacagtgaggttcataattaatggactgagaaacaaggacactctggatgaggtcaaagaaaaaatagaatgtgaagtaaagaaatgagaatgcaaggaggatgggaagatttctccaggcatgtgtgtagagcggtgtgagattcctgagtagtgtgtgctggggtaaggaccagtgtgaatatagttacagggtgagcctgctaaagggcaggctgagtgacattttattggaattaaggaagccaaaataagttgaggatgggctctcaaatgggttttcaacttggacattgactgcctacgatggtggcacattggagtgaaatgaaaactgtgagccaggtaccagtcaggaaggggcatctgtatgccgtggctctcggaggagcacagaggtttcagtgggagcaccatggagtggtccagatgccagtgtggggagccacagcgtgccctcactatctttcagatcccactgtgtgcaggaagtggtaccgtctaagagaaggagtgttcttggagaagaatcaagtttcaaccaaggcagagaaaagtcagtaatgttttataaaagaatgtgagggtgtggggaatgtgttgggaaggagggtagtaatggacagaaggaagccacagagcagcaattcatttgaggaaatatttgcaagcaattaccattgccagggactacactaggcacagcagtgaacacattatgcccttgaagtacttgcagtctagggaagcttaaggcatggggagatgaaattagggaaaagatggtggtctggagggtcttacatcttgtggatgaccaagggtgacagagcaaagaggacatagttggattgatagtttttagattataatttattcactgtaaatacttgtttaactaaactttccttaaggctaactctgttagcttcctaatgagagcgctgtaaccgtctgatacttatcttaggtacagaaggcaatatgatgtagaagtaagaggctggatttggagctgtttttaaatttaacagtcaaatattcaatgagggcctacaatgtgttgggcactgggctggacccagggcaggcagatacagtttaggatcttaggtacatcatttattagctgtgtgaccttgggcaacttacttaaatgaccttctgtaaaaccagattgtggttattctggaagagaatgcaggcaaagcttttagcatagtgtctgacacattttgagtgcaaaataaacttttatatattattagactggatttttcaaattttaacctgataaaaacaccataattttagtgtctcttctttcctcttgtaacttatcccacctaatattaattggccaaagtgcataattttgtgtatgtattacaactaactcccctaccccaaatttgggttaacttaacattgtattgttatttgtgggggagagcaaagatttctctgaaatgtaacatcctttagctttttagatgaaaacagaaaagcaacctcagtccctcatcataaactgtatttgtagactgtagttttgaaagcaaattgatccaccttttaaaaatctaaactgatattttaaacaggtgtgtgcaaatgcagtccctcccacccccaccccatcagcatcttgacccagctacttctttggagctgactactagagaatgttagtctcctctctgagagcccagcaatatattatatactaggtaatcattggataatgttttctgatattttaaaagttaatattgcaactaaaaaccaaaatacctattcaggtcttgtcttccctttaccagtaagaatcagggtcttccccttccctgcacctccccggattagttttctactttttcatgagttactaaaaccagagaacactgattttaatgttgttttacagaaaacagtaccataaaattgacaacaaattaaaatatacattaatggtacagtatattgttttcagaatagtggaaagaaggggcctttcacttgaaagacggaacagcttaaatgatagtgttgttagacgtgtttcaaggaattacaaaatgttgtgtttattgaccatcaaaaaaggtacagctgaccttttccttagatattttaaaacagaattccaagttatagctcccctttaaaaacaggtatggatactttaatatatgcattgcctaacagagtatataggctacaaatacagcaaatgcacatagcttttattcaatttttgaacagcagcttaccagacgtgctgagttttagcaggttgctgagtggtaatctgcaggagaaatggaaaacaggtttgccttaactactcttgtggctttctaaaaataaattgctactttcaagttacctatttggtattttcactttatttagattttgtggatctcaaaattttctttttataatgttgatacattaccacttacaatttacttctgaattctgtaccataaaaataatgtattttattttcatgttactttaaaaatgatattgcttcttacttgcttatatttatcattccccccatttgtgtccttagaaacatttgttttaattgctctgcttttcttaagtacatttatatgaagagagctatttaatgtattttaaatacatttcttagaattgaaagctcttcttagaataatgaaaaaatttgtaattcagaattatattttattgactaataaataagcattcatgttatattacatagacaattaattagaagttaagtgaaattaaaattttcctgtagttaaattatttttatttttatttttatttttttgagatggagtctcgctctgtcgcccaggctggagtgcagcggtgcagttggctcactgcaacctctgcctcccaggctcgagtgatcctccctctgcagcctcttgagtagttgggaccacagatgcgtgccaccaagctcagctaattttttttgtatttttggtagagacagagtttgaccatgttgtcaaggttggtcttgaactcctgagctcaaagaatccagtgcccgccttggtctcccaaagtgttgggattacagctgtgagccaccgtgcctggcataatgattgttttagaagggatcttggtgttagactgtatagttggtgagactgaagtgtcttagatggaggttgtacctgcaggagagtcacaatgtgtgtctcatctataacagagattctgaggcagaggtcattataagttttgaaggtaacctgtgagtctcaaaatgttttttatgaatttgtaattccgaggctgggtatggtggctcatgcttgtaatcccagcaatttgggaggctgaggtgagacgatcccttgaggggattgtgctactacgctccagcctgggcaacagagcgagactgtctcaaaaaaaaaaaaaaaatagagtttataattcccaaagccttccctcccctctgagggaattttatcaaggaatacatttctctaataagggaagtagctcaaatttttgaataaagattattttgattatgagtcttagtagtctaatttgcaaaaatagatgatggtgatgatgacaacaatactaattaaaatttatgcacggtcaactgtgtgtcgagtgctgtttctcaactttgctttccctgagacgacctatgagaatcactagtgcaatatttgaagggagttttcttattatctccattttacaggtatggaaactgaggcacagtttactttttatttttaatattattaatttattccttagtactgagtcaagcctagttttttcttgttgttgttgttgttttgagacagaatcttgctctgtcacccaggctggagtgcagtggcatgatctcggctcactgcaacctccgcctcctgggttcaagtgactgtcctgcctcagcgtcccaagtagctgggattacaggcgcccacaaccatgcctggctaatttttgtatatttagtggaaatggagtttcaccatattggccaggctggtctcaaactcctgacgttgtgatccacctgcctcagcctcccaaagtgctgggattacaggcgtgagccaccacgtctggccaaacctagtttttagctattttattaaatggaattatagactagtaggaccgtcacagtcttgattactttaagaccagatcatgcaagtgtttttgactattctgcaggaaatgaaatcaaaccacttctacctattttctcctgttatagtttttatcctgagtctggaagttatgttaaatatttttttgcactaaattccaataaagcagagaaaagacaattgttaggcaatttgtagtaccagcattgtttttctatacatactgttataggtgaagcatttaaattattgtgcttttttggtaacaagttttttacattttaaagttgttctttatattttaatcaattcatcattcaaagttctgtgccccaaattataaaatagttcacattttaatgcttttagcagtcaatctgagtgattcagattagttttgatctaaatttaaatgttatgttattatcttttcagctagaaatctgaaaatatcttgttgccaaccatattagtggatatatatctagaaatatgtaaagcgtagtattcatttatacaaataggaaacttatacatttttgggagtgatttgcttacagtttagttcggtttattattgctctttgtttctccctggatcagggagaaaacccttaatactgggaaaatcaatttaattcctattataatgactaccatctatatactttttttttttttttgagatggagtcttgctctgtcacccacactggagtgcagtggcgcgatcatggctcactgcaagctccgcctcccgggttcacgccattctcctgcctcaacctccccagtagctgggactacagtgcctgccaccatgcctggctaattttttttttgtattttgttagcagagacggggtttcaccgtgttagccaggatggtctcgatctcctgacctggtgatccacccgcctcggcctcccaaagtgctgggattacaggtgtgagccaccacgcccggcctatatacttttgaagtatctgcaaatcaaacagaagattaatagtacaggtatatacgtaagggagatgctaacaactgaggaagtcatgtttgcttggtttgcagaattgtgattattaaatatcatattcctttgtaattatggatcctatgaaaaataaaagatctacttgtctctgtttgtataacttggaatggatgagacctgccctctcagccatctataagcaataatgttagatgctctgtgatgatttggaagaaggtgaggagagggaggaatatacaagggaggtgggcatggatggagtgaagagtggaaggtgatgattgtaccaattttctgtgttttaatttgaaatcatctccaacttccatatattcagcaagagtaagtcaaaatacttttttggcctttttaatgatgaggtcatgtttctcactgtaaggttcaattatgaaaatttttccaaaatgtaatatttatgaatcaatctttttttatagttgtgattagtatatgcatatatgttacatcattaaaaaacttttattataaaattgataaatgcttatggtaaaaaagtgaagtagtacagaagagtataaaatgaaaacaaagggttgtgtctctacagtgttcccagtcccagtcctaaaaaatagccatacctaatagtttgttgtgtatttccttgggtgtttttatgcacatacatatttagttgaaattaaacttatatccaattttttgaacattgtctttttcacttaatagtgtattgtgttctattttccatgaccttacctctaaagctacctcttgctttttaatgacttaaagccacctcttgcttcttaatacttcttaatggtgtcctattatatgtgtgtattgaaatgtatataacaagggtatttagtttttaggtacaaatacctgcatagttttgcaagtacatctacaggatatattttttagaagtggaattgcttaatcaaagaagcatgaaatttgagcatgtgaaatttgtataggcattgtcaaattgccctctaaaacagtatgctgattcatattccaatcttaggttcaacacagtgtaaaacacttgatattacaaaattttgaaatgtctgttaatttgctagctcagttatatttcagttggcatttccttatttatgagtgaagcatagctccttttaattattgttgaccgtttatattttcttgtgtgaatttcctgttaaatttttttttctctgatttgtaagtgtacagatctgaggttcaatggctttgagttcggatttgggctttactactaactagttgtttgaccttgagagggttatttagtctgaacttcagttcattatccgtaaaatgtggtagtaagactgcccagctcataaggtatggttaattaatgagataatgaatagaaaatacttaaccgatttcttaaagtacagtgagaatatatgcttgctagtagcattactaatattagtagggtttttttttaaattaaaagtagaaattttcagaaatgtcttttttttttaagacaaactctctgttgccgaggctggagtgcagtggcatgatctcagctcacccctaggctcaagtgatgctcccacctcagcctcccacaagctgggactacaggtgtgcgccaccatgcctgggtcatttttgcatttttttgtagatatggggctttgccacattggccaggctggtcttgaactcctggggctcaagtgatctgccaagcttggcctcccagagtgctgggattaggcatgcgccccctcaccggacgaaaatgtctttatagcatccatatgataatttggtttacttcgtaaacataatgatatggtaagtttcaatagattatctaatatcgaactatccttatattcctggaatgaactctgcttggtcatagcatattgattattaattatattcttaaaatataactaacgtataacaactattgtttaacacaaattaaaacacttttaagattatgtatacttcatggctttaaaataattacagaatagttttataaaattgcagtgaaactttttcacacataggaaaatgttatatgttctattatgtgccttttaagaatgtatgcccctctgaaatagtatattattttgacagtctaagtcctcttacttaagattgattttagattgagaatctagcagaaaagtgaaataaatacatagagaacatttatgtaattcacatttaatgttttttttttcctaaaagcattttcatccatcaaatatggacttttttcttatttcctccttttaaacttgaaaagtactatattaagggcattagaaacgtggtgctgcataacataaagatatttcattttgaaaaagaacttgggttccattttgcatacaaactttaatataaatagaacctggaattccagtaagaaccactttaaataatcataatagctaccatttatttagagcttactgtgagccaggagcttttctaagtgctttacatgtattaaatcattttattatttaagtgcagctctatatgacgggcactgttactgttctaatgttaccagtaaggaaactgatccagagaggttaagtcctttcccaagcttacacagtgactgatgggcagagactggattcaaattcaggcattctctctgtaatcccagtactttgggaggctgaggcaggcggattgcatgagctcaggagttcgagagcagcctgggcaacctggtgaaaccctgtctcttttccttactttctatttctattgccaccactccagttatcacacacttagattacttatctctcttgaattagtcttcctcttcttttctcactcacctagtacatctctgccctaacatcccacatatgataaagtttatacattttaatttaatttatatattttaactcagggtcctcaggaacctacagtctcagttactctgttaaccccattttctattacaccagccacaaatgctctcatataaccaagctgtggctgcctactgtatactaaacattcattgatttacagtatgtcgtgtaattctctcatcagcttttagatactattattatttccgttttaaagaaacgaaaactgaggcacagagaaattaactggtagaaggaacccacagcttatcaggagagcagtcagagtttgaatccagtgagccactcgttggaggtgggttcttcagcatggtctttcataggggcggaaacctcgttcaggtatcctatgcagttatcttgaatcagaatctgtggggtgatttatttatctagtgagtgatgcctagcacctatttacatggtcagagaatgcctctctcaggagctgacatttcagccaaggcctgggaagtacagggtggagggtgaggggaaaggagagcattccagggaaaggagatgttgtgtgtaaaggtctggagcttattccctcatttgtcagcagtgtgaatgtttatctttttgacatcattcttacgtcttttggcagcttaagccaaatatatcaatctattttttgagatttactcctcatgtgattctcatacagttggcttttattttattttatattttattttatttcgagacactcttgctctgtttcccaggctggagtgcagtggtgtgatcttggcttattgcagtctcctcttctcgggttcagatgatcctcctgcctcagcctcttgaggagttggggctacaggcgtgtgttaccacgcccggctaatttttgtagttttagtagacccgtggttttgccatgttggccaggctggtcttgaactcctggcctcaagtgatccacctgagttggcctcccaaagtgctgggattacaggcatgagccactgcacccagccggaggtaggttttaataatcatattttgggaggccgaggtgggtggatcacctaaggtcaggagtgcgagactagcctgggcaacatggtaaaaccccgtctctactaaaaatagaaaaattacctgggcacggtggcctgtgcctgtaatctctgctactcggtaggctgaggcaggagaattgcttgaacctgggaggtggaggtttcagtgagccaagatttgccactgcactccagcctgggaaacagagcgagactccatctcaaaaacaaacaaacaaaaaaatagtcacattttacacatgagaaaaattgagattcataatacttagcaatgtgtaaaggtcatataataagtggcaggaaaaaaatggcagagatgggattatgcttcaggctctctgaattctgcgctctttcctcatactgttgatcagtcattctacatgtaaccatggataataatttatactcctcccataacagatggatttatcttcctaaccaggttctacattagtagagtttagggaccctgtttagtacttgtctccctcataaacaccaactactgcgttatatataaatggtcagtaaataaaagttgtttccatgtatcagttttgctaaagccagaggcatttcagaccatttttcctatggtaaaataaaattttgatagttaaaaagttatttgcagggtacatgcatcatttttctaaaaacaataaagctatttataaagaaataccaggcagtggttctgaaatacatggaacataaaaactaaattaaagatctaaggccaaccttacttgttttgcagatttattcatttgctcagcacaattggttggaagagaataacttcagttttgcagactatcatttacattctctactagcacagataagcagataaaacagtcatggacactcctttcagaaccacacatgatccctgagttatgtatcacccattttgtggttgtaattctattgactagtcactagcatttgaatctgtcatcttgcaaatacaactttcttatcaatgactgccctatggttttattcttagttacttttggtaactggttggattgtcttgttttccttgtcatgatctttttaaacacgtattcttaacatctgaattctctttggttgcaagtgactgcaatgtgcaaacacctttaattcaatcaagtgaaaagggggtttattgagatggcaggggtgtggttcacagaatcaccaagtcacagcaagggtaggggtgcagttggatttcagaagcaactggaacctggttttgagccctgttaggaatctctccatctcttgcctctgattctctcttgcggccagctacttgctccatatggtgaggagcatcgccactgcagttccacattttacagctgcagcaagaaagaggtggacctgacatcccctctcattcaaggcttccccaaaatcccaggaaagcattctaattagcccagctatcctggattgacctggaaattgtctcatttgcccctatggggtctgctatggcacagggctcagaaaccctgacctcacctggagctaattttgactgacccatgtcagcttatgagaactgtatctgccagctgatttttagtttagactggctgccctgaagaagccctctgtctttctttgccaaaggcagtgtctctgttggctcgctgagcttcctttccagcctaaggggacatctgcagtttactcagcatgtttgcaaatctgagaaaactgacaatccctgagcttcttctgtgagggaagctcaagtcacctgtttcaccacctgctgtgcaactgcaggtgacccgtttggatgtgtctttttctgttgagaaacattactgtttataacagaataatacttaacatagaatgacaggaaataacaatactagacaaatgtttctctttaaaagaatgggaccgttatcttgcatatcagttcttctagctactaaaggaaaaggtcccaaaaaagaaataatactttacatttacaccacaagtttttcaaagagataaagtgggaggctaaaggtcactgtcatctttcatcttatgaactgttttttgatgttattttcttcagaacattaagagcagccaaccacctggttccctcattatgcaaaattattgcattttaagatcagattggatgttatttccagaactgtaagcatttctaatttgtaagagcactggttttttttggtgcaaaaaggatcgtttttggaatgattatactgtaataactgtagaagagatagttttatatgtggttggttgtgctgtcactttagttaaattcaaaggcatttataattattcaccatttgcaagacattcatatgtgcattctatgagactgctaaaggtaagtaaggtatagcttgtgcttgagtcctagaggagctaaatgggtatgatgactctcctcccagaggagggtgcatcatgacaaatgtcacctaccctgattctactaaacctatgccacagagagcacaagcacaaaggagctgcatgcacattccactcagtgagtctgtgccctgcagtaggtggacagtgagagcctgtgaatgtgaatctgccattcctgcaggctcacttggttcctgcatgcctcccagagcatgaacatttctagggcttaaaggtatccattttgcatataacatggcgtctaaatacaagtcagcagtaacttctagtgcttacaaggaaaaggcaatcagttttaatggtggaaatgccactattttggacttcttgtagggctatgtgacagtctccagcagtggcttcctatgggattttcaagaataacctggacgatagaagatttttgcctcatatgttgtttagaatttatcacccatgtaagatgtgaatctactgaaacagaaacataaataaggtgcgttctgtgtttctatgtagaagagagtatttaatcctaactcatgtatttattttggggaaaagtgtcagggaggatgtggcatttgagcagagatttgagggaagagaaggatttttataggtgggaatgggtagtggaaggaataaatttccaattcagcaaaccatgtaagttaatatgatgttcagggaatagtgaatagtctaataaggtttggaatatgtgggctttattataggaagaagaggccctaaatataggtttggatcagattgtgggggagggtagccttgaaagccactgtcactgtaagagtttggattttattctgtatgtgatggggaaccattaagttgtgtgtgtgtgtgtgtgtgtgtgtgcgtgtgtctgtgtgtgtgtgtgtgtcacagaatgaaattagcagatgtatcattaccagaaatggtcaggatagaatcctgaagtttcaaaataggtctttatagtcctacctattcctttcatggtggtcattatccaggaagcagctgaaaggagatgatgtctttcaggggatagcggtgtttaaggattaaacactcttattgaagtgtgtgtggactaagaggaaatgagggacatagactatcagcccattgtgctgctattgcctgtatattatatatgttataaacctactaacaattcagtgttatagttgttgctttatgaaatgtgatgtcttaaggaaattaagagaagagcaaaaatttatgtttactcttttctgtttactcacatacttatttaaaatttaaaaaatttatctatgtatttttattacaattttaaacataacataaaattcacgatttttaccattcttaggtgtatggttctgtggtattaagtacattcacattgctgtgcacccattatcaccatccatccacagaactgtttaatcttcacaaactgaaactccgtacctgttaaatacttaactcctcattcccttctgttcccagccctggcagccaacattctttctgtctctttgaatttcagtactctaggtacctcatagatgaggactcatgcaatatttatcctttggtgactggcttctttcacttcgtgtaatgttttcaaggttcattcatgttgtagcgtgggtcagaatttccttcctttttaagatgatataattttctattatatgtaaatatcacatttgtttattcattcatctgttgatggacacttgggttgcttctacctttggctattgtgaataatgctgatgtgaatatggacgtacagatatctgtttgtgtctctgctttcagttcttttaggtatgtacccagaagtggacttgttgaatcatgtggtgattctgtttatttttttgaggaactgctgtgctgttttccatggtgctgcaccattttacattcccactaacagttcacaagggttccagtttctccagatctttaccaatacctgttattttggttttttgataatagccaacctaatgggtatgaagtatcttactgtgatttttacttgtctttttctaatgactttgtgatattggagaaatgtctacttaagtccagtgcccacttttttttctttttttttttattatactttaagttctagggtacatgtgtacaacgtgcagatttgttacatatgtatacatgtgccatgttggtgtgctgcacccgttaactcatcatttacattaggtatatctcctaatgctatctctcgcccctccccccaccccatgacaggccccggtgtgtgatgttttgcactctgtgtccaagtgttctcattgttcaattcccacctatgagtgagaacatgcggtgtttggttttctgtccttgcgatagtttgctcagaatgatggattccagcttcatccatgtccctacaaagggcatgaactcatccttttttatggctgcatagtattccatggtatatatgtgccacatttccttaatccagtctattactgatggacatttgggttggttccaagtctttgctattgtgaatagtgccgcaataaaacatacgtgtgcatgtgtctttatagcagcatgatttataatcctttgggtatatacccagtaatgggatggctgggtcaaatggtatttctggttctagatccttgaggaatcgccacactgtcttccacaacagttgaactagtttacagtcccaccaacagtgtaaaagtgttcctatttcttcacatcctctccagcacctgttgtttcctgactttttaatgatcgccattctaactggtgtgagatggtatctcattgtggttttgatttgcatttctctgatggccagtgatgatgaacattttttcacgtctgttggctgcataaatgtcttcttttgagaagtgtctgttcatatcctttgcctttttgatggggttttttgattttttcttgtaaatgtgtttaaattctttgtagattctggatattagccctttgtcagatgggtaggttataaaaattttctcccattctgtaggttgcctgttcactctgatggtagtttcttttgctgtgcagaagctctttagtttacttagatggcacttgtttgttttggcttttgttgccattgcttttggtgttttagtcatgaaatctttgcccatgcctatgtcctgaatggtactggctaggttttcttctaggttttttatggttttaggtctaacatgtaagtctttaatccatcttgaattaatttttgtataaggtgtaaggaagggatccactttcagctttctgcatatggctaaccagtttccccagcaccatttattaaatagggaatcctttccccatttcttgtttttctcaggtttgtcaaagatcagatggttgtagatgtgtggtattatttctgagggctctgttctgttccattgatctatatctgttttggtaacagtaccatgctgttttggttactgtggccttgtaggatagtttgaagtcaggtagcatgatgcctccagctttgttcttttgacttaggattgtcttggcaatacgggctcttttttggctccacatgaactttaaagtagttttttccaattctgtgaaggaagtcattggtagcttgattgggatggcgttgagtctgtgaattaccttgggcagtatggccattttcatgatattgattcttcctatccatgagcatgaaatgttcttccatttgcttgtgtcctcttttatttcgttgagcagtggtttgtagttctccttgaagaagtccttcacatcccttgtaagttggattcctaggtattttattctctttgaagcaattgtgaatgggagttcactcatgatttggctctctgtatgttattggtgtgtaagaatgcttgtgatttttgcacattgattttgtatcctgagagtttgctgaagttgcttatcagcttaaggagattttgggctgagacgatgtggttttctaaatataaaatcatgtcatctgcaaacagggacaatttgacttcctcttttcctaattgaataccctttatttctttctcctgcctgattgccctggccagaacttccaacactatattgaataggagtggtgagagagggcatccctgtcttgtgccagttttcaaagggaatgcttccagtttttgcccattcagtatgatattgactgtgggtttgtcctagatagctcttattattttgagatatgtcccatcagtacctagtttattgagagtttttagcacgaagggctgttaaattttgttgaaggctttttctgcatctattgagataatcatgtggtttttgtatttggttctgttcatatgatggattacgtttattgatttgcgtatgttgaaccagccttgcatcccagggatgaagcccacttgatcatggtggataagtttcttgatgtgctgctggattcagtttgcgagtatttcattgaggatttttgcatcgatgttcatcagggatattggtctaaaattccctttttttgttgtgtctctgccaggctttggtatgaggatgatgctggcctcataaaatgagttagggaggattccctcttgttctattgtttggaatagtttcagaaggaatggtaccagctcctctttgtacctctggtagaatttggctgtgaatccgtctggtcctggactctttttggttagtaggctattaattgttgcctcaatttcagagcctgttattggtctatttagggattcgactttttcctcgtttagtcctgggaggatgtatgtgtccaggaatttatccatttcttctaggttttttagttgatttgcatagaggtgtttatagtattctctgatggtagtttgtatttctgtgggatcggtggtgatatcccctttatcattttttattgcatctatttgattcttctctcttttattctttgttagtcttgctagcggtctgtcaattttgttgatcttttcaaaaaaccagctcctggattcattgattttttttttttgaagggtttttttgtgtctttatctccttcagttctgctctgatcttagttatttcttgcattctgctagcttttgaatgtgtttggtcttgcttctctagttcttttaattgtgatgttagggtgtcaattttagatctttcctgctttctcttgtgggcatgtagtgctataaatttccctctacacactgctttaaatgtgtcccagagattctggtatgtttctttgttctcattggtttcaaagaacatctttatttttgcctccatttcgttatgtgtacccagtagtcattcaggagcaggttgttcggtttccatgtagttgagtggttttgagtgagtttcttaatcctgaattctagtttgattgcactgtggtctgagagacagtttgttagaatttcagttcttttacacttgctgaggggtgctttacttgcaactatatggtcagttttgcattaagtgtgatgtggtgctgagaagaatgtatgttctgttgatttggggtggagagttctgtagatgtctactaggtctgcttggtgcagagctgagttcaattcctggatatctttgttaactttctgtctcattgatctgtctaatgttgacagtggggtgttaaagtctcccattattattgtgtgggagtctaagtctctttgtaggtcactaaggacttgctttatgaatctgggtgctcctgtattgggtgcatatacatttaggatagttagctcttgttgaattgatccctttaccattatgtaatggccttctttgtctcttttgatctttgttggtttaaagtctgttttatcagacactaggcttgcaaccccggctttttttttgttttccatttgcttggtagatcttcctccatccctttattatgaagctatgtgtatctctgcacgtgagatgggtcttgtgaatacaggacactgatgaatcttgactctttatccactttgtcagtctgtgtcttttaattggagcatttagcccatttacatttaaggttaataatgttatgtgtaaatttgatcctgtcattatgatgttagctggttattttgctcattagttgatgttagttccttcctagcgtggatggtctttacaatttggcatgtttttgcagtggctggtaccagttgttcctttccatgtttagtgcttccttcaggagctcttttagggcaggcctggtggtgacaaaatctctcagcatttgcttgtctgtaaaggattttatttctcctccacttatgaagcttagtttggctggatatgaaattctgggttgaaaattcttttctttaagaatgttgaatattggcccccattctcttctggcttgtagagtttctgccgagagatccactgttagtctgatgggcttccctttgtgggtaacccgacctttctctctggctgcccttaacattttttccttcatttcaactttggtgaatctgacagttatgtgtcttggagttgcttttctcgaggagtatctttgtggcattctctgtatttcctgaatttgagtgttagcctgccttgctaggttagggaagttctcctggataatatcctgaagagtgttttccaacttggttcctttctccccgtcactttcaggtacaacaatcagacgcagatttggtctttcacatagtcccatatttcttggaggctttgttcatttcttttcactcttttttctctaaacttgtcttctcgcttcatttcattcatttgatcttcagtcactgataccctttcttccacttgatcaaattggctactgaatcttgtgcatgcatcacgtagttcttgtgccatggttttcagctccatcaggtcatttaaggtcttctctgtactgtttattctagttagccatttgtctaatcttttttgaaggtttttagcttctttgcagtgggttcgaacatcctcctttagcttggagaagtttgttattactgattgtctgaagccgccttctctcaactcgtcaaagtcattctctttcctgctttgttctgttggtggcgaggagctgtgttcttttggaggagaagaggcgctctgatttttagaatcgttagcttttctgctctggtttctccccatctttgtggtttatctacctttggtctttgatgatggtgacgtacaaatggggttttggtgtggatgtcctttctgtttgttagttttccttctaacagtcaggaccctcagctgcaggtctgttgtagtttgctggaggtccactccagaccctgttttcctgggtatcaccagcagaggctacagaacagcaaatattgcagaacggcaaatgttgctgcctgatcctttctctggaagctttgtctcataggggcacccagctgtatgaggtgtcagttggcccctactgggaggtgtctcccagttaggctactcggggttcagggacccacttgaggaggcagtctgtccattctcagatctcaaactccgtgcccagagaaccactactctcttcaaagctgtcagacagggacatttaagtctgcagaagtttttggtgccttttgttcagctatgccctgctgccagaggtggagtctacagaggcaggcaggcctccttgagctgcggtgggctccacccagtttgagcttccaggctgctttgtttacctactcaagcctcagtaatggtggatgccccttccctagcctcgctgccgccttgcagtttgatctcagacttctgtgctagcagtgattgaggctgtgtgggtgttggaccctcctaaccaggcgcgggatataatctcctggtgtgccgtttgctaagactgttggaaaagcgcagtattagggtgggagtgtcccgattttccagatactgtctgtcatggcttcctttagctaggaatgggaattccctgaccccttgtgcttcccagttgaggcgatgccccgccctgcaccgtgggccgcacccactgtccgacaagcccaagtgagttgaacccagtacctcagttggaaatgcagaaatcacccgtcttctgcgttgctcaccctgggagctgtagactggagctgttcctattcggccatcttgcatgagaaatcttttttttttttttttgagacggagtctcactctgttgcccaggctggagtgcagtggcgcaatctcagctcactccaacctccgcctcctgggttcatgccattctccttagcctcctgagtagctgggactacaggcccccaccaccatgcctggctaattttttgtatttttagtagagacggggtttcaccatgttagccaggatggtcttgatctcctgacctcgtgatccgcccgccttggcctccgtaagtgttgggattacaggcgtgagccaccgtgcccggccagtcctgtgcccacttttaaattgggttgcttgtttttgttgttgttgttgttgagttgtaggagttctttatatagtctagatattaatcccttgtcagatacatggtttataaatattttatatcattctgtgggtcacatatttaccttttctggtgctctttatttcttcctgtagatttgagttactatctagtatcatttccttttagcctgaaagagttcctttaattccttgttaggtgcatttgctagctgcaaatactcctagtcagtgttatctatctggacatgagttcatttcactgtcctcattaaaagatagtttggctaaatagagaattcttgggcaatagttttttctattagcacttggaatataccatctcactaccttctgacttccattgtttctgatgagcagttagtaattgttttgttgttcccctgtatgaaataaatcatttctctcttactgctttgacaattttctctggttttgagtttaacagtttgattaaaatgtgtgtgggtatggatttcattgtgtttattctgtgctgaggttcattgaacttctagaatctacataaatgtttttgtaaaatttggaaagttggccattttattgtaacatttttctttgcttctctctctgtttccattttttatggaacttctattatacttaggctagtatacttgatgtctcacagatatctacgactgtctatttttattcattctttttttccgtttttcaaattgaataatttcccttaatctgtcatcaggttcctgattctttcttttgccacttcaaatctcttgagcccacctaatgagtttttcatctcagttattgtgctttttaactccagaacttgctttttttttttttagaatttctctctttattgagattctttattgagtcgtttttactctttgattgattaaacctgatttcctttagctctgtgaacatatttataatagctgccttgaaattgaaatctttgctaagtctaacaactggcccaattgtagatcatatctgttgactgcttttttctggaatatgtatcacacttcctgtttctctgcatatcttacaagtttgctgaggactggacattttagattatacattgtagcagttctggattctgatttcctccctctccaggttgttgcttatttttttttttttttttttttttgtagcttgtctactaaatctgtatgctctgtctttgccatggtatgtggctgctaatgtttctgcttttcgtttgtttgtttttatttttaaccctggcctctcaaggttagcccctgtatcttcgtgatgcagtgaccagtggttggtcagattataagggcaatgggacttgtgtgagtttgggggcatatccaaattttaggcagttttcaagtatactagcttttactttctgccaagctaactcatacctcctctaagtgcgctgtagccacctcgacagcctagagatatgtagagggctagggcactgcccagtttctccgtcctacccacactgccttccaggcagccacggatgcttggagaatttatcaagtgcctccgtgtctgcctcattttctgttaaatttctggttagttcactgcatccaggaccaagcgtcaggctctctaagcttctacccttcctgcttgtttgtcggttttttggttttgttttgtttttgcttttcttgtattctctcaatcaagttagcctcttcctgcaaagctggtagaaccaccatgctgaccaacctggtgggtgagggattgcagccctaggcaggaatgccatgggctaccactgtcctaactcaaaatcagtagctatttttatgaataaattcttaatttgttgtatgcctttggttgatttccagagccctgatcctttttttttttttttttttttccagttttgtttagtttcctcattgccttttgagatgaggactggccatgctcctcattctgctgtattgtgcttctaaagatagttttcaagtaaccaaggtgagacaggagatcaacaagactcaccagtctgctgatcagaacacgatacaaaaaattagccgggcatggtggcacgtgcctgtaatcccagctactctggaggctgaggcagagaattgcttaaacctggaggggcagaggttgcagtgagctgagattgcaccactgcactccagcctgggtgacagagcgagactccgtctcaaaaagaaaaaaataacagctagaactaggaattataatatatttgcataagatactccaaccagcaccaagacagtttacaaatgatgccatggcaatgatctggaagttaccttatatggttctgggaactccccaccccttttctagaaagtttgtgaataatttagcatataattaagagtgggtataaatacagctatccttgcaggttgctttgggccactctgcctgtgggatggccctgctctgtctatggagcagccatttggctatacgctgttgctctaataaatttggtttctttcactgtcagcttgctcttgaattgtttcttgagcaaagccaagagccctcccagagtttcttgagcaaagccaagaaccccccaattttggggttcaccagcattattaggttttcctcattttcatcaagaatatatttataaaggaagaaaagatttttttgtttgtttgtttgagacagagcctcgctctgtcacccaggctggaatgcagtggcaccatctcagctcattgcaacctctgcctccggggttcaggtgattctctggcctcagcctcctgagtagctgggattacaggcgcccgccaccatgcctagctaatttttgtatttttagtggagatggggtttcaccatgttgcccaggtgggtcttgaacttctgacctcaggtgatctgcccgcctcagcctcccaaagtgttgggattacaggtgtgagccaccatgctcagctgaaagaaatagtttttcaaaatatattactgcatagctcccttaaacattcatatctccaaaaaagagataattataaaattctctgaaatgttcatatttcaaacataagaagggattaaaacaaaaatgttttcttgctaataatcagtcttttaaatgtatctaatcgcttttcaaaattttaaaatttaatactttctaaaaatatgcaacttctgtaattatcagaatcaaggcactaaaatttcttgggaaataggaaaaaatttcattaacaatgttatagtaaaactgagaaccttatttctaataaaaattaaaacattcacttaaaaaggaatattgagccaacgtctacctcactcttgtaataatatagtttcctctatacctttgatgtaggcaaaccccagggttctaccagttttgctgcaagaggaaactgatttgattgagagaacacaagaaaagcacacacatacacacaaatacagcccctgcccagcagcaccattggttacagtgacctgggtgacggacatgcaggaagtctagaagctcagatagcctgaggctgggtcctggctgccgcaaacagaccagcaaactaaccagaaatttaacaggaagtgagacagtcacagaggcacttgataaactctacaagcctccatgacgtgtaattgttatgacatgtaattgtcccaaggtagacttactggctttttctatcggtagagtggtggtggccataggttgcaagcatcctggcctcccagctgccacctggtctagctgtttaaagaagtaagccagtggtctaggattcttcctgaatctttcagttagaacacccaaagctattccttgtttttcagccacataaagattgctggatcaatccattaggaatgcctgttagcaggttctgtctcaatttaaaggctcctgattattcccttttagagcttcatagagtggttttgctatgagcccaaacctgggaatccaaatctggcagaatccagccattttccccacaatgtttttttcttttttttttcttctctttttttgagacggagtctcgcacttttggtccaggctggagtgcagtggcacgatctcggcttactgcaacctccgcctcctgggctcaagcagttctcctgcctcagcctcccaagtagctaggactacagctgcatgccaccatgcccggcaaatttttttttgtattttagtagagatggggtttcactgtgttgtccaggctggcctcgaactcctgagctcaggcagttcacctgcctctgcctcccaaagtgctgggattacaggcatgagccactatgcctgccctcctcgcctcaaaaaaattcctaattgtttcttagtttcaaggggctggagtgccagaatgaattcttttcattcctgggctaagtccttgtcccaagggtgagaatgtatcccatgtatttaactttttgaatagaaatttgggcctcgttgggggggtatactcaataccctcatttccccacaaaattaaggacctgtattgtatttttttcagagtcctccctagtaacgctgaaaattaatatggtcattcacatgttgtaggaaggatccatttattaagctgtagttaccttatttcttttgccaatgcattttcaaataaatgaggattatccctaaaaccttgagggaggacagtccaggtaaactgaaatgtagcaagagtgtctgcattagtccattcaaaagcaaaagtatactggaaatatagtgggagtctgggtgcaaatgtgtgctaaagaaagtaccccttaagtctaataccacgaatcagttatcattttcaggggtcaatattgtgtaagaattaggagctattggagctattaggagctagtaggagtccttgtataaggactgggagtactgcttcattaactgccctcagttcctaaattaatctctgttccccatttgatttacttatgggcaaaatagggatgttacgtgggtactgacagggccagttagtactttaaagtctatactttaaaagctttactgtcatgggttgtgggccccattgtgtttctggtctcaaaaattattgtttttttccgtggtaaccaacattgagttttaaacaaaactggactggggttacattagcagctctaccgggaacttccatgtctgaaacagaggactacttgagaagtgatatgcagtggaagagaggtcttttctttacctgtatgaaggcaagcacttagagctagaagtagtattcctgcctggcctattgcatttttatgaggctctcctaattgaactgtggcctgtaagtgggaacataagtctcttcccagtaaaggaataggacacttaggcataagcaagaacctgtggaaaaatgtgtggtcccgcatggtacaaccaaaggagtatgtgaatctcctaatttttggctggttgtcaatcccagttatggtacaagactgtaaagacagtatccctgagaaatgggtcagcactgagaaggctgctcccttgtctagtaagaactcagtatccttgcctgctacatcaagggctatctgaggctcctctgtggagatggtaaggtgtcattgggagctctggggaaccttggggcctatcagtcctctattctcttggccattatgggtttgggtggcctttggagcctggggtagtcccttttccagtggccctcttagtgacagtaggcacactgattctggttacaggaccagcaagtcaggggctcttgtctgggcattccagacactgatcttgcaacacttcctcgagatggataaccctgaggcagaagagtgcttaaggcagttgtgaacgattgtactttttggctatttcttttgtgtgtgttttttctgcctgctttgcctgtccctatttttgtaaactccaaaggccatgtttaagagttagctcatggggggttgaggtcctatttttgcctattgtagcttcctcctaatgtcaggagcagattgagtgataaaatgcataccagggatagctcaccctttcggggaatctgggtctacattagtgtatttcctgagtgcctcaaccaaacagccctggaacagagagggattttattcttctcctgagttacttctctaaccttgtcataatttactagcctaaccacacacttttccataccttttgttaaacaagttgccacgtgatttctgcatttaaggtcttgggaacccctctggtaatcccactgaaggtctggatctggaactgcatcgcaccccacaagaaaaatggctcggccttggttatgagtggccactccatctacatattcatggacagtacccagaatcatttgtttatcctctaccatacatcagatggacaataatatttgcaactcatgtcaagttaagtcgaaagacttggccaacttaataaactcctatataaacttctctggatcctccaaaaactgaccaaatttctcctttgcataaagccaaatcacacatagaaaaaggtacatgtttgtggactctccctccatctccatcagctacctcctgcaagggatgcaggtttgatttggggggctgatgtgaggtcccactcctggtggcactggttggattcacttccttgggcagtcgggggtataggctgaggctagctgtaaaagccggaggggtgtttggtgactttgggggtagaatcttacactggagacctggcaggacccccctcagaatcaagggaccgagggggctcccaggggagagagtgtggcccttctaggtggagtggctagaaggagataatctaggatatctggtgtggcttcttggtgcctggaagtaacatgagctagacacatcctacagttgtcccttaagtcaagatcctgataaaatgccataaaagcctgcacataaggggcctctcctcatttttcctcctttttacagaataagtccaattgtaaaatagtatcataatgtaaagaaccatttttaggttgggtgcggtggctcacgcctgtaatcccatcattttgggaggccgaggtgggtggatcacctgaggtcaggagttcgagaccagcctggccaacatggtgaaaccccgtctctactaaacatacaaaaattagccaggcatggtggtgggcacctgtaatcccagctactcgggaggctgaggcaggagaatcacttgaacctgggaggtggaggttgtagtgagccgacatggcgccattgcgctccagcctgggcgacagagtgagactccatctcaaaaaaaaaaagccatttttaggccaaatttcttggtttcccaatttgtattggacccaagtggtgttgctaaactaaagaaaattagtttctttttaagcgatttaatttgactttgcttcagttgcctaaaaagcaccctagcaatgagtcctctgggatgcttcccgttgtccccctaacagggatctctgctagacagtagtacaaatgccatcaattcctgagagcctaagtacagttagggtgtgaagaaagtcaattatgaggtatgaatgggtagtgaagtgatcactctatccagcagcaagcagaatatgacaaaagaggtgttttttttaagacagagtctcgctctgtcaccaggctggagtgcagtggtgcgatcttggctcactgtagcctctgcctcctgggttcaagcaattctccggcctcagcctcctgagtagctgggactataggtgcgcgccaccatgcccagctaatttttgtattcttagtagagacggggttttaccacgttggccaggatggtctccatctcttgacctcgggatctgcctgccttggcctcccaaagtgttgggattacaggcgtgagatgctgtgcccggccaagagatgttttaataagcaaagtgtagaaggataggtaaagtagggtgacaggattctcatagtctgaattccaaaaaaagcacagaaagaggaggctgaaaatgatcagtatgacaaagaccaacaaccctaacagggtgccaaatgctgaaaaacctggaacatgaaatgccaaaaaacccagagcatccaggagttggcccatcatgaaccccaaaggcacgagacctaacacagttggggccactggacaacgtgactctggcatcccaaagttagcacaacagaggacttctgaaaattaccaaaagaggattcaaaacagactaggaaagtgtcccgacttacatagaatagaaacagttgctcagatagccaaagcaaagacaacagatgtgaaagaaaacaaaataagcattagaataaaacagccatttattagagactaaagagacaaaaagatttgagagaaagcgtgacaaggacatggcaggcgtgctcctgtctgggacacccaaatgataggggataatgaactaccaagccagaggccttgttccctcttcttggttcacccaaaaagatcaatgtcaagggggaacagaggggagactcacctgtccttcgaagccatatggtgttgattggtcttaaattggcatctgggtgaaggtttccctcagttttgcttagattattagtcaccaggaatgatgattggctctaaaaagagcctttggctcctgtacagctctacagccttatagagttagagctccatagtgttatagctccagagccccaatttttactgagcccctttgtcatgttcatcttgttcagtgttgtttattccttcatggttgccaggctgatacaagtgaaccccagaattggggctcaccctgggagagttcttggctttgctcaggaaacaattcaagaaaagcaagttcttacagcaacagtgtccagccaaatgactgctccatagacagagcagagctatcccagagcagagtgggcagagtggctcatagcagcccttgtggattgctggctagctatatttatacccacttttaattacatgctaaataaggggtgagttattcatgaactttctagaaaaggggtgaggagttcccagaaccatgtaaggtaacctccaggtcattgctgtggcatcatttgtaaactgttgtggtgctggtgggaatgtcttatgcaaatgaactataattcctagtcctagctggtttgggctggtctctttactacatcatagtttttgtttttgttttcattttgtttttttaagagacaggttttcactttgttgcccaggctggtgtgcagtgacatgatcttggctcactgcagccttgacctcctgggctcaagcagtcttcccacctcaggctcccaagtagctgggactacaggcaggcaccaccacactcagctaatttttttttttttttttaagagatgaggtctcactatgttgcctagactggtctcaaacacctggactcaagcagtccttccacctcagcctcctaaattgtggaactacagacatgagccactgtgcttggcctacattctgttttgatcagcagtgtcatgaaaacaagccctgttaatctcctatcttactagcaaggtgaagaaatagaaaaataagaatatcataatcatactaccgaggaatagctaccatacaaactttggtgtctatcctaccagaattttttcatggatattttctgtaggttcaaactatgcatctatattgaaactctcttaaaaaaaatagtaaaagttggtgaacaatttccaatgtcattagatactcctgtaaaacataatttttaggaggggcagagcaagatgactgaatagaagcctcaaccagttgttcctcccccaccccacggaaggacattattgaacaactatccaaaagaaacaccttcataagaaccaaaatcaggtgagcactcacagtacctgttttaactctatagaactgaaatggccactgaggagggtaggagacagtcttgggttaccagcaccacccctccaccatcctccagcagtggccgcatggtgcagagagataatccatgtgcttgggagacagagagagtgtagcagttgtgagacattatatcgcactcagtaatgccctgtcacagcaagaagcaaaagcaaactaactcagctgatgcctgcccacagaaggaatatttaaaccagccctagctagaggagaattgcccatcccaacagttggaaagttccggcaagcctcaccaccttgggctaaagtgctctggggccgtaaataaacttgaaaaacagtctaggccacaaagacttgaactcctaggcaaatcctagtgctgatgtgggctcagagccattggactggagaggcacgcgagttactgagacactgggatggctaagggaatgctggcatcaccctttccacaaccccaggcttcatagcttgcagctccaattgagacccttttcttctgcttgaagagaggagagggaaaagtaaagaggactttgtcttgcatctttgataccagctcagccacagtagggtagggtggtacccgttagagccacgaggccctcttcccaggccctcattcctggacgatacttctagacatacccagggccagaagggaacctactgccttgaagggaaggacccagtactggcaggacccatcacctgcagactaaagagctttgggccctgaataaccagcagcaatactcaggtagtacactgtggaccttgggtgagtctttgagacttgctggcttcaggtgagactttacacattaccagctgtggtggctacagggagagacttccttttgcttgcgaaaagcagagggaaaagtaaaggggactggatcttgcaccttaggtactagctcagccacagaggggtagaggactaagtgggcttttggggtccccaattctaggacttgactcattgatgacttttctggacttgccctaggccagaggggagcccactgcccaaagggagcatcccacgctaggcacccttcatcataagcgactgaagagccctccctaagggaacatcagcagtagcctggcagtacgccccataggtctatagtggtggtggccacagggtgaggttcctctgcttaaggaaaggggagagaagagtgggaaggactgtctcagtgccagctcagccacagtacagtagaacaccaagtagacttctaagatttttgactgtagtccctggcttgctgatggcacctctggatctgcctggggcttgggagctcgccaccatgaagggaaggacacaagcctggctgacttcacttcctgctgattgtagagccccagggccttgagtgaacataggccatagccaggtggtagtcacagcaggccttgggtgagatcccagtgccagcttctggtctgaccaagtgcagtcccagtggtggtggtcacatctccaggcagctcaaaacacagagagagtctctgtgtttgtttgggagaaaataggggaagagaacaagagtctctgcctggtaatccagatagttcttccagatcttatctaaaacataatttttaaatgactacatagatatcagtagtatatatgaatatttattttaatttttttgttgggaatttagatatctctttttaaactgtcatttattcagatcaaattacttgatgagcacttacggaattgggcatgaagaatttcaagacttttaataacatttctaaactgacccctctgttcccacttccacccccaatttagaatttcaccagtagtatgtaaaaaagtctattctaaactctgcatcctggccaggtgaggtggctcatgccagtaatcgtagcatgtttggaggtcaaggcaggaggattgcttgagccgaggaattcatgaccagcctaagcaatatagcaagagcctcctctaccaaaaaaaaaaaaaaaaaaaaaaaaagccaggaacagtcgtgtgctcctgtagtcctagttacttgggaggctaaggcaggaggacagcctgagcccaggagtttgaggctgcagtgagctatgattgcaccattgcactccaccctgggtgacagagcaagactgtgtctctaaaaaaaaaaaaaaaaaaaaaaaaaagaaccaaaaaccaaactaggcatcctctctaattaatactgacttttatcaagaaacaagtaagtttgctaatttaatagacttaaaatgcttaattattagtttatatttcttgtctgttattgtctttatatcacatcatttttctttttaatttaaaggttcatttaaatttatcatttatcatctcacaaatcttgatttaagtcttgatctgaagaaatgaaagttaaaaaagaagaaatctaaatttccaacaaaaaaacacaaattaaaataaatatccatatattattactgattcctatgcagccacttaaaaattgttttacaggagtacctaataatataggaaaatgtttaccaaatcttatttttatttttttaaagcagactttataagacaaatgtgtagtttgaactcacagaaaataacgcgtgaaaaaaaggctgatgagttcccctttacaaaatggaaatggaacttttcaagaagaaatgcttattacgttttttacatggatttatttcttttgcctttaattaatgaaaaaaaccagtctgaattgtattgttttgtaaatatgtgttctatattttgaatctttggatattgatttgcattgctgtatcacaatttgcttatatttaatagcatcaataatttttttagacttctgataatcagtagagaggcttgattgaaatatgttcccctaaagcccatatttgatagttttattactaaatttagaagccagtaattaaactattttcttataattatggctatattttagttcaaattgctcatcctaaagccatcaggtcaaatgatacttgttctgaaaatatattaataaattgggaaggattccgtaatatttctgttcctataattctctgatacgtgtatgctaggcagcattcatctcaaaaacagtaaataaaactactcagaagctttaagtaactttagctttactatatctgaaagacaaaattgtattctggtaaatgtagctatatcattcattatcagttagtatttatatttagatgaatgtgattcaaggtctcaggccaaaataaatgccaagagatgatcgtattatctaaacaattagagcattggcacaaattcttgggaagctgttgactttttaaccaaagtgttaggattctgtttttatttcaccttggcattttaatttcttaaaattcataatgttcatcaactgcaatgcttagaaatccttaccagaccattttcagcaaagtacaaatatagtttctattacagttctgtcctctagtacaagttgatccacttactctctgctgcttgatagttctagagaacagcattgaggaattctgatgattagtcgcaaacaacattgactttaaaaaatggatagtttcccaaacatattatcctccgaattattcttctcgctctttttattatatctgtttatcttattcttagtcatttgtgaggttttattttttgtcttaaagaaaatttactttaaatagagaatttgtaaaataccgtggattacatgcacctgtcttttcttgggttagtcttgtatctttatctaaggaacactgggagctagaggggaccactgttccattgtgaaagagtgaaggtttgtatggtgtttcctctattgtcagaatcgcacgggctactcatgatgtatgaacagtagaattaagtagaatatttgagcctatcctgttctggactcatcctcttagaaacgttctttgttgataggattcctttgataaaccgattgaatgctctgtcctcttaattgtgccatgctataaataagtcagttattaaaagaaatggttgatgttttatagactgaatgcatacttgtagagcatgttgtagaaagatactttattgaggttagttccagtgattgagtacacatacttaagtttttaactctttggaacccaagagtagaataaaaaattatttacaaaacgtatgtcggttctgacatagggtattgtttttcctttggaggcatttttgaagaaaaaaaaattacacattacaaaaaccagattaaagagtttggcatgtacagctgtgtgtgtgtgtgtgtgtgtgtgtgtgtgtgtgtgtgtgtgtgtgtttgagactaagtcttgctctgttgcccaggctggagtgcagtggcaccatctcggctcactgcaacctccgcttcctgggttcaagtgattcttgtgccttagcctcctaagtagctgggattacaggcacgcaccaccatgcccggttaatttttttttttttttttttttcttggagagggcatttcgccatattggccaggctggtcttgaactcctgactttaggtgatacacctgccttggcctcctaaagtgctgggattactgacgtgagccaccatgcctggccagcatgtacagttttaatgagaggaaaataccaaatgaagagcaaatttttatttgtttgaaggtctcaattgctgcttatttatgtatttcagcaatacccttcccaatagtgtcctgaacttgatgtttacttgtggggtgtgaatgttaattaattatacagtcccttaaagagtagtggtatacatgtaaaggaaaatctttttagaaacataaaaacataaaaaggaattagtaaatttggagttttattctaaatactgctgttaaagggctacaaaaaataatgggcttataatgaatcatggcaatttagtcaaatatttaaaatatctaaaatgtttatgagacagcagaatattttatagtagaagtaataggaaaaaaattttacagaaattttttaggaatagtaattacatgtctgggatggtttagaacctacctaaataaaggtaaaaaatacagttttatagagaactagaaagtggtttgtgaatggctaattcttaaagctccattgataaccttggggagaggcagaacatcctagattaaatagaaattgtgtttctgttatttcatcaagacagggttatacagttaagtatcttggctaaaatctttatagtaaaattttgctgacatgaacatcgctggtctgggaattaaatattcacttaagtactatttcatgaacagtgccagaatttctgccagaaaggtaaaagatatatttatattgcgttttttatagctgaaatgtagcctgtaaccgagtggattatagtaacttaatattttgatgcaggaagtaggaaaatattaaaaattgaaaggtggttttaaggaaattgtaatggttctgttcagagtttatgagacagccttattctgtagacttttaaattatgaacttcccacctatttttatgtaaatggtgatgtcagtttcagcctttcctccatttgccttaagccagagaaagagagagggagagagagaataagagagagagaaacaccttgtgttggggccatcaaatggtttttttgatagtcatcagtggtattcacaaaattctggttttcttgccttctgaggttgtagtaacacttgcacttccccatcttgctgaagttaggactgaccatataacttgtctaatgcaatgtgatatatattccttattggcagaagagacatctgtcacttctaggcagaagctttagggactggtggccttccaaattgcagaggctccattagcctgcagccttcagtaaggaagtggaaccaagtactcactctcctgaggtggacatattatgtgaccaagaaatacactcatgttattttgagtcactgagattatggcagtgtttgtaactgttgtgtaagccagtctaatctgacatatgcagtatgcaatttctttatgcctaaggttaaggaagaagataataacgtttctcaccgactaaagtgaccatttatttcttcggtcatttttgttaacatttactgtgtgccagtcactgttctaggtgctaggaaaatagagggaacaaaacaaagcaatctcttcttcccactctttgttaattctttagggaacctcctttgctgtgaagcctttccctgccctctgagctaccggttgctcctttctcgtctgtgttcctccggcactttgtagatatcgtcattgtggcactgatgttatcatgatcattctatttctgtcttgatttctagactgtttctataaatgttttaaatatagtacatatataatattgaaagtaatataaaatgtgtaggcaaaacaagttacacattatataaaatgtataacagaagaatatgtatacatacacatagatgctttgcattatccctttattccctttatgtcatcccccacatttcaaaaaaatattttttgaatgaataaataaggcttcctgtgggtcttttaggcaaatgtgatttgggaacaaaatgtgaacttctatattttgggcatgttcttccaatgcctttgctctgtgaattcaaatttaagagcattactaatggatgagaacaggtctataccaaattacctgggcagaaatgtgaatgaacaggggcgggggaagcctattaacttgtcattgtgcctcttccctttacttagctatatatatacatatatatatatacacacatatatatatatgtgtgtgtgtgtatatatatgtgtatatgtatgtgtgtatatatatgtgtgtgtgtgtgtatatatatatatatgtgtatatatataattgttatacccttttaccagtgtttctcaatcttttttccattatcatcccctacccccagtctttttggactgttgccccctaaatgcccccaatgagattttactgccacagaaataccgtatatctgtttatgtattgaacgtatatctgtgctttataaaaaaatacagtaagtctttttgccccctaagaacgagttttcttggttgatgcatgccttcaactaatatttgaaaaaggtaatttttttttcctttgtaggagggcgtttccccttcaataagctaagtttaactctactgagtcacaactctgttatttaatacacctgtgcttttgtaacagctttattttaagctaattattatttaaataagtatgctaaaatcttagtttattgagaacattggcaaattaacttttatatattttatggaagtcaatttttctagattgaaggcctctaaaccacgcattctgtgcaaactgtatttgccttttattccttcagcatatacttactgagcgtctagagtgtgcaagactctgccagagctgaggacccagtgaatcgtggagttcagtctgcttcctttaactccttgctagccaggatgcgaatatgggtcatgtatacttgtctagtgcagagtcgttttgaccatactgatttttaaaacatcaacaacaaaatgttgtgggcttttagtgaaaaatcctggaagttgaataatccctcatctatcattctttatgtatagcacatgaaaaggttgagggccaagtcccacaatatgcgaagtcagtatagttggtattttcctgttctgtcctgcaagttgtgaccattgtctggctacaccagtgcacattactctatctgcaatgtgggaatctgcttaaattcttgggccattctgtataaccagtgtagtatatacatatatgcacaacaaaacagggaaacctcaatataagattcacttaaagaataagattctggttctcaccactgttgaattgccaaacaaaaaggatgaagtatatagtttcaagctaaatttcagattgcgtaggaggcatggggcaaatatgtttcagaaagaacacaagggagtacaggttatctggaggctttggtttgagtgcccatccagagatagagccattcattcatttatttgttacagaaatatttactgacctcctaatctttgtgccaggaattttggtgagtaagacaaaaggctctcattttcactcatcctctctgtccccatttcttggacaaattgtgtaggacattttaacattgagcaagttttcattcattcattcattcattcattcaatgtgtgtttgagtgtgtataatacaagtacattattgtgagatatttaaaaaagacatctctgccctcaaggaccttgcaagcttgtttgttcatcaaccagtcatttatttaaaaaaaaaaaagcattgagctagtaggcaatgtgccaagtcagtgctagggaaatacagagatgaacaagagcacacagtcggttcctggagggctgcgtctcagcctggagaggcaaacagcttgtaacatctttggaagcatgcagtgtggtaaatgacaataatgagctcgtcccactgtattgcgagagtgcaaaggatgagcacagaagtggagtttccagaattagttctgtgtgggtgaaaggtcaagatgtgactctccatctgactttttagttgaggctggagagaagggttggcttggaaaggagattggagggagttcaatcagaagaaacagtttaagtgttgataaggagctttataaggcacgatgacagctttacagaactgcaaatactttattttgatttggctgcagaaggtgggggtagatgaattctaatgtagtgaaacaattgcaacaggaatgccaagaactaagtccttgtagtactggcacaatgtatagttcagtgaaacagcccagaaacagacaaacacactatgtgataaagtgggtatcacaaatcaacagggtgttaagtaataatattgagacaattgataaactctttggaaaaatagtagattcttactccagatgatttttaattaggacttaggggctaggcacttagaaatttgagaattaggattgatttctgtgaattaaaatttaagatcaacagtaatggatcagagggtgggggtgtgtgtatgtgtaaaacaagttaatcttaaccaaatatcttgcctactgcctactgcctactgcaccacctcgttgaatgtgtcaatcctgtgaacatggccagcttcatgggccctgcactcacgagggccgtgcatttggtttaatgctctgctcttgttgtcctttggaaagtcttaatttttgaagatggggcccatatatggtggtttttgtttcgttttgttttgttttgtttttgcactgggccatacaaattatgtagcattcctgcctatgaagttggccatctctggggacagaaagttagagagccaagctttagaagtagatatccttgtgttctctggagagtcgcagccaacccagttaaagtgtcccagacacattggcagggccatccctattgagtgcctcaggctatccagcctgattccctgaaacattcaatttatttaacaaagtttcctacttcccatttcctgctcaccaagcaatctttcaatagtgacttggctgcttctttggttttccagcagggagagatctagctagttgtgctggtcccatccttcattcaggaaggtagttactaaattggcaatctggtttcatatgtcagtgaggttctttaatgtgagcctgcttctgcatgactggtccattcctgttacgtttctgagactgaaggctgaagtccaggaattacgcgggtaaattcaccaaagcagtcatgtgtagaatagtggttaagagcaagagctttggagtcaagacacacaatcctggataaaacgtgggtcctgtcacttactaggatgtatgtatgatcttggctttcctgtgccctagtctttcatctgtcaagtgatgacattaacacctaccttaaggttgttgtgaggttgaatgagatgatgtactttagatcagggtttcttagcctcggtactgttgacattttgggccaggtaattctttctgttcagggcggggtgttcggtgcatcatagaatgcttccagcatccctggcctgtacccagtagatgctagtggcatccctctaaccccctatagttgtgacaattaaaatgtcacagaggtggaatcacctctggttagtacttggttaagagtcactggttaagagtctcttggttaagagtcactggttcaggtgtttagagtggtgcctgggggaaagaaaatgttttatgatataataataataatgggaatagtggtaccaaagatgatactacttttgatgccaccctgagggacctaggaagacattcgtcagcctttcatttattctttgtccttaaatttttatatctatgccagaataaactccatgtagattaaatagtacatgtaaaaagctctacctttaaacaactgaatgaaaaagaagtaaatcttcagatttgcaaataaggaaagggttttcaaggtcaaaagcagtgatacttctgtgatgtttaatgttgggtttaaaacacattggggaattttctttcctcatagatatcatgacattaaaaataaatatgcataatctataaaaactttgtagttacaattgaaaagcaaattggataaaatgattgtgagtaatatgacagataaagtggtatgaaaaaactaatttaagtcaaaaagaaaaccaaatatttcctatagataaggacaaaggaggaaatacaaccatcctataaacatttgctatggcttaaaatctttgtcaatttaaataaataatttaaaatttttttaaatattattaaattcaaactatttaataattttttaaaaaattttaaattatttatttaaattgacaaagattttaagcaatagcatccaattctgttgtacagttaggggggtcttattacatattttttgtcggacaatcgataggtacaatccttctagaaagaaacatggtgataaatgtgccctaaaaatggtcatacaatttagcccctgcaaataactttgggaataatgcttacagcataatctgaaatatagacaaatatcgatgcatgaaggtgtttactgcaaagttgttttaatataagccagctaaatgttcagtattagagaagtagttatttacggcatataataatctgcaatccttaaatgataatctttacacagtgtttctaatgacatgcaaaattcttacagtgttaaatgaaaaaagtaggtttttaagttgcatatgcaatgtaaactcaacccagaaaaaagactggaaggaaatacccaaaacgttaatatttgtcgctgaagtacgcaaaatgttaatatttgttccataatatttagattatggataatttgtgaaagttagtcacaactatatgattaaattcatcatttcatggcagacagccttttcttttgtttctgttcctttaggtaatgtttagatatcatgccttggaaatgaaaatgaaaaggtttaagctatgtttctctaaataggagaaataaaaaagaaagtgtcaatgccctaaaatacagctttatttttaagtaaattataaattgcaatatgaaaccaattttggggggtagactgcttctcctggttgaggtgaattaatggttttttataccgtggtactctttttgttcattaagtgttaacgatgtactcattgtagtatggtttttgatgaaacaatctttaagatgttcatttttgtttttatagtatgtgcagaagcttataatcctgatgaagaagaagatgatgcagagtccagggtatgtaatttactgaatgaatgaattttaaattgatgcccttgtcatatataaggaaaataatcatagaaaagatttaacaggcatgtaggttaacaggagacataatggaattattttgactgtttcttttcctagtctcatctccaatagcctactcctgctgtgagtcttgcagaattatttttatccagagagtatttctctttacaaaatgtatcctggtgatgaaaagtgttttcagctgtctttctcatagtgataatattatttttcttagacagtgtttttagtaaacaaaaatactgggaaagaccttctacgcctattaatttataacaacggaaagttactctgaaacaaacaaatcacggtaaaatcacatccagtgtgtcagtacagcagttaggattattttttaaatctgtgagtcttcatagtttgctcagcagctgacttcttgcaggccctaatgtttttgtaagaatttgtccactgtgatttcagcagtttttaagctatgtctttcagctcagttctactatttatttagtaaaaagtaaactaaaagatgactatgcctggaaatggaaagtagtaatttctgcatcaccctccccccctttttttgagtacatgtgttgcaaaagtgcctcttgtttctttggccttaaacagtataaacaaaaacttatttttgtagctctgaaaagtacataagtaagattgaggtttcatgtggagaagcagctactacgtccctaagtcgttacatcattaagctccttgaaacttatgtaaaatccagtggtatcaggaggcttacaacgtggaagatcttgaaatctcattttattcctggacccatggggattcccactaccagggttgtggaagctcatttctcactattagaacttcagttcttttcatgaagtttataaatcctagcctggaaatgatgttgttttaggattaaggtatttttactaatctgtgatgtgctgttacccctctgtatagtctgaaaaactagaccttgcctaccgtatactttatgtatctagcagaaacaataccgggtggcaatgaagacaacatgcttctttatatttgtgtataaatgagtatgataaaatttagtaattgagatcagagcaatcgagatgagctggtttaaattaataaaaacctaaattaatgaacatttgcaatacagtttaaaaacaatatgcagtatctcattgattcaaaagctgttaggccttgaattttagctgccatttaattgatgaggtaaataaagtgttttggcaggttcactccagctaatttctaatagttttgttggggaggctataccagttaagattcatttgactgtgtaaaacctcaccctatggagacaaatgtgaaaaagaaaacactggggagagattatcagacaaatgcttggagatcatattgaactgcagaaagcgttcaaaggccaagctgtaggcctggcaggcaggagccagcccgcctctggtgtccatcaagagcaagagtgtaagacttagcgtagtgtctttgaaacgggttcagctacccatctctattactgtgtctctcagttcaaaattccaatttccaaagagtttctgatggacccagctttggcccagggtagggccagggtcaaaaagtccaacctacttgggaaccacttctgtaaataagggcagttactagaggaggaggaatctttgtggggtgtgtatttaccctaagatctgtcccctgtaacaccttttaaagttatatttaatagtttttttgttaatgtattatatgtttgattatagcaaagtacttttaggttatcaattaggttgagtattctctcctctaaatgtgttactaaaaactatacttactttagtctcaacaactatgaagcaaaccataccacatgcttgggaatgattattacagatttcaaaattatttagatgtagaaggatattgggaaatatctatgaggaaaatgtatactatattgtgataaaattacatttcatttggacattttgtattacttctgagactcaccaaatcagtaagtctgtagtataaacagaaatttatcgtctgatatgaattcaaagaaaatgtaaatacttaagactcattttggaaaataacagattttagttggaatgcctttaataaatgaaaatgtaagggttatctagatctagcatgtagaaactggtagagaagagctaataagggtagagtatttcttatgtttctccacaaaaattttttggagttccacctgtatatctggcctggtgctaggtgtaaagtggtgagcaaatggacaagtctctgccctcttggagcttacagtctagtggcagaagcagacaagtgaataaattagtgaaaagttaaaaaacatgaagtgctaaagaaacagtgaaacagtgtaggaatcaaaacacagcccccaagcctctgggtcaagtgattctcatgcctcagcctcccgagtagctgggactacaggcatgcaccaccacatacctggctaatttctgtatttttagtagagatggggtttcgccctgttggccaggctggtcttgaactcctggcctcaagtgatccactcaccttggcctcccaaactgttaggattactggcgtgagccactgtgcctgaccgatatacagtgttctttaaagaaaatgtctaagttaaaaccttacttgttaactgtttttctaattttttttttttaatggaaaggcagcagaaatttagagcagaagttggcaaactttttttggtaaatttttttttaactgaaaaatgcactattttcagagagtaaatattttaggctttggggagtcatggggtctcctttgcaactactcagttctgctatagtagcttgaaagcagctgtaggtaatacatcaatgaaaggcatgtctgttgggttacattaaaactttatgacgcttgaatttgaatttaatatagattttatgtgtcaggaaatattatcatttgtttgattttttttcccccagtcattaaaaaaatgtaaaattattcttagcctagaggccatacatacaaaaacagctttgcctgcaggtgtagtttgctgatccctggtttagaatatagactctgtagctggcctggctggcatgaattctggctctgcaccttgtggactggatgacattggacaagtgatttgggcaagttgatttccttaactctaaatttcttaacctgcttcatgggatctgtcactaggataaaatgagttaatattagtaaagcccttagaatagtacctggcatgtatttatgctatgtttgtttaacaaataaaatttttatctgaaatcaggaatgaattttaatgaaaaccaaagtggcctctagtacactaaaatcacactttgggtgtattgctgaggcctcagtgatccagagagagatcccttaggtgggatcatgctaagccccagaggaaaaatgtaggagagcatcttcagagcaggtggctgcagtacagaggagctggagtgtcagagaccacacccgctttctggctgtttactttccccagtgaagagggattttaccgacgaggttaattacagagagtggactctgagtgctgaggagtaatggcagggtgagggaaaagggaaacaggaggagagcagtagaccatagtgatggaggtggggctgagaaaaaaaatactacttagaaatggtgattgggctgggtgcagcggctcatgcctgtaatcttagcagtttgggaggccaaggcgggtggatcatgaggtcaggagtttgagaccagcctggccaagatggtgaaaccctgtctctaataaaaatacaaaaattagctgggcacagtggcaggcacttgtaatcccagctactcaggaggctgaggcaggagagtcgcttgaacccaggaggcaaaggttgtagggaaccgagtgcaccaccactgcactttagcctgggtgacagagcaagactgtgtcttaaaaaaaaaaaaaaaaaaaaaagaggccaggcgcgctggctcacgcctgtaatcccagtactttgggaggctgaactgggcaaatcacgaggtcaggacatcaagaccatcctggctaacatggtgaaaacccgtctctactaaaaatacaaaatacaaaatacaaaaaaaaaaaaaaaaaaccaaagccaggcgtggtggcaggcacctgtagtcccagctactcaggaggctgaggcaggagaatggcgtgaacccgggaggcggagattgcagtgagctgagatcgcaccactacactccagcctgggcaacagagtgagaatctgtctcaaaaaaaaaaaaaaaaaaaaaaagtcgtcattggtacgagaggtagcaggaagaagagagaagaggaaaaagctggatttctgtgtgaaggcttataggaattgaatgggttggagagaaagacataaagttgaccagagcgaagcaggtgcacgatactgatgcctgatgcactctcctctcccccctttcctttctgagaacagcttctcagcaggcagacatctcggttgctttggtttgaagttctagatggattttgtgaagtgagaaatgactttctgttttgttttagtgtgttagccttccttatttgaagtaggaggaagtgaagtttggttggtgtggtttggttaatacctgaattttaaaggtttcttatgcagcagtgaatgagaagtccctgggatctactttgtctgtgtttgtgtgtcatcttagaatctagtttgagatgaatattgggcagatagtaaacaaaggtttacatctaccttacccttagaggggaaagtgcagtgaccctttctcttactagctagtagttctttcatgtagtctttacataatgcaaataaatggtatatatatcaatagtttacatataaatagtttagcaatactataagtttccccaattcttttcaggcttataattttcattaatttttagccatctgatgtggtttgaaatgctgatttaaatttcccattgtgagttttgatgtttgtggctataaactccactgctgcctgattctgtgagctctgatgctctgatggtagggcaggctgcctgaagaggcaaggtacctgcccatcagctcttgtggtcactctttgagtgagcattggaataggaaagggtggtgtgtaggtcttcaggaaaaccaactccgtgtctgctgcttttaggactaccccttgcccctctaactcattttatagttacaaactgttcatgttcacaaaagagtggaccttttggtccaagtcagttgagcctcctgctagtgaaaagggactcgagagatagcaagccacacttacacacacggcattctgccactcttcacactctagaatacaagtttagtgagaatatagcacactagtttccttgagttccttctgaaatcagtgcaccagccagcctccttggactctttttccctggaacacatattctcttggagtggcagtgcatgattgtttgctcccttctaaaaatcacttgctcgctgtggggcaggtacataccacatgtgtaaaaatatattcggcatctaatgccatatacatttaaacattttacttctttccagggaccttatcaagattcaaaagaaagaattacatcctgaaagagtattaaactcagtagaaacagaatgacagcagtccaaattttcagtgtagctgctggcacctgttgtccttttgtacgggtccccactggctgggagctttggaatcttcctagccagtcacagttgtgtgcataatgaacttgctaacctaggggaaaatatgcttttgaaaaacatttcagtgctatattgatgaatggataccaacctcccccgaacaaggtgaattatgttcccctacttggtaggctcataagttaccagtcaccaaaagtgaatctcagcaccaacctgaagcaaacttgagcgctaacagttcttctttctaatgttggttctgatttttgttagtttttaaaatctctttgagtgagatggtattggctaatgtctttgttttttaaatctgatgtccttttagattatacatccaaaaactgatgatcaaagaaataggttgcaagaggcttgcaaagacatcctgctgtttaagaatctggatccggtaagataaatcttaataatagaaatggctttgttttttcccccagtgacagtgtcaagaactgtacagggtcttgagttttgccctctttgtaagctgacatcaccctggggtgatggtaaaggcccccttgcggatgcttgaatgcacagtaggttgaactgcaggagaggaatattgagtttgggggaatatactgctgttggagcaagaagtaaagaagcctgaggtgtttgtcctgtggaagatattctctcatctctcaagatgttatctcagggctacaaaaacagccctgagaaatggcacaggtaaaaagatggtaggaacttgccctcttcgtacccatcaggaatatgcagggatgctcagggcccatggaggattgtttctctttacagccagtggtagtaattatatttgaatgtgtataaactcattatctgtgtattatacagattaaaagtaatatttcacttggctttaaggtgaggttttttttttttttttttttggtcctttataaggatttggaaatctctaatttttgggttcggtatttctagaatacccactcttggtatgagtgcacgtgctgttcagactttgtcttgcactgtgatgtacatattctgcttccttcatctcagattatgcttagtcattgctgtatagttatttaggagtgaacctctgctgccatattccaaatgtgaaaatagagtcaacttttgtaacttacctcgacttttttatttggtcaaactcaacatcttcaagtttttggtgatgccctagaggagaagcattaaatcaatacctgctctttttaaaatgaggtcttcttaaaaaggacgtttttataaagattcatgtactgcatcataccagttatatactgcgtcatatttacagtctgaaatattttaaaaatctcttttgtttctagtgtaatttatgtttatattacgtcttccagaacacagtacattgtgtgactttggagatttatgttaggcccacacattacgagtttgtatgtccatctctgagtctccattactggctttgataggcctaaatttgaccagacccaggatccatcagtcacttcatctgtccattgtctgagggcaggaactgtgtcttttgtatctttgcatcactctgtaagtagcagatggctcacggccctgtacgcgcactaggctctcaaaagaaaacatgggactgagacaagaatgctttaagttatccttttgttacaggaaagaggtcctcatccagaccccaagagagggttcttggatctcgcacaaaaatgaattcagggtgagtctgtaaagtgaaaacaagtttattaagaaagtgaaggaataaaacaatggctactccatagacagagcagccccgagagctgctggttgcccatttttatggttatttcttgatgatatgctaaacaaggggtggattattcatgcctcccctttttagatcatatagggtaacttcctgacattgccatggcatttgtaaactgtcatggttctggtgggagtgtggcagtgaggatgaccagaggtcactctcgtcaccatctcgactttggtgggttttggctggcttcttgactgcaacctgttttatcagcaagatctttatgacctgtatcttgtgctgaccttcagtctcatcctgtgacttagaatgccttaaccatctgggaatgcagcccagtaggtttcagccttattttacccagctcctattcaagatggagttgctctggttcatgcacctcggacacttttatagttatctaagtatacatatttaatcctaaataatagttttggatagatttgtaataaaatgatggtgtttaagtaatatctaattcaagtcttgttaaaagttatgccgggccgggcgtggtggctcatgcctgtaatcccagcactttgggaggccgaggtgggtggatcacgaggttaggagatcgagcccatcctggctaacatggtgaaacactgtctctactaaaaaaatacaaaaaagttagccgggcgtggtggcgggcgcctgtagtcccagctactagggaggctgaggcaggagaatggcatgaacccaggaggtggaggagtttgcagtgacctgagatcacaccactgcactccagcctgggcaacagagcgagactctgtctcaaaaaaaataaaaataaaataaaaaataaaaaaaagttatgccaaacccttgaacatagttacagtctcatggtatgaattcagtagttcagagtggccctgatagatccttgtccattcaagtttgtttgctcagttcattcaatccacgtttgccgagtaccatcacttaccagcagtgggagttagtgctgaggaagcaaagacctggttcagtaccctgagttgatatcaaagctagcctatggatcccatgttctctaaggcaaggaccaatgtagtatttaactcttttgctccggaggcacacagaaggcagtggtaaaattaatccttacttttacacttagaggtaggctttattcaagaagtctgtattttttgactagaactttacatgggagaatttcagaggtcaccaaaaacagtgctctcaagctttaatatgctgatgtatcatcaggggatcttgttaaaatgcagatttggattctcatggtctggagtggagcctgaaaagtctgcatttctcacaagctcccaggtaatgttgatgttcttggcccacaacatactttgaataccaaagactagagctagatgtgaaaatgttcaagttcagtatttggttactgttacatgtgttatgtttgcatgctttcctattcaatgaaccagtattttaatgcttcagcggggactaagtcgtgaaattctggtgtctgtagggttaagtgacacacaggcataaatcgttgctaattatgctttcctgggatgttgtctcttctgttctgtcttctaaattaattgatcttccttgccatttcaactttagctctttaaaagcattgtgaaaattttggttgcattttaaattattaatatttaagaaagcttttgctaatacagtctggcaaggagcatctttgcttagtgtgattattttgtaaacataagagttcttttagactttttttcactgctttgctgaaggtcaatatgtattttaaaaaccaacacatagagggaaaaaacatccagtttctgaattgtcatgatcgaatgttttatagagaagaagcaaatgtatatacatagtagttttcagaagaccttttttttgaatttgagctcagaccaccttgaatgactcccttactatttaaatccttccagagatgatataggatataagtaagtaaaatttatttttctcagcaaattaccacctggaataagacatttagcccaaaacatggcagattagaggttttagtttaagctcatattgtaaagtagctttctagttttttatgatacacattatttacaataacccaaatgtgttttaattgaattacatattcagcttatataatctgcttatcatgcagctcctttcattttaatttcttgactactatgtttcaagacctgtttaaagtgttggaggccacaaagatatttagagatggttgttgtccttttggaatttatagtttaatgagagtacaaacacatctgcaaagcatgttgggaaaacatgatatattgctgtaatatggtcagggcatggtgagaagatgtctgtctcttagcttaccctaacagttcagaaagctggaaaggtcactgagctgtgccctctgaaaatgaggagggaatcaccaggtgaggaaaagtacagaatgttatcactagagcctaaagtggcaaccatccagtgatggatggcctccatctagtgatgggagtgatggagctaagatgtggatgctttatcaggaaggcccattctttctcgaatgctatgctgtggcactggactgccttgtaggcagtgggcacagctgaagagttttagtcagagaatgtaactatcagatttatctaaggtcactttggtggtaatgtcgaagatggagttaaagaggggagaaaaacaggggaagcagacaagaacaaaagagtgaagcccagtaagaaaacgaggtcatgatctagggaagagaaatgggcctgaactccagggaagggggaaagggacagacagaaaagaatggtttcacaaaaaagggttaacagaacttggtacttggtgattgatttagttggggactgaaggaaagaatctaggatggctcccagtgtctagctggagtgactgcgaagttgccaccttttcctgaaatgggaaaacttgaaggaggaaggggaaactaattagtaattagcaagaagaatgatcttggctttgtgtctactatttcatttgaatttcccgaagtcattatttagcttgaaaatcttacacttcctagacttcagaaaatttttccttagagagctgtatattcatatgttgagcacagcatttataattattaatctctttgaagatattcttttcatgaatattttaatgctccactcagtaggccattttcctcctgaaatatttctaatttgaggctaactgaaataattttcttaggctatatgataggctctttcattaatgaagagtaaattgttatttcttaagtgagtcagagccctttactgagctcagtcttgaattggcattctgtaggagaattagatgtggatttcctacagtagttgtcagttatcatgataagcctctgcatattaaatatttcctaagttcttttcactctgtgcataattatggggaaattacattttgattgactagaacagacacctgtctgtattttatcaggaattgccttttcatatatccgtgtatgaattcttcagttttataatgttttcaaatgcagctaattccaacatcacaaaatagttactatagcaatttatttcatcttttttccccatttgacatttagagtcagaactaatcaataaagctgatgttcaccctctacctgccttaaaaaagtcaatatataaatagcaagcaaaacaatatattagtaaatcatttaatcaacctttagaattttgattggtgaccatatgttgcctgagttgatgaactcatttgggtagaatggtccctgtggggccaattagcactacatcacgaaagggctgtttcactgctaccttggcttcatcttcaaccttggctgctgttccacaaaaagatgccagagctcacacagggacccaaggaggggacgaaaactgcttcctgcaaacccatcaccatcattcttccaaaagtttttcttagcctatatgaagatgtaaaattatgttctcagtttaattagagtttttttagttaattaaaaaatataaatcagtatacatgtaaaattgacaaacattcaaaaagaacaaaagagtagtcagtgaaaggaaatctccttttcacctttgcctctcagaaacccagtttctcaggaactatgttcttttagtactatcttgtatatttttgcagggtcatgcaatgcacatacaaatatattctttttcaaattttggtggcagcagaatagacatactgttatgccctgtttttttttgttgttgttgttgttttttgagagtctcgctctgttgcccaggttggagtgtagtggcacgatcatggctcactgcaacctccgcctcctgggttcaagtgattcttgtacctcagccttctgagtagctgggactacaggtgtgcaccaccatggccagctaatttttgtatttttagtagacatggagtttgactatgttggccaggctggtctggaattcttggcctcaagtgatctgcctgcctcagcctcccaaagtgctgggattataggtgtgagctaccgtgcctggcctgccttgttcttttcaaatttaacaatatattagtatttatagaggttccatattctttttaaaaaatattttcatcagcattgtttatacaagtttaaactattagcttttatgtattataaagctaaatcatgataacacattaatgttttgctgttgccactatgttataattgtacatataacagcagattccaagtaatcaaaacaatatttaaaaagaagaacaaagttgcaggattcacatttcctaattttacaacttactgaaaagctatggtaatcaaaaccatatactgggctcgggtagacatatagaacaattgaatagaattgagaatctaaaaataaacctatatacttatggccaattgattttcccacaagagtgttaagaccattcaatagaaaaagaatagtttcttcaacaaatagtgctgaatccctggatatccacacacaaaacaacaaagctagactcctttgcatatacaagaattaattcagaagggatcaaaagccaaagatataagagcttaaaccataaaactcttggaagaaaacataggagtaagtctttatggtcttagatttagcattggactcttagacaccaaaagcataagcagaaaagaaaaaagataaataggacttcacacagatgtaacatttttgtacatcaaaggacattattttaaaaagtgaagacagtctgcagaagataaaattatttgccaatcatatatctgataaagatctagtatccaaaatatataaataacacaactcaacaataaaaagacaaaaattccaatttagaaatgggcaaagtgcttgaatatacaaatgactggcaatcaaaaaattttcaacgtggttagtcgttagagaaatacaaatcaaaactacaatgaaataccacttcatccccaccggggtagttacaattttaaaaaaggaaaataaagtgattaattttatgttatgtgaatttcacctcaacaaatttgtagttccctctcaccactccttttcaacatagtgctgaaagtcctggctaatgcaataagacaagaaagtgtagtaaaatgtattgagaaggaagaaatatacctgtctttgttcacagatgacatgattatctaagtagaaaatgggaaaggcttccagagctagtaagtgattataacaaggttgcaggatacaaggttaatatacaaaagttaatcactttcctttatatcagcagtgaacaagtggaatttgaaattaaaaatacaataccatttatattaacatccccccaaaatgaaatatttagatgtaaatctaacaaaaatatgtataagatcaatgtgaggaaaactatcaaatttgaaggaaatcagggaagaatttaataaatgaagagatttccatgttcatggataggaagacccactattgtcaagatgtcagtttttcccaagttgatctgtagattcaatgcagtcccaacaaacggatcctaaagtttggagaggcaaaagacctaggagagctaacacaatattgaaggaaaagaacaaagttaaagtactaatactaactgacttcaagacttagtataaagtgacaataatcaagacagtatagtattggcaaaagaatgtacaaattaatcagtggaacagaacagagaacccggtaacagccccacttaaatgcagttaactgatctttgacagaagagaaaaggtaacacaatgaagtaaagatggtcttttcaacaaatggtgctggaaaaactaggtatctgaaaaatgaatctagaaatggacattttatttttcacaaaaattaactcaaaatagatcacagatataaatgtaaaacacaaaactgtaaaattcctaggcgataacatgggagaaaatctagatgaccttggatttggtgataactttttagatgtaacaccaaaggcacatccatgaaagaattgataagctggacttcattaaaattaaaaatttctttgctgcaaaagacactgtgagcagaatgaaaagacaggctcagactgggaggaaatatttgcaaaagacacagctgataaaggactgttatccaaaatatacaaagaactcaacagtagtaaaccatcagattaaaaaattggaccaaagatgttaacagacacctcactgaagaagatatacaaatggcacacaagcatatgaaaagatgctccacatcacatgtcatcagggaaatgcaacttaaaacagcaatgagatagtactacacatctattagaatggccaaaatttgaaacactgacaacaccaaatgctggtgaacataggtggttcaacaactcattgctgatgagaatgcaaaatgcaaaatgttacagccactttagaagattgtttagtggtgtcttttacaactaaacatactcttaccatcctctccagtagtcatgctccttggtatttacccaaaggagttgaaaacttaggtccacacagaaacctgtacacaggtatttgtagcagctttattcaaaattgccaaaacttggaagcaaccaagatgttgttcagtatgtgaatggataaataaactggtacatctagacagtggacaaaatgagtgatctagttatgaaaagacatggaagacatggaagaaccttaaatgcataatactaagtgaaagaagccaatgtggaaaggctatgtgctgcatgattccaactatttaacgttctggaaaaggcaaaattatttgcaaggcagcccttgtcaccgctagacagctctcattcctaggcaggtctttatattctgccaaaacctccatgaaacttccacccaacagtcccagttatggcctctagaactactgatgtcatggtttgaacagaagataactggtgtattctcatataggtcttttctgtcacctaaacgccttgtttcctgaaattccctcattgcaggttttcacatttcttgattacccttctttgagtgttctctcgctgccagtgactcctttgaaagacagatgtctgaaaatccctacatgcctacaacagcagagctttttggtgaatggatatatgacagcttatttatccagtgccctgttgataaactgttagtttgtttccagtcttctgctattgtgatgcaaagaaaaatggtgatgcattttataaatatctatatagtaacttcctagaaaaggaacagtgaggtggaagatcatgcatatctaaaattttattaaattttgacaaatggcttttttagagtttgttccattttaccttctcaccggaagtctgtgtgagaatgcctcttttcccacacggtctccaacacagtgtgatattctaacatttgtatctttttgaatctggcgagtgaaaagtggcatctcatttcgattttaatttggatttctcttcattttcagagaagttgagtaacttttcatgtttttaagaatcctcctttctcttttctggaagctttgcagatcttttatctttagtgttctaaaaatacattatttcatcctagtgtggggatttatggtcattgactgtgctgggcacttgagtgtgcccttttggtctgaaaacctgtgttttcagaccaaaattttctttgggtctagaaaattcatcctgtattgtttatatttcctcctttttgttttctcttttactgtctctggcactcctttcttttcatctctttattgactttttttgaggtgtttggttttaatttttttaactcttttatttacctttaaaaaaattgtaatggtggatacatgtctttacacatttgtcaaacccatagaatgtacaacaccaatagcaaaccctaatataaactatggactttgaatgataataatgtcagtatagattcagcagttgtaacaaatatgccactccagtggaggatgtttatcttgggggagtctgtgtcatgtgttggggtagaggatatgtggagtatgtctatactttctgattaatgttcctatgagcttaaaactgctctaaaaaattctattttattttttatttttgagacagagtctcattctgttgcccaggctggagtgcagtgtaacagtcatggctcactgcagcctcaacctcccaggctcaagcaatcctccaatcttggcctctcctgagtagctgagactactcatttttttgagacagagtctcactctgttgccaggctggagtgcagtggtgtgatcatggctcactgcagcctcaacctcccaggctcaagcaatcctccaatctcagcctctcctgagtagctgagactactcattttttttgagacagagtctcactctgttgcccaggctggagcgcagtggtgcgatcatggctcactgaagcctcaacctcccaggctcaagcagtcctccgacctcggcctcctgagtagctgagacgacaagtgtgcaccaccatgcccagcttattttttttggtagagacggggttttgccatgttgcccaggctggtctcacactcctgggctgaagcaatctgcctgccttggcctcccaaagtgctgggattacagccatgagccactgaaccctgccaaaaaaaatctattttaaagaaaaaaaaatgacaatcatatttttaatttccaagctacccatttttctctgatttgctcttttcctaacatcctatttttttttggtctcatggatataatatcatcttaaatgtctctgcaaaagctctctacagttcctgaaatatctatctcatgtgttgtcattttgctgtttatcttagtcttgtaggctaccaggggagcaacataaagctgatttagagctctgagtaagtagggcaggcctgtcaaccagtgcactgtttagcttgagctgacagggagccagctgttacattggggaacccctaagtcctaccaaatgaaggtttttgttctagggcaccagtgttcacagtatctgttctagttctaatttgtttagtttctctctaatcttttgtctgggaggagttgagggtccacatttggctgctaggcattctgtattagggtagagggattttgaaggaaggtgtcaactaatctctgcaggactttaaatcagtccgcttgtctttagctttgtgtctcagtcccatgctggcagaaccagatgttacccactttggaccctcttggtgctctgcaaggcatgttggcccctccacactgcagtctcacctgtgcgacttggggcagctctctctgccacttgttacttaccttcgccctgaaactctctcatccatcagttgtcccttcctgtactctatactattgtagattcatatcttcatatgccttgtaacattttcatgcggtctcaaaagggagagaatcacatgtgatctgttatcctctttattcagaatatcttgtttcttcaacctgtgttttccacttgcatcttttttcccctttgaatctatcttcaactctttagtttatgtataatagtaattgattttggcatgggcagttagcattataccttttgtatgcccataaggagtgacctgaccaagggctcagagctaataagtagcagaacaaataaccctctaaatctttagacttttccattgtattgtattatttcctcatatccatttattctgtcttttcaaagttctttgaattattcctgtatttgttctgattaaagatttctttcacctcctagtttattctcatcagtttgaagtttatccttgagccttgtcaatcacactttgacagaataaaaattttacatagtttaattagttgttgaatagtatttttgatgtttctgacaaatctgccctagtgagctcagtggatgcagcttgaagccaaccttaatgacagtgaatagtgacagaatatttgccacagtcatttttgttttactttgttgtttttcttttttgttctgttttgattttggtgctaaaccaaaaagaagattggaatcaggatctaaattcaccaagtatttaggttatctgtacacaaattttagtgatgactaatataaggaagtttttaaaaatgggtatctttaaaagaaatttgaaataattccttactaacctgatcctttttagttgctaagattatatttcacaaggtatatggtggtttggtggttaaattttcattttaaagtggtgatagttgcaaatattctaaaatagactaattataattactttcattcaaatactgaatgtgagagtatataatcatcttatttgtatgtggtaagaaagactactatgtatttttctgacaacatttagtggtagttatgattatttccatttctttggacttgttcacagaaatataactgtggttacttaagaaaacatgttctagataaacataaagattatatcccatcttttttaaaaataggagcagatgtctcaagtattagatgccatgtttgaaaaattggtcaaagatggggagcatgtaattgatcaaggtgacgatggtgacaacttttatgtaattgataggtaagttttgcccaaccttactattgaaattgaaagaaccttttgtataaaatctcaaccattattacggcaactgacaggttaatataggatagttgttattgccgctactcttattattacataataggcactgtaaacctgttgtgagtacatgcagtgaaaccacagtggatcatgaaaagagacatagtttatagaggaactaatgacttttggttagtctaatctgtaaatgtcagtcatttaacatgagcatcttcatttgctgaattctaattgagagatattatgtagtagtattagtatgtactagatgcctgttacagtgagaacagcagtataatataacatctgagatattaattcacagtagacctcaattggtatttcttaaaaggttctttttttataaactgtgtaaaacatgctcatggtttaaaaaattcaaaattggcggagtgtggcggctcaggcctgcaatctcagcactttgggaagccgaggccagtggatcacttgaggtcaggagttcaagaccagcctgaccaacatggtgaaaccccgtctctactaaatacaaaaaaaattagccaggtgtggtggtgcacacctgtaatcccagctacttgggaggctgagacacgagaattgcttgaacccggcaggtggaggttgcagtgagccgatactgcaccatttgcactacaacctgggcaacaagagtgaaactctgtctcaaataataataacaataaataaataaaaataggaaatgcaaatatttcacaggggcataaggtgaaaagtctttcttcctactgctttaacatcatccagtccacataagtaagtagtttgtgcatccttccaagaattgtatattattatatttgtcttaaaaaaactctataattatttaaagaagtcttgcatttatgttgaaaatctgttttcaggaaatttaagttgtgctttacctcatcatagaacaatatgccttatgcaatagatgaatcctgaaatctaacagcagagcagcctgagctgagtccttatttcttcacttttgtaaaacaatgataagtgttcatgagacaattggcatccctgacccctccccttgtgtgtggaacgcaggtcctctcccagcctgacttactgggttacgtttgctctctgggctgggttgtgttcacctcagaggtcttggtgaaaatgacctctttggtctcctgaagcctcatttcgttattttggctctgtgggtggtatctttcatgcgtcagtcgagcatgctgtttaaatcaagagttgtcactgattctcccattccctcatcccaaattcctggtgacctgtggctgaagcactagccaggattttagaatagaataaaccagttatctatatgtgaatcaaagtaatgatttttatatcattaatagctatcatcactgaaacacctcagaaatgcacctaagtgtgtttaattgtagaggtgtatgagaagccctaaccctctatgatcttaaccatttagtggggatttttgactttcaaaactgccttacatttgtatatagtgtattcccttttcagttagatcctagtcacccatttggtagatgagaacatgcaggcccacagaagtgacagcacttggttcagatcacccaaatgactggcgtagagccaactccacagccaggtctcctgccctgttcatgttctttctggaggttcttgcctgccggaggccttgcattatcagagaagaagtctgtgtgaaaaaaacagcccaagattttttgtttgttttttttttttaaacagtcttgctctgttgcccaggctggagtgcagtggtgcgatctcgacccactgcaacctctgcctcccagtttcaagcgattctcctgcctcagcctgcggagtagctgggactacaggtacccgccaccacacccagctaatttttgtattttcagtagagacaaggtatcaccatgttggtcgggctggtctcgaactcctgccttcaggtaatccgcctgccttggcttcccaaagtggtgggtttacaggtgtaagtcagtgtgcctggcctagcctgcggtattttaacagattttagactgatgtgatttcaactggactgatagctcattttacttctcctcggcacatttggctttgttttaccctattcaaagtagccgagtgtagagaacagtttcagcgcaaaagtataaatagtgtaaatcgaagagtttaatctgtacagcattgctagtctgaaaatctgaaattctccaaactccaaagcattttgagcatcaacatgatggcacaagtggaaattccacacctgacctcatgtgatggtttacagtcaaaatgcaggcacacaacagcttattcagcatccccgaaggggttagtgtacgaggtacagtaactttaatcagaatatagcattgtaggtggagactgcaagcctgccattgtttgtggttgctcttgtttggcagctggtgcaggtattctggggatgctactatgctgcttagttgccccaaacacattagtttttactgtgttaatggtatgtcttattttttactgttaagtacttatgtgtgaatacaagtaaaaaatgatggcttattggtagcatataaattcagagtcaggaatgatggtaatgctgaacaaccacagattgtccacatgggtggttgagataatgacacctttgctttctggtggttcaatgtacacaaatttggtttcatgtacaaaattacccaaaatattaaataaaattatattgaggctgtgtgtataaggtatatatgaaacataaactgattttgtatttagacttgggtctcattcccaagatacctcattctatatatgcaaatattctaaaatctgaaaatatctaaaatctataacacttctggtcccaagaattttggatgagggaaactaaccctgtacttgaaaaatgattatccatgggacaaattctagtagtttcccttgaaacagtcattctatccgtgaatgacattgaaaaccaattcttttcttatttatttatttatttatttatttatttatttatttatttatttatttttgaggcggagtcttgctcttgttgcccaggctggagtgcagtggcgcaatctcagctcactgcacccactgtcctcctgggttcaggtgattcttcttcctcaacctcccgagtagctgggattacaggtgactgccaccacgcctggctaatttttttgtatttttagtagagacggggtttcaccatgttggccaggctggtctcaaactcctgaccttgtgatctgcccaccttggcctcctaaagttctgggattacaggcgtgaaccactgtgcctggccatgaaagccaattattttcttctgtctatcatgtttctgctgttattgcttctttattattaataatccttttctttcttttttggaggggcagggagagtgtctcactttcttgcctaggctcgagtgcagtggtgcagtcacagctcactgcagccttgaactcctgggcccaagcgatcctcttgcctcagccttccaagtagctaggagtacaggcatgtgccaccatacttgactaattttttggttttttgtagagacagagtcttgctatgttgcccaggctggtcttgaactcctggattcaaatcctcccaccttggcctcccaaaacattggaattacaggcatgaggtaccaggcctggcccataataattttctaatgttaaaagccacttttttttttttttttttttttttagcagcacgtccccactctttgtctgtgttagggtttagtcaacagaataaagccaaagaattttttctatctgccctcacaggtgcaagccttgaaagcatgttctctgataaaatacagtatgcggaaagtcagtcatccacacaaagaatgcagtttacgtgaatatagggtctgggtaataggaagtgcagtgacatgcaaactgaaccttatttgcctagaaaaagaaccccagttaaaagataagcaccaaaaaactataaaaagaccagagttagatatctagtctgaatttctactttttaactttagaatgggggttgatctaaagtaaagggccagagagtaaatatttttggctttgcaggccaatatgttctctgttgtaactactcaactctgcagttgtagcataaaaccagccatagataacacataaacaaacaagagtgtttatattgcagtgaaactttatttacaaaagcagatagccagtttgtgggctatagtttgccaacgtctgctatagattataaaggaccctagtaagttttgtagagtagtggctaaccaaattgctatagctagattctttttaaaaagttattttcttctgatcacaaaagtaataatatgttcatgttacaaacagaaactcttaaattagatagcgaatatgcctagaatccctcactattcttatgcttttagataactacagtcagtgatttgataaatgtttcttcagatgattttctttctttttttaaggttaattttttatagagatgggatcttgctatgttgcccaggctggtcttgaactcctaggctcaagtgatcctcttaccttggacttccaaattgctggaattacagatgtaagtaagccaccacacccagcctcttcagatgatttttttttttttttttttttttgagttggagttttgctcttgtcacccaggctggagtgcagtggcacaatctcggctcactgcaacctccgtctcccaggttcaagtgattctcctgcctcagcctcccgagtagctgagattatgggatcccgccatcacacccggctaatattttgtatttttaatagagacagggtttcaccatgttggccaggctggtctcaaactcctaacctcaggtgatccacccgcctcagcctcccaaagtgctgtgattacaggtgtgagacctggcctctccagatggttttttatgcatatactatttggttgtagtctttagttatagttttatcattccttattcaaaatttttattgtttagtcccatttttcccagcaggcacatggtctggaacagatggcacagattgattcccctttattgtcatcggaggggataacaggctggaaataagatttttatttcacagggctcttttctgaaataatgttttattttaatgatattttatttgaattaacctccaatctacatatgtccaacagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggtgagtaaaatacttatttgacctgaatgttatgatttgtagcaactgctatgacggtgttacaaattgccgcatgtagtattttaatttaaagatcatcagtcatcaggtaatttattaagcagccactgaatgctgaactgtagggcactaagactgcactaagtcagatcctgatgtcattgcccccactcctccagtccagtcaggagcttgggacctggtggcccaggaaagacactcagattcagaatgctcctgtcttacccactcttagaaaataaccagccatacaaacacagccttaagtactttttctcagatagctttctgaggtaagtattataatctgataaagtggtggctcccagagtgtggtcccctgaacactggcagctgtatcacttgggaactttttagaaatgcccattctggggccccacccactgattctgacctactgcatcagaaattcggagtttgagaaaccagtataaaaggatgctcttggtgctataaattgattggtaactactctgcatttaaaagcagttgtgtagggaaaaaatgcttggtggctgtgctcatgtgccccacatcagaattacctggagtatcttttaaaatcctcttacctagccacgaggtcaggagatcgagaccacggtgaaaccccgtctctactaaaaatacaaaaaattagccgggcacggtcgtgggtgcctgtagtcccagctactcaggaggctgaggcaggagaatggcatgaacccgggaggcggagcttgcagtgaagctgagattgcaccactgcactccagcctgggcgacagagcgagactctgtctcaaaaaaaatcctcttacctagacctcaccatgggcaaattgatcagaatcttcagcactgggacctgagcattagtacttttaaatacatttcttaatgtggtattcccgcaagacttaaaagctggtttaaagatacattcgggcaatattttcacatatgataggatgcaaattattaggcactactaaagctccttctggaggattgtatttaaggtagtgattctcaaactttaatatgcttacaaatcacctgggaatccagttaaaatgcagattctgattcagtggttctggggtgaggcccgtgatttttgcatttctcatcagctcccaggagatggcagtactgcctgatgtcaggccaaaccttaaacagcatcgatttagggaaatgtttacagtatatgtattttcttttaaaattgttgaaaatagcccacccactagttttgacatgcatttattgggttatttctctcaaatccttttgtggaaagagaagaggttgaagtaaatatgaagtctgttaaaagtctcatttccaaggactactgtatatagcattgtggaagtcacacattatttagtcacagttcagcatttgactctgaagtcaattcagctgataaaaaatatctcttgatcaaagagacaagacattttacatttcttttaattggaaccagttattatatacttatttaaaaatgtgatgagtcacttttttaaggtttagaggaaaagctgaattgtctcaggaaaaggaaagaactgtcagtgatttgaatacccaaagccagcaaagaaaaaacttcaaaccaggacagtccttcacccacagaagtctttgtctgcctgtcattaaagtggtgggataaatctagcatctgccatgacctgttttattcaggaaggtttacttttcaaatgtagtcattccaatggggttgccgttcagattcagattgtcagattgtcacacagtgaggaaactgcctccttgcacatcttcagaataagatcaactgttttataggttggcctctttgaatactgatagtttttagcccttgtagaaactttaatggggtataaaagacccagaatttcctagtgcacgtactacttaagttcctaagataggattaagcattttcagagctttttagtagtctatacatgttattaaattttataaaaatgggcagtttgtgataatcctcctgacatataatagctttctaaaaaagttagaataattaacataattacttagtatttcaagcctactttttaagggtgacttgactaattataataactccttctcagggagagtcgagtagaaaataaatttttcttttaaggtcaacagactggaggtctgcctgttaaatacaggtgtgtaaagataagcaaaaaaagcccaagagaaaagtccattgcagaatagtctcactctgtaaataatatttggtcactattagccttagggctaacatgatctacgtgactatactgatgatttggaaaggtgatttttgaaatggcttcaggatgaaagtatttgaaattctggactttatatgtcacagtgggtgtgaagaggtaggttactaatggaaaattctttctgagagatataactgattatgattagtttctaaatcattaagctattttgagtcttctctgttttgcaataaccgctgtccatacaatggtgttatacctgatttccaaacctgattacatatcagaatcactttgggagcatttatgaattattgagccctacatgcagagatcttgagtcattaaggtctggtgtctcagaaatcttttttaatactatagcttattctgatgcagagccaggcttggaaataatttcaatatttgtgctaattatcttgtaaaattttcttttaaaaaaagtattaggagtaaaacaagtccaaattacagccaataccaaattgggaaacaagatgtttaatttcctagtgtcttagtccttttggggtgctatgacagactgttatagaatgggtggcttaagcagcatacatttatttctcatggtctggacgctgagaagtccaagatcaaggcaccagaagattcggtgtctggtgagggcttgttttcctgtttaacagacagcgtcttctacttgtgttctcacatggtggaaggggcaagggagctcattgggatctcttttataaggacattaatcccattcatgagggctccagcctcatgacctaaccatcttccaaaggctccaccacctaatactatcctgggtgattaggatttcaacagagggattttagagtgatagaaacattcagttgcagtccatcacacctagagactttcatctatactggcatttttctccattgcactagttcatttaaattcagccttattatgttggcataagaaagaatgaataagacctagtatttggtagcacaatagggtgaccatagtcaataataaaattgtatattttaaaataaatgtaattggattttttgtaactcaaaggatagatgcttgagggggcagataccccattctctatgatgtgcatatttcatgttgcatgcctgtatcagaacatctcatgtaccccataaatatacacctactatgtacccacaaaaattaaaaataaaagtaaaaaaaaattaaaatattggcatagtaatttattaaataatatatcccaatttttactttattaaaatggtataattgtttattaatgaatgccaagctaacataattattgaggcttttattaaagaattaaaatattttatgagaaattatttaaaataaaatttttaggaaaataatgttttgagctgtatccttaaaatttttactagttcttcaaccgagttctgtatctttgagggcatgatagtataaacaggaacattttagactgtgaacatggtaaacactggaattagatcttactcaaaaacatagttgtagtttctctgtgccttcacattaaataaaaattttttttatgagtacatattatgtgtatatatttacagggtacataagctatttcgataacagcatacaatatataatgatcacatcagggtaaatggagtagccatcactttaagcatttataatttctttgggcatccctccacatttttgacaagaaaattttgacataatgtggatatgaaaaagaacgtagagtacataacagagtaaaagaacagtgctagtatacatatttaaaaatgctgtgacagcgcctccttgtgggcagaacccaacatattggtcagatttctgttatgtataaaaagtcaacagatgctttctttaaaaaaaaaaaaaaagaaaacagtattttatgtggttctgtattatattttgtgcttgacgaaataaaaatatgaaatgagttgcattaaaagtataatgatgttaatcttttatttcagaatcttcaatcattgtttcttgtagggaataaaataaaactatttgtatagctttacccccataaaatttaccctttaactgttctgcctgtaggacagggtaaccttcaggagaataattgtgaaaaacaatgccaaaaagagaaaaatgtatgaaagctttattgagtcactgccattccttaaatctttggaggtaagtatatgtttatgcttttattttattttgctttaaaagtttctgttttgctaggaatatttagttctatagaaaaatttctttgaataaaaaaaaatctatccatgtttttatttgaaaagattaaatggtagtgctaatttttataactcattgtttcttctgctatctataatttcatttgttttgttatttgaaagtaatacattcctacccagcatctatagcaaatttatatgtggtctttatctgatagcagacttaatataatcacatagatgtagacaagagccactagttgtaactttacagtgaggcgttctctagatatagaatgtcctctctggcctcttcctctcagtcatctttgctgtttattcctcttttcttctcctcttaaaactggcattccaggcctctgtccttggcctcttctcttttcaggatacacttattcacttggtgaacatgtcgaatcccatggccttaaatacagatgtcccttgacttactatggggttaccttacgaataaacccattgtgagttgaaaatatcataaatagaaaatgtatttaatacacctaaactatggaacattcgagctcagcctagcctacctgaaacatgcttaggacactcacatcagcctacagctgggaacagtcacctggcagcacagtgcactggagagcatgggttgttcacctcattgtggtgaggctggctgggcgttgtggctctctgcctggcgttgtactgcatatcgctagcctgggagaagatcgaaactcaaaattagaagtatagtttctatcgctttcaaacaactgtaaggttgaaaaatcattaatcaagccattgtaagtcagggaccacctgtactgtccatatattgatgcttcttaaaattgatatcactgggcaaggcccctcccttgaaggtcagacttacttatccaactgcaaatgtaagatttcctctcagatgtctaatagacatctcaaacctagtatgtcccaaatctactccttttctctttccctgcagatggcaacatatccttccagtgtctcaggccagaaaccttcgagttagcactgactcatatgaaccaccatcacctcttgcctggctaattgcagagtcatcttttaaaatccctggttgtggcactgctctatttaagctcctcctcacatggcctctaaggctctgcacagactgtcccactcccccacccattttccccaacctcatttcctactgctccacactcatcatctctctgttgacacatcagcttcttgccactcctcaaacacacctgtcccacacccacttcggggtctttgtacttgccgtctgtctggaatgtcttcctacacagctgcagggctccttcatttctcagcccagaggtcttctcaatgagaccagctcttaggtttttatctttgaaggtagagacttatgagagagagtaggttgttgttaccctaaaaattcagcttcattttccatacttcatcattaaattaaatgcttttctatttcactgtcatatttgaagtattttgagagtaattaaagacaggcatatatatgtacccacaacatcttataaaatggcaagtgtcaaaacagcagtgcttctccttttgaatgtctctgttggattatcagcttacatctggtaaaaaatttgtccacatcacacagtgcgtggtagacagctgatcttttccagcagcatatttctttaaataagagtaggtcagggattggaaatctggtgccttcagagctaggcaggtaacacagagaagaaaaccaagccaggaagggactttggcagattggagaacatgtatttcattaaagaaacagctgctatcccaccatagttttattgttgccatgtggaaatatgggctatgtgatgctgatttttcaagagaagctggagattgaatttttatgaaaaattattttaaaatgctggctggtaattaatacaacaaacacatatacaacctacacactgctcgatttatttggcctataggctaccagttttttactcccgaactagataagcttacccagttaatttgtttctatttaatattgtttttctttctttgtagttttctgaacgcctgaaagtagtagatgtgataggcaccaaagtatacaacgatggagaacaaatcattgctcaggtatgatattttgaaatgtaattcagtttagggttatattccaaaaggttcctgtagtggtagatcttgataaacttttcatatttctaaaattagtatgcagtgatgggttaaataaatattacttctaccaaatgacctgttaaaaatggtttcatttatagtcattactctattgaatatttttgtttatgtaattaactcctaatgaaggtgtattaaaccatcaaatggttttctgcatcattgtagtcatttataagaggaaaaaacaggtgaatgttccatgacattaatgaggacccagaaagtacactggaaaattctatagagttttgcatgatcagttcatgatgaaaattcctgaggctgctccttgataaaattcaccaagaaaggaacatactgcaacatatactgttttggcttccaagactacatgtgggtcaacatgttatttaatccctaatacttttctaagatcccagctggaaccaataatattagatacctgggttggagtagggctaccaaaagtagaatttgtgaagactgttgaagttcacaggtaaagcatgcagatgatagtaccttgtttcctagttatatttttgaagcactaagcaaatgattaaaatggatttttaatagattctgtaatttttgtatcacagccttatactgttttgtgctctttatctgaaatgcagtcttttcctttatatgggaaacaagattcaaggtctttgagactgagaaaaagaattgttttagaagacaaatacataagtaaatctttcgatcaacacccctctcccattgctgagtgtgtgtgtgtgtatgtgtgtgttagagcagtcagggattgggaagaaatggagtcaagcaaggttaaagttctactgtataaactagtaaataacaaagcaaagagcatgttttaaatgattttttaaggttttattttgaaataattatagattcacaggaagttgcaaaaatagttttgagaggtcccgtgtactcttcacccagtttctcctaatgcgttttgcatcactgttaataacaatatcaaaactaggaaaatgacattggcataattcacagaccatattcagttttcaccagttttacatacacttagagcgtgctttaaaaatagttaaaaattactcagcagttaatagacctattatgattcagaacactcgaaaacttaatatgaagcttttatgaaaacctgatacaagaataagggaaaggagatatgctatacttagggtttattaaggatattcttacatatttgttgtcttttaagcatttataaatatacatatacaccctatattctaaaaatctaaattcaacatttatttttgtgatagaatcagatgctaaacttcttgaatttgtattaaggagttttgaaatattttaagtttctccagaatcactttgagaggcttagagaagtcagtgtctgtattattatcttccatattgtattgtttaattcagactgcatcattggagatcaaggcagagttcattaagaaacaaaagcaagaaagaacaggtatatgggtagagcaacacttttcttttagaagtccttccaaagccttgaaatggaatgtcagtaggctagcatgtcagagtttggtcctcagttgactgtagtgaaaatgtcaaggcccacatctgctgcttccggctccatctggatgctttctgctctttgcaagttgatggcttatcttgggtcaccacaccaatgcttgcgatgttaggatgacgcagggtgcatgtctcggcacttcctcaggagcacaggatccgcagacatgtttctgccaactaaggggacgctgctggcatacacagcagtgttgccatttccaactatgtatgctgttatctaggctgaaatttgggtgaaattcttaccccagtgttgccacattttcttggttttttagcagaaatacagtggtagagaatatattatttcaaggccaggcacagtggctcacgcctgtaatcccagcactttgggaggctgaggcaggtagatcacttcaaggtcaggagttcgagaccagcctggccaacatggtgaaaccccatctctaataaaaatacaaaaaaataaataaatacgggttctagatccctgaggaattgctacactgtcctccaaaatggttgaaccaatctacattcccaccaacagtgcaaaagcattcctatttctccacaacctcaccagcatctatcgttgcttgactttttaataattgccattctgactggcgtgagatggtttctcattatggttttgatttgcatttctctaatgatcagtaatgatctttttttcattttttttttggctgcataaatatcttcttttgattcttttgagaagtgtccgttcatatcctttgcccactttttaatggcagaaataccatttgacccagaaaacccattactgggtatatacccaaaggaatataaatcattctgctataaagacacatgcacacatatgtttattgcagcactatttacaataacaaagacatggaaccaacccaaatgcccatcagtgatagactggataaagaaaacgtggtacatatataccatggagtactatgcagccataaaaaagaatgagataatgtcctttgcaggacatggatgaagctggaagccatcattctcagcagactaacacaggagtagaaaactaaacaccgaatgttctcactcataagtgggagttgaacaataagaacacatggacacagggaggggaacatcacacaccggggcctgtcagggggtggggagtgaaggtagggagagtattaggacagatacctaatgcatgcggggcttaaaaccagacaggttgataggtatagcaaacctccatggcacatgtatacctgtgtaacaaacctgcatgttctccacatgtatccctgatttaaagtaaaattttaaaaaaaggaaaaaaaaattagctgggtgtggtagcacatgcctgtaatcccagctacttgggagggtgaggtgggagagtcgcctgaatccaggaggtggaggctgcagtgagctgagattgcaccactgcactccagcctgggtgacagagcgagactccatcttgggggggaaaaagaaagtattatttcaaataattttacaaatgaaatcattactacataattgtccatcaaaacctcttcatttagggccgggctcggtggctcacgcctgtaatcccagcactttgggaggccgacgcaggcagatctcgaggtcaggagatcaagaccatcctggctaacacgttgaaaccccgtctctactaaaaatacaaataaattagccgggcgtggtggcagacgcctgtagtcccagccacccaggaggctgaggcaggagaatggtgtgaacccgggaggtggagcttgtagtgagccgagatcgcgccactgcattccagtctgggcaacagagtgagactccgtctcaaaaaaaaaaaaaacctcttgatttagaaaccgagacagcttgttcccttaggatttcacttttcaggtgaatatgtgtactttggggttggatcaattttagggatatgaaaggtaacaagattgttgtcaattaatttgcattttcaccgtctgtttttgttattgattccaatagggagattcggctgattcttttttcattgtagaatctggagaagtgaaaattactatgaaaagaaaggtaagcattctaagtcctcagaacccacatactgttagcaaggaacacaacagatctactttttgatgtttagactgaggttaattttatttttcataagctgaggaaaagctcatctttttaattgccttgtcagggtaaatcagaagtggaagagaatggtgcagtagaaatcgctcgatgctcgcggggacagtactttggagagcttgccctggtaactaacaaacctcgagcagcttctgcccacgccattgggactgtcaaatgtttaggtagggattgcaacagtgggcgtgcttctgctggttgaacttatgtctgcattttatgtattcatgttgagtgaatcattttattgggttcacaggttttgtggtccccacaaaaggtaacaagattaggactcattgccttataaaatcaatttgtggaagccattttttcttcgaaatttttacatccagatacattttgctcttcttgtgtatatatgaaataacatcccatattagtcattaaaataagagttccaagtaccacgttttatatggaatctctcaaataagcaacatgtgctatgttcctcaaaagagaaggctaaagtactatttttataaagtccgttattaagatctgcggggaatgctgagatgttgtgagaatccttactcattacagtattgggacacaaaggttcaggtttgtcaaagcacagtcaaatgttctttgctgttcagttgttattactattttaccagagtagcttggcagaaatgtcatcttcaggtgcaggcatctgtatatatctgagattatatatctgagaaatcacttactttgataagaaaatacagtttagaaggtggcaatatggagggtattttaagaaaattgatctcacagttattaccctctctgtgcttttcatccataattcaatagcataaacttaatgtttttaagatttgcaaggatccttagaattaacttcttagagaagtcattctttaaaagggtttaaataagtataatattaatcaagtgttaaatttggatggaagagaagacgattagaaactggcaggtaatttccctaagtagggctattagaaagagtaaaggtgagtgagtgaaagtctattagaaatagtaaaggtgagtgagtgaaagtctattacagtaaaggtgagtgagtgaaagtctattagaaagagtaaaggtgagtgagtgaaagtctgttaattttttttcaataatagattattatactcacatcaaagaaaacctgagaaatacagaaaatgtagaaaaaacataacaccgccactcagtgatttctgctattataattccttcttgtcctttttatttgtgtgggcttccagttgttaaacagttttccaaacaacttttaaagttcattatcgcttaggaatgttcttattttattacaccaaattttaaaattcttttaggtaaatatatacacgataaattaatcattccttagtggtaaatacttcgaaggttttggctccaacttttttgtggggagcaattttttgtgcatagaagacttttctgtattataggagttttccttagaaatggttttcaggagtgggtttttaaaaaattaacttttgacacatattgccagattacttgtatttgtacactactagcagtgccataatgcccattcaccctattcttgtaaacattgccttttttatctttttatctttagtgtaaaaggcaaagaagatctattttaatttgtacttttatgtatagagtatgatcatattttctatttatatattataaatccagttttaaaatccaggagacaggcaagcaaagtgatttctagcatgtacttatagaagtaaacaaaagcattatgtcagctgccatttttggattgcatagacatagtatggcagcaaaacttacaaaaggttaacacttggccttcacaacatggcattttaaaccctgagaagggaacacaggatagaaaacactcttgtgccacccttgaggagttcacattgctaaggtggagacagcacatttattttttaaaattctaaggtctttccatgatagtccctcattcttttctcagcttggaccaggaacctcccaccaacttagcattgctcatcatattgccgagggactgcagagtgtggtccaagagcgtggccctggctgcttcctttttcaagtggaacatttttatcattatgctttttcttgtattttatagtatttacctaaaatatcattgcactattgatatatatggagtcggtattgtaaatgacttagaaattctgcagatttgcaaagaatgttatttaaaaaaaaatcttctcttttctcagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctggccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaaggctataaatgccacgtacattattttcagtattgttggttatatttaaattttccttacaataaagcacacttttataataaaatacatgaattattgtttttcatacttttttgcttgtttctttaaagttttctgacgtgcataatgcataattcattgaaaagcatgatagcaatgtggcatgtggaagcgaacccccagggcataacatagtaagaaagtatggttctgtatggcaataggtttttaaaattattagctattcatcatgtgtgggagaaataattgtggtgtgttgcagatttatttggccatttagaataaccaaatcaatctggctaactaggaatttatgtgtaaaattatctgattaaaacagctcaagtttgacttgtggatgtcattatttaattattaatcaacactccttactatgtgagaattctctgttgaccattcattcaaggacagagcctctcgtgtatcatgcgtggctaaggaaaggggtgaggactttttccccaagagtgacggtgctttcccttattttaaataaaggtgtgtgtgtgtgtgtgtgtgtgtgtgtgtgtgtgtgtatgtatgtgtgtgtgtattgttttctacatatccatatgtactagggcttagtgcagatattttaacatacacgttacctgtgacacaacttaggtgaatgtatatgtgttaccattaggattagtattataaactctggctaaatgccatttaaaatgctttaaaaggccggcaccatggctcatgcctgtaatcccaggactttgggaggctgaggcaggaggatcacgaggtcaagagatcgagaccatcctggccaatatagtgaaaccccgtctctattaaaaatacaaaaattagctgggcgtggtggcatgtgcctgtagtcccagctactcaggaggctgacgcaggagaatcgcttgaacctgggaggcagaagttggagtgagccgagattgtgccactgcactccagcctggtgacagagcgagactccgtccataaaacaaacaagcttaaaaattcttcaagtgaaacggcatgaagcaagagacttcggattttattgaaatgtaaaatttaaaaacgctgtgttctttcccttcccaaagcatctttaaagatactgatagaatttttcctctcaaaaaacgttataaaggatgagatgacctttgccattcttaaggaaaattaatactgtgtaggcctagagaggtgagtcatacatctggattaaggcagagctttgttaaattgctggacgggattcttaaaaaaaaaaaaatttactacctaagagaaatatagtttttaaggaatgctggcttctaaaatttagtgtttggtatagcctgatgccaagtatcagaaagaattttgacaaaaatgaagaattggaatgagttgagacaaccttacctgttctagaatacttttaaaggcagcaaaactggttgaatagactacagagttgttcatcttcacaggtataaaaaccctttaaaagtgtaatgaattatggaaatataagcagtaaagtataccagttatttgcagaagacttgtgtcaataactatgagaccttaaatcagttcaatttgtatacctaaggacaatcagtgacttcactaaagtcatttactttgtgagtcaatggcagaacttatggaaaattgagatatattgattcttcatccaattcatggcctcatatattttcccaaataatgttaatgagcctggcatataaattggtatatagtttccaatgcagagaataagattattttgagaggaaaacttttgatgtgaccaacagatctgggtctttctttacctttttatgcttcaaatttataaatctaaaattgcctagaaaatcctgaagaagtatgtatcacatatataggaaaatgtggtgatacatgatagggaagtaatgtctacaccacaaaaatgaatgctacctaccaaggaggtggttttcacagattttgatgtaaccatagcctgagtctcatcatttttccaaatataaaaaatgctactacaaaatgtatatatattaaatcatgttttatcagcaccaattataactgattcattatagcatataaatgcattttttactgtcactggaaaacagaaaatgacctttttttcaggcacaagggaaagttttctgtagcttttgactgtaacaacccagacatgaaaccttaaatattttctatttaacttgaaaagaaaggttacaaagtagaccttcgaatgagtttatgaacaggaaatatgaccagttaaaatcttagataaagttgctattgatgactggttttccatctt

SEQ ID NO: 17514 - DNA, 11209 bp, Human
tgcttccattctagaaagataatagtagctgctttttaagtggcctctagagactcttttaatataggatttacatgtaggaatctttggtctaacaaaggatttttcttacccttaggtgttccaacattcactaaacgtgtggtgctttcagcagttgtgagatcctgactacagaacgaggtagcttagaaactaaaagatccttaaaacttgccagttggtttgggggtttctcagagatttttaaactgttggaaaatggcatctatgagaaaatgaaaaagtagtctagattgttacacctaaagacgagttactctaatatgaaggactgttatttaaagcatttcacaaaactatttattgaggtgcaaaaagaaaacattggaacatcaatatatttatttttctcattcttttaaaatttctgtggagtattttaatgtttactcattaaaatgtatgtttaaagtaatgtgtaatgtatacatgtacagtagtacatgtatataatctataaatccttatacatatgttggggcccatgctcaatagttttttaatagactaaaatgtatgcggaaaatttgatttagaggattgtgtgaatctcgtcttcatcagaagagtgttttagagtgtatgtgtggggaacggggttggtttaaataggagcacatgagattcagttacatcaatttattttatttaaatataacaactattagtgatacagcattcattcatattcagcaaatattttctgagcatgtcctatgcagcaagcattgccctaggctctgtgcatacggtggtgaacacaaacgttgtccttgacctcatagtccttccccactatagtttagtagggaagacagctgtcaaccaaataatcatacacttaaatgtaccaccaaaaatgggtaagtgttatgaaggaaaaatacagcaagttacaggaggctacaagagtataaactggggcaccatctctattctgagattatcgagaaaggttatcctgagaagtgacatttaagctggggcctgcggagattgattgcacgattgccttgtcaagagacagaggaagagtggcctagatggaagtagcgggtatgtgtgagggcctggacggggtcatgagatgagtgagggcctgtgccacaaggtcacagggtttcgggcaatggggaagcttcagagatggagctgcctgacagagaggtggagtgcaggctaaatgacctcaggagctttgtccttcttcaattccagggggaaaatcacaaactagttggaagtaccagagggctacagaaaacaacaaaaagagactagctggtcggctaggcacaattaaaacatcaaattctgccccagcagcaattccgggaaattcaagtaatgccccctgtgtggccctctagaactgtatctggtaagagtaaagggcagtgtgtcctctatgcctgcgctacagatgtggacattttttttaattgcctgaaaatttcataagctgtagccagttagagggcctagcaatgtgttgtgatcatgtgttttcctgagttatttgaaacaagagggtgtatgtactaccctcttggcaaaattaaaggattttgagctaggataaatgaggtagatcagaggataattgcaggaagtggggcagtggctagccctgcttgagggcttaggcccaggctgcagaggagctaagtggaagagcaatatttgacggtctattgccgctgtgcctactaatcggctaggggaggagaaggaggacaagggagaccagggttggacgatgagcatgaaagaagagtgggcgagccagggagcgcttgccacatggagggcgggaggcggctacaccgggtccccaccgccgagaaaggggcacgaggaggcggcgcgggccccgccccctcccctggcgggcgcgggcgcgggctcgagacgctgcgcggcggcagcggcgggcgcgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttgggtaaggtgcctgtgcgtgggcaggaacaggggctaggggctggaggacccggaaggccgggaggtggggggcctgtgagaagagggagaaaggaaagtctagttgatccccaggaccactcgtagcttgagaaaagggactgagccgctcccgaggtcggagtcgggggcaggtgacagtgcaggggggcgttgctgagtaatcccgagctgctgccagagccgagcagagaggcgcagggctccgtggggagcgggtgtggctcagtgcgcatgcgccacagccgactagctctaagagctgggggtgaggtgagaggacctgggtcggaggtagttgggactatgtgtgacatctcactttctaggtccgtaatgctaacagtgcccctgtcgtagagatgccagcattcttgtctcccaaggaagctttttttccttgtgttcagctcgcttgatgtcatccaaaccttatctacctatctgtccctgggcagtctactgaggaagaagtgtcctggggacgatgccagattgctatctagtgtgcctttgggcttatagccctagagctgtcgttgtgagcagtgaaaggttagatgtgggactccacattggaccctttgagttgcatataggatataaatgtgggcatgaatgtaggaatagcgtttcagtggcatgacagctgtggcatttggagtcggcatggatgtagctgataacttgttagctctgcaaaatgaatccagtgcgtcagagggtttccgcgctacgaagcacccaccaccagcaccaacgccaagtattgggttgtattggaaacacactcaaacattcaatcatttctcatccgtgttgaattttacataaatatagccgcgcccaattcttcagtgcaatatttccaattattgtgccagcattcaacagtgagttgagtagcccttaccagtgtgtcgccacaagatgggctttccccacaggtccaaccatggctcctcccctgtacagacttccaacagtgccactctcatccagtgcctagccctccccagttgctcttcccctatcgatccctgcagtacacatccctttcaagacttgcctccgagcaatctgcactactgattttgagcatcattccactccatggcaactgaactgatgcgaatttgcttttctgcctctcttctctccatcatcatactaaaatgtactattttcaaaggttcaacttctttttcttcattgtactgcctcctcccccacctccactcccacctctaagcattcccaactaaatacaataatttgaataaggctttgtgggtactgcagattcagaaggtttcaagtgtgttaaagaacaaagagctggggagtattggttatggaaattcctaattcaccttactctccaagactgagaccctgatgggaaaaaaaaaagttagtaaactatccttagagcatgctcattaatgagtttgtgggggtaggaaaggggaattgcgtctctcgaatattttactcagttagagtcagatctttctctgaatgggatcaaaatcagaataagcgttttggtccaaatgcttgcccgacagaggacccataagggatgcatacgtcatttgactttcctatttacgtatttagtgttatcaaagaattcatttgcctgcttaatgttaccttgtttaaaggtttggattaaatccggcatattctgggggaggaaaaaatgatttcatttgcttttacactgtgctagttctttttaatttaagtatgtactaaaggacatgacattcattttcaaacaatgataaatgattgtggagaggccagcacccaccgacaacatcaactggatatcattattctgctcttgttttgggtaggaatggggaaatgtatatacttatttttaaaatgtgagagtagggggaggaaaactggagcatttcccttgactttcaacaggtggaattcccattactccccatccagaaaatgatcgagtcaagttcataacttctgctctttagttaccttataaataatagtattttggcatcttacagaactatggatctattgtaccttggcatcaattcagaggcattaattctgggcacctacctaatcatttaattggtaaacaaatatttattatctccatggaggatcctggtgctgcacactgaaggggcttcaaagatgtatacagtgagcttactatctaggaatttaaaattgatcatgtaagaaagacaggaaaagtttgttaacaaaataagtcagtataatgacattatttcaactgtaaacaatgagatcctgagcttgcatgttaatttgtaaactccctgagggcaagaccttgccttaaacatttattaattcccaacagtatctacatccaatggatgtttgagtgatgaagctttgcaaagtagattgagtggggagacaccagaagcagggagagaagaactttcacaatagattagatgtgagaaattgtgggccaaaatgaggatggtagcacaggactagaaaatgatacttcaagggaaaatcagcaggattgaatgaaggcaaggagacaaatctaaactgtattcatttttacttctagaaaataaatgggagttggagacagcagaggagagtggagggtttccttagtaaggacacaacacacaataggcactgtagtgttttctcaaatatcagtagcaagattggaccagaagaccctgaaggtcccttcaatgctgagattctgtgccatatgcagatgttcaagcttgttgaggaacaaggcattctcaaatatggaagaaagagaaaaggaagaattcttatactttcactagcaggccctttctgagaagggttaatactgagccacaaggcccccaccagtgcatgaaaggaggtggaggagccagaggaataaaaatctcaaaccaaatttttcaaaaaatgcttacaaatctttgcaaacttcataagcttttcattctcccccaaaatcctgttaagtagggcaggtattatctgctctatttttatgtaagaagatactgaaacagaaagattaaatgacctgcccaagttcataaaataaatgaatggtgtaacagtgatgaagaccctggtgtcctgattactgccagctagctcagtgctcttgacactgaaccacattgcttttcctctttttcccttggcatagagcctataggcccagaagttatgtgtgcacataaccaaatagggaatgcacaagcaactgcagcattatctcagacagttattaatacatcatcattattcctggagctgagcatttggtttccatattcactcagtccttgacctgtctattgagtttatctgcaactgggagaatagggtcagtgagtcttttaatgatgtgaacgcctgtttgctaggaactcaaggaagcttgtgtggcctggacgcttaatactagccatcagaatcatgcccaagtttgtacttctgttgcttttcaaaatgagagttcaagagttttgctctgtaaaattatcctacagaccagtataaaaaaataaaaaagtgtgctaacacttgtttcatctccatttaaagaaatgtttgttacttgagctaattccaaagacagcaatttgggagcaggaaaaagaggacaaaaattaggaattgtaggaaacttgagaattctgtagagtgtatataaaccaagaaggaggataaagcctatccatttaggagatattatttaaattcataattactgatttagatatctaatgaatccttattataagttttatctatatttagaaaataacatgtgattattaagcagcagatttttttttaaagcttcgttcttcctcagtaagaaataacactacacagatctaggcactgtttttcttcttaaaccagtactcttgatgctgcttaaataagattcttgccataattaattataatattagatgaatgtatatttaaatttaataacaccagctaaatattaaaactggtgtttaagacagatgaactgccaggtacagcggctcacgcctgtgaacccagcactttgggaacatgaggtgggcagatcgtttgaacccaggagtttgaaaccaacctgggcaacatggtgaaaccccatctctacaaaaactacaaaacttagccgggcatggtggtgcatgcccgtagtcccagctactcagaaggctgaggtgggaagattacttgagcccaggaggtcgaggctgcagtgagccatgactgcaccactgcactccagcctgggtgacagaatgagaccttgtctcaaatttaaaaaataaataaagaaaagaaaaatgacctaaactaattaataaaataattagccaagataatatactttattgtaaacaggaagcccacaaacacaatttttttctgctctctaattatgtggaatcaattgcagagacaaccttgagacagactggtgagtgcactaacaactttcttggagatgggaacgttggtaggtataaaaggaagaagtttcatctccgacttaggatttcagcatatcttagattgctctgtactttccttttcctgaatgtcatctattgtgaatatcatctttctttaatttgcttttactttgaatggagaattcaattgagagacaatataaaatgtaaaaaattatataaattacaaattaggataagttaaagttcttggaataaaattattttgcttatgttaagcataggtagcattttgaacttttatttttgaaaagcaccctctgtaggttacttgaggttgctgtgggttctttttttttttctgacttgaatatatttttatatagagccttaacgttattttattatagatttttttaaaataatgttttctattctgttttatagcaccctaaaaagaaagaataaaacaacaacaggaaaaaaaggaaaatatttaaattgtgacaaaaacccactgggtaggtatttcaagggggcacactgtggatttgggatattttaatatttgatctcttaaaaatgaatatttagaaaaatatatagctagtacataggcattccaaaatcattttaagggctactaaattttgtaaaattatattcaaatgtgtgtgcttccagaaactgttttgcatgcactccttcgattagtgattcgttttcatccctttgggtctattgtataaatatcatccaattaacctcatcaccgttgagttcccacaatagacctagtgggaaagtacctaacagaatataggaaaaggtagtatttgttcagtaagcatttgatctttttattttaagacacattctaggtgttccatgtgtagacatgttgtggaggtaacaagtagggtactgtataaatattagcactttaaattttgcagtatgttttcaaatgttgctattatggaattaaaacctgaatccaaaaactaataagctattcaagatttccttccttcatgacagctgttatattgatatcagtcaattgtcatcaacttaaatgccattgttccatgaagaaaaaaatatagaagatccttacttgagagggtgttcctatcaatgcaagtataatggggtaaatgcctgaagaaacgtaaccttgttctctctttcaaattctggggtgcagtctaattctggcccagacctctaccgacagaatcaagaatccagtttatgtagctttctcttctcagtaatttttgtatccatcaggagcagacttcaaaccccaagtcaatttcatactatttgtctattgtttggaactgtccaaaccggaagctaaagttgtcacacatttgagtggcattcctgttctaggcttcctctcctagaattgggtcagaactgaaccaaattacaggaccatctgctagtccatttacccatggcactcagccattttcctggcacaacaaaagacctcagaaaaacaagacctatttttccccttatgcaaaattagtgttatttcttctgctgtactacatcaattaatgagcataaatcagagaagttgaatgagaaggccttataattcagagaaatttgctatgaagttgatttcagtttcaggtttaactgttttccctcctacttttccttttattttcaggttctcttggttacaaactccttcccttctggtgctgcaaaaatgagtgggaaatccctgctcttaaaggtcattctcttgggtgatggtggagttgggaaaagttcgcttatgaaccgttacgtaaccaacaaatttgactcccaggcttttcacaccataggggtagagttcttaaatcgagatctggaggtagatggacgctttgtaaccctccagatctgggacactgcagggcaggaacgtttcaagagccttaggacacccttctacaggggagcagactgctgcctcttgaccttcagcgtggatgatcggcagagcttcgagaatcttggtaactggcagaaagaatttatttactatgcggatgtgaaggaccctgagcatttcccctttgtagttctgggtaacaaggtagacaaagaggataggcaagtgactactgaggaggcacaaacctggtgcatggagaatggggattacccttatttagaaactagtgccaaagatgatactaatgtgacagtggcctttgaagaagctgtcaggcaggtgctggctgtagaggaacagctggagcattgcatgttgggtcacaccattgacttgaacagtggctccaaagcagggtcttcgtgctgttaaagatagggagccttttaaaaatgtgccccaaattgatcagtcagtagtgtaagaataactgtgcccctctaagagtgcacacacacgcacacaagagggtaagagacaaggttctgattgtgaaacagagcctttcaaattgaagtgtagattgatttaaaaaaattaaaaattaaaaaaaatgaagctctatcaagccaagtgtattttgcgtgatttctgctatttccccttcttgtgtgtctcaggacatatcagaaaattttagtcctgagacagttaaatattttttaaatcacagtttaaacctagaacccagctgcatgaaggagttaaagagctacaactatttcttaaagtgttccattaatcaactaacaaatgtcactatcagactcttgccaagcagtttctgacatttctgccaaaggggaaaaaaatcagactttgagctgtattacaataaaaataataatgcaaataaggattcctaggcttgaattaaagaagttgtaatgattaggagtgcaaaagtataatgatatacactgacttgtttaaatccttatgtatggttcgctcccatctgagcttttcaaaaaatcccatctcaataagagatactctaatgacactggcaattgattatacttcttgtgtttgaagtcataggatactagtgaatggattatgcttaaatatgccaaccacctttgcaaataaatggttggtctgcttttaattcctaagtctacttttgctgcatagagatgttgcttctctgacaacctcttaccaatttagcaatgctgcttagtatatgaatttggatgcagtgctctctgctcatcatttagatggtcctttgatccaacatgctgggctcatggagaaggcttcataaaagattgggggataatgaacttttctcacaaggctccttaactcaaatatttattgcagaagaaggaactggtttcttatatgttgcactgtatgttcaactagcctaattaggacattgaaagtgacagaagagcagatcttaacccagtgttagaatgaatttcccataaacagagttgtccaacagtggaatggactgccttaatagtgagctccctgcctctgaaaatattcactggatgaccatctgttagaataccataaaaagattttctgtgctggctacatgttcaatataaagtcctttctggctctaagttctatgaatatataaactacatcagtgccatgctgtggttagatttatctgatgataacagctaagactatggagagggactttaaaaattctcaaaccattctgtgatcaatctttaacagcaactacatagctcttccttttgcttttgcactgtggcaggaaaaattcttgagctctgagtaatctttatgtgactgataaaaaacatcttaaagctcccatgttaaaatataaaaatggtttgacaatttttgattaccatgactgtcagttatatactatattatgaatatgcagtgtggttcttgttggttgatctgtttaccctgcatagattttaatctgtactttaaaacatctatgataaaaatagtgacagacagaaattaccccaaaaagagacctaggccaggaagggggtgggagctttcataggaatacagcctagaactctccattgtagccacgtatggaatcagccttacttacatgtaggacctttgtgctttaagagctctgggacatattggccaaatagaaaagaagaggacagtatttcaactcagtcatactcaatatttccaattaagatataatcctgacaccattgttcaattaactttgacgccagaagtcaaagccagaactgggaccccacagctcttaagtactggtccctatcctgcctatgcctatagccagccacactggtttccaagttctgtgatcattttgctacaatcatgttagggtgaaaatctgtacgtcagaactgttaaatgctaattatttttaagtgcatgagacctggggccttctctttctacttgcactctgcttatactagtttctatttgtagatctcaggccttcatcataaagacctctatcaactcacaaaagtatttgtctctattagagtggcatgtgg

SEQ ID NO: 17515 - DNA, 13193 bp, Human
tccgtctcaaaaaaaaaaagaaaagaaaagaaatatgcttataccatttgatctgatgactctatttctggaaatttattaaacagtttatcaggacattatccaatttgcaaataaagacttatatataaagtgtattatttacaataggaaaaaaatcccaaatgtcccacaatcatggcaattatacaactattaacaatattttgagttacacaaaaagtctaattgattgcttttatgatatacataagcataaaataaatcttggaaggactatgccaaaatgtgaattgaggctatcattagttagtagattaagtgtgacctccattttataaaaatatttttctgtatttttaaattttttcataacaatgagaggtaggtttagtataaattaaggaattgtaggcctcatgatgagttgcttcaaaagaaataattgtcagggaggcaacttttgggccctgtaaacagaattcacagcctacccttaagactggcctttaatggagttgttccaacagacacagcacctaaggtggacggacgctccaataacgaagatggctatagacagaggctactgctaccttggcctctgggctttcatttttcaacccgcagaaataataatagaataacaatttatcctccgctgagttcctactatgtgctaagcactttacctgcttaatctcacttaatcctcccaacacctcttcaagaaaggtatgatcaatattattaccattttagagatcaaagaactgaggcttggaaagaggaaataactggctgaagccatcacatctcatttgtgtgtttccttgcctctcttctctttttctcttttctgcctttcatttggtccagctcatcaatgcatatcttgatttctgagctgaagaccacaaatccagttttccatctctctgaaaaacttttcatctcccttttttttttcctcagagtgaatataccaggccacctggaggcaggctttcctgagagcacctcccgcttccttttcctgctggcttttaacttttgccccgggggccacagccagctttctcacttggtagcagtggcctcttgtgcctttttctccaagatcacccaggtcagtatgtgtggttactctcagctccctgagggagtgagcagccagaggggcatagcatacttctctccctccagctcctttctccttggtcctaggccctctactcttcaagcccttttgcttgcttcagctcctgcttcttgctccatctcctcccatcttttctctcttctccaattcatttccttggactccatttctgcctttatacccttatctttattatcattgccaaaagcaaataccaaattcttgtatttgaaaaaagactttggccaggcacggtggctcacgcctgtaatcccagcactttgggaggccaaggcgggtggatcacgaggtcaggagttcgaggccagcctggccaacgtggtgaaactccgtctctactgaaaatacaaaaaatagcggggcatggtggtgcgcgcctgtagtcccagctactccggaggctgaggcagaacaatcgcttgaacccaggaggctgaggttgcattgagccgagatcatgccactgcactccaagctgggcaacagagcaagactgtctcaaaaataaataaataaataaataaaaaggagactttttttttagtgcagtgattccaagatttgttcatcgatatgcaaccaactaatgagtgttatgcctcacagttcccttctcctaagttttagagttagagtagtgggtgggaaggtgataaccacagtgtaaactaaaaatccatactggggatggaggctgagaggaggtttcaggggcaaatgaccagaacacttgcagctggaaagaactgtagagaggactttggaaagcggagggttgacagagccggtagttgtctcctgtccattcatctcctaggctgaagctcctgagggactcacatcagttatcttgctgctccagaagggtgggagatggcagttttcccaagctccggtctccccagatgtctgctcaccctcattctcctccagctgcccaaactggattcaggtaagtctctctctctctctgggctgcatagttgaaatatatcaataaatgtaaaataaacaatcccacttggctctccctggagacctccactggatccagacaaactcagctgtcaaaggagtaagagagcgcggggcactgcgctttggcgggaatctggtcggtgtctgtccgtagttcgcatctccacatcccgtctgatcccgctcgtttttcggcagctccctttgacgtgattggacccccggagcccatcctggccgttgtgggtgaggacgccgagctgccctgtcgcctgtccccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttctccgacgactcccctgctgtatacactttcgtatggatcagttactttggaaaccatcagattcattctcaaaatctcttttaggttgatgtcgccggggagggacgactatctgggcgggaggcgagggggggtaaaagaatttaccaagacagttgtaaagaaaggcagatttacttttaaaagtatgaaaatacttttcgaggaggcaaaaggcaggatcagcaaaagagaagctgactgccaggaaacaaaggcttgctggataatttatagaatagtttttatgctgtctgttgaagatggctttgtgcagtatctataaggcaaaggttgcagtgagctaacttgcaggtgtttggtgatagttggacacaggaaggatgactgtgagttatttgcacaggagggctgtgtactggaccatgaagaaaggcagacttgcagcttatctgccttatctctttgttttcccctgattaggactccacagctagaaggtactgaaggtcctacagtaggaaatcagtgagaaagggttttgagttgaacatggagagaacagtgcaatgtctttattgtagaactttatttcaattatctccagccctttttcaataatagggtaagcatttcttcatgaaataattaaatacatataagagttatataacattcttttatacaagtacaccataatttacttcatcgagtccctgaattgtacatttaaattgtatttctcaccattacacatcttatggctgtggtgagcataccacacactttaaggctggcttatggattagtttctaaagactgacatcctaagattagagagcatggcggtttgtcacattcctgattcatatagaaaagattctgttcttgttcccttttttgcttcaagccagaattcaaagggaaacaataaagaaaataataagctttgaggaggaaagtacgcattgaggtctgactttctcaattcctagtgaatgacatcaagcaaatctctttctgatttttactgtaaaactgaggatgtttttatctaagattatttttcaagaataaaatagtctgggaccagtggccaactcctataatctcagcgctttgggaagcagaggcaggaggatctcttgagccaagaaattcaaggttacagtaagctgatggttgccactgcactccagcctggacaatagagtgtgctgtcaaaaaaagaaaaaaaaaaagtgggatgtggtgtctcacgcctgtaatcccagcattttgggaggccaaggcgggtgactcacttttgatcaggatattcaagaccagcctggccaacatggcaaaaccccatctctactaaaaatacaaaaagaaattagctgggtcatacctgtaatcccagctactcaaggaaaatcgcttgaacctgggaggcagaggttgcagtgagctgagactgcactactgcactccagcctgggcaacagagtgagactcgtctctaacaaaaaaaaaaagaataaaataaaattagacaatatatgagaaatgacctcgccaattctaaaaacattatagacttattagatactatactgtgccttaaactgatctaaaacatataatatacaaacatattgcctttcacatatatatcatatatgtatatattatctaaatctatatgcatatattatatatatatatacatagatatatattcaagtaaatataaagtttgaaaaatacttgggtgaaatgtgggtccctgcttcacaacagggtcccccagttgcagcatcatgtataattcaaattttgacattttgtttttagggaagaagtatcttaaagcttgattataaaaacatagaaatttgatggcataaaatgtgttaccttttatgagtggcagacacccttgagaatctgctgaaagtggcagctccttccatgaaaagaatatatattcttgtatatacacacattcttggaatgtggattttaaccagtggttgtggaaatgtgtttaagagctcttttatgcagctcagtgtttttctgtaccatgtggaattacagaaaaaaataggctaaacacacaagaaaagcagctttatgtttatatataacaggccacaattatgtgagggaatatgaagttgagaccatttaagaaaatttctgaatcaacatcatagataaagaaagcttaaattgtcaactataatctcaagccaaagaatcgccaatcctctcctcaaggatattcctctgttcatccttaaatacccagtcctatttctcctcctccccaccaaagtcttctcataatgctctcagcctagaccactaacccacctctgagttattggtcttagtgttcctgctggctggacaagcacccccaagtctgcccaccaaactgctgcaaacatttcaaaggcttgatcccaacaaggcatccttctctgataaggtatatgaaattccttttattggtacttcaatttcctttaaaaaaaaaaaaaaacttttttagaaacagcatttcactctgtcacccaggctggagtgcagtggtgccatcacagctcactgcagccttgaactcctgaactcaagcaatcctccaacctcagcctcccaagtagctaggaatacaggcaagaaccaccatgcccaaagagatggggtctcattgtgttgcccaggctggtcttgatctcctggactcaagtaatcctgcctcagcctcccaaagtgctgacattacagacataaaccactgtgcctggccctcagtttccttgtatattgaaatatggagatgagttcttccccctactagtccacttgtgcctttctgtctctctctttctcaaactatgtagctctctggttataaggctcccaaaaggggtccgctaaaacattaagtctagattctctctccatagctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctacgaaaaatgtgtcctgctacatccagaatctccttcttggacaggagaagaaagtagaaatatccataccaggttagtggaaccaatgctgctggattcctatgttgacacagcttcagagccacaccacctgggacacctgcccagatgtgacctcatggcagagttgtctactttccccacctaagctcttttccagtgacttaagggaaccccaccaactttattagaagagttaagatactgaagacataaacctaccttgatctcaaataaatttcagattatttatctatttattttttgagacagtgtctcactctgttgcctagactggagtgcagcagcagaatgatctcagctcactgcaagctccgcttcccaggttcaagcgattctcctgcctcagcctccagaatagctgggacgacaagtgcacaccaccgtgcccaactaattttgtgtatttttagcgaaggcagggtttcaccatgttccccaggctggtcttgaacttctggcctcaagcaatccacctgcctcggcctcccaaagtgctgggattataggtgtgagccatcacacccagtgaaattccagattttccatttcaggagatctaagtgagatagagaagctttgtccctggaggccttcctgatccagagccttctctcctcaagtaaacaaaaagactaagttggccgggcgtggtggctcacgcctgtaatcccagcactttgtgaggccgagacaggcagatcacaaggtcaggagatcgagaccatactggccaacatggtgaaaccccgcctctactaaaaatacaaaaaaattagccaggcatggtggcgggtgcctgtagtcccagctacttgggaggctgaagcaggagaatggtgtgaacccgggaggcagagcttgcagtgagctgagattgcgccactgaactccactccagcctgggtgacagagcgagactgcatctcaaaaaaaaaaaaaaagactaagttatttttctacttttgccatttccacccatactcacttctccttcctatcccatgctagggctctgtctaggtttccagggtcctcagggaagaaaatcctctcattattccccagatactgtctctggttcaggcagaaacctttccttattctttggtcaatgagtcccattctgttacatacagaggcacacttccccttccttatttacctccttcatcctcttggctcccattctgcactgatagttaaggaagaatttccataatgacatgaattggtccattatatttattatttcacaggtcctgtcccaaaattactcgtcatttctctctttctctgctgactcctgcttgaagtcaatttttttctgaaaagtttagagtggcattggagtgactatttttttgctatatgagggatgagagtggtccaggccatcacctcttctaccctcctttggaatgtggagaaaagctggacttgctcagaatttctcaactaatgtccttcttggggattttgttttagcttcctccctcccaaggctgactccctggatagtggctgtggctgtcatcctgatggttctaggacttctcaccattgggtccatatttttcacttggagactatacaacgaaagacccagagagaggaggaatgaattcagctctaaaggtaaaccatagaatccacaagggctacgtgtcaggagtgcttcagaggcaggctggatccaagtcctttagaatgacttattttaggatgacaggaagatatttgaggctgggcatggtggctcacgcctgtaatcccagcggtttgggaagccgaggtaggtggatcatctgaggtcaggagttcgagatcagcccggccaacatggcaaaactccatctcgactaaaaatacaaaaattagccaggcttattggtgagtgcctgtaatcccagctactcgggaggctgaggcaggagaattgcttgaacccaggaggtggaggttgcagtaagccgagatcgtgccattgcactctagcctgagcgacagagtaagactccgtctcaaaaaaagtagaagatacttgattctagaattctgaaaattggaggaaatcataagggtcctgaagtcacagatgccaatatgaagaagcacagaggattggggcataggcagagtctaatcaagatatcagggctgatgtttactcactacccaccctcagaccctactcccacttttaactcaattgcccagtaccaatcttattattaaagatctgaggccgggcgcagtggctcatgcccgtagtaatcttagcactttgggaggccgagatgggtggaacacatgaggccaggagttcaagaccagactggacaacatggtgaaaccccgtctctaatgaaaatacaaaatttagccagggtcgtggcccacacctgtagtcccatctactcgggaggctgaggcgggagaatggcttgaacctgggagatggaggttacagtgagcagagattgcaccactgcactccagactgggcaacagaatgagattctataaaaaaaaaatctgatcccaagccagttccaatatgtaggaacttcctgcatctttcttcgaaaacaaagcaaaacaaaatccttgttcttgatttattggcaatgcttcaatattcaaatagtcatgaattaaacagttcctcctttgtgtgtttcccacacgagttttgtcccctcctttacgtccactatagaaagccattgaggtatttttgtttgttttccagagagactcctggaagaactcagtaagttctgtcttcttgttatttcacccacagagttttctctctcttattatataacctgtcaatgactatctttctcttttgttgcagaatggaaaaaggctaccttgcatgcaggtcagtggctctgaacttctctagggctctgaggctctatcccctaggaattcaaagtgctatgatacttggaaatgaaaacactaacactttagtgatgaggacaggaagggaaacggtgatgacagatggcctcaacagtttctgtgaggcacatagagaacccttggaagatggcacttccgacagagtcccattaggccctaggcacagttagctcttacatcaccctctggctgctggtaaggggggatcctgtggtgaatggagacccctgagcaggccaaacatccccccacctccagaagacctgtcaactcctacaacagtgttctgtttcttaggagaaggaaagacagtcctgcaacctgtaatattcactgatgtcagacctgctgtttctttctctccagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggagtctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttacaccttccatttccatcgtattctccagtttccaggatagatgttgctcatcgtctttacctaataaataagtttgtctgattgctgaaagcaacctcttaacctttcttttttaatatcaactgaaacaaaataaaacatagggcaagaaacctgcatgggaatgcagctgtctaaagctttgccattgtatgtggtctaagacccatccctaggcctgatggcagtgggctcaccagggcaggtgcacatgggggctgatgcctcatgagggaacaactgcttaccagggtcttcaagcaggaatacagaatctcaactcaggaacaattttttattagtccatcctcatatttctgtaaagaaatacctgagactgggtaatttataaagataagaagtttaggccgggcacggtggctcatgcctgtaatcccagcactttggaaggccgaggcgggtggatcacgaggtcaggagtttgaaaccagcctgacaaacatggtgaaaccccgtctctactaaaaacacaaaaattagccgggtgtggtggcaggcacccgtaatcccagctgctcagaaggctgaggcaggagaatcacttgaacccgggaggcagaggttgcagtgagctgagatcgcgccactgcactccagcctgggtgacagagcaagactccatttaaaaaaaaaaaaaaaaaaaagataagaagtttaattggctcatagttatgtaggcatgacagcttctgctcagcttctggggaggcctcagaaaatttacaatcatggcagaaggcgaaggggaagcaggcacatcttacatggccatggcagaaggaagacagcagcagggacgggggaggagagaggggggagcgggggatgtgctacacactcttaaacaatcagatgtcataattagtcactcattcactatcacaaaaatagcattggccgggcatggtggctcacgcctgtaatcccagcactttagaaggccgaggcaggcagatcacctgaggtcaggagttcaagaccagcctaacatggtgaaaccccgtctctactaaaaataccaaaaaaattagccgggcttggtggcacatgcctgtagtcccagctacttgggaggctgaggcaggagaatcggttgaacctgggaggcagaggttgcagtgagccgagatcatgccactcacttcactccagcctaggcgacagagagagactctgtctccaaaaaaaatagcactgaggggatggtgctaaaccactcatgagaaaccgcccccatgatctaattacctcccaacaggctgcacctccaacattagggattacaattgaacatgggatttgggtggggactcagatccaaactatatcaaataatatccaaagatcacccaccccattttttttcttttaattacaaggccttaacattaaagatttcccaaatatttcctcctcttgcaaaagtactgttaaagagttggcttcacttacctataccattgaccaggttacctttacagtagtagaaatgaagttcaccacccaaacaggggcagagggtaggtagccattggcactctggccttttggatagctgaacacacggaggtttctggagggcagtgtgtgcacagagaaagcttcggagctgcatgccccttcccacacatcttgccctgtacatattttccatctgtcttttcatctgtatactttgtaatatcctttataataaatcagtaaacatgtatttgcaggataggttggataaaatcaagagtaaagtctattgaaggaaggaggaggcttagtagcatcagtccccggatttaaaagggatgtttgaacgaaactgggattccgagaagaggaaagagaagactaaaaaaaggagctaaaagaaattgctcgatctatttataatacattatgatgtattatgaaagtaaataccactctaatactttcagaatacattataatcctccctgcacttacttgcttaaatccagcatctatttctgcaatattaaaatcctccaaagcattctatttcttttaggggca

SEQ ID NO: 17516 - DNA, 16740 bp, Human; identical to SEQ ID NO: 12331

SEQ ID NO: 17517 - DNA, 23501 bp, Human
aagtgggtggactgccttgtgctattgaccattaaacagctgcccaaggccattgagctattaattaaataataattattattattttaaatttttttgttgtgttttttgggtttttttgtttttgttttgtttttttgagatggagtctcgctctgttgtccaggctgtagtgcagtggcacgatcttggctcactgcaaactccgccttctgggctcaagtgattctcctgcctcagcctcccaagtagctgggattacaggcacccaccatcacacccggcaaatttttgtatttttagtagagatggggtttcaccattttggccaggctggtctcaaactcccgacctaaataaggtgatccacctgccttggcctcccaaagtgctgggattacagatgtgagccaccacgcccggcctatttattgtttttacagacagacagggtcttgctgtcccccaggctggagtgcagtggcagagtcacggctcactgcagcctccaactcttgggctcaagaaatcctcccgttttggcctcccaaaacactgggactacaggtgtgtgccaccacacccagctaattaaaaaaatttttttagagatggggtctcgttctgttgtccaggctggtctcaaattcctgttctcaagcgatcctcctgcctcagcctccaaaaatgttaggattgcaggtgcaagccactgcacctggcctctatctccctgtttcttgctctctccccatctgtgtgtgtctctgacagtctgtggctctctgtatctttctgtgtgtctctctgtgtgtgtcttggtccatctcatgcccagctaatttttaaattttttgtagagatggggtttcaccatgttggccaggctggtcttgaactccagacctcaggtgattctcctgcttcagcctcccaaagtgttgggattacaggcatgagccaccgtgcctggcccatgggtatgaatttctgcctgtgtgtgtcttcttcttttttttttttttttgagatgaagtcttgctctgtcacccaggctggagtgcagtggcgctatcttggctcactgcaacctccacctcctgggttcaagcaattctcctgcctcagcctcccgagtagctgggattacaggcacccgccaccacacccagataatttttgtatttttggtagatatggggtttcaccatgttggtcaggctggttttgaacccctgacttcatgacctgcctgccttggcctcccaaagtgctgggattacaggcatgagccaccgcgcccggcccatgggtgtgaatttctgcctgtgtgtgtctttttagcgtatgtgtgtctccatatctgccatctgcaggagcacctcagtttcattatcttgctccctgtctattggagtgtatctctcttcctctctgtgtgactttttgtgtttatgtgtgtgtttagtgtgtgtccatattttcctgttctcttgtgtctctctgctgtgtctctctctttttctttctgttttttgagacggagtctccctctgtcacccaggctggagtgcagtggtgcgatctcggctcactgcaacctctgcttctgaggttcaaacgattctcctgcctcagcctcccgagtagctggaattacagacacatgccaccatgcccagctaattttgtatttttaatagagacggggtttcaccatgttggccaggctggtcttaaactcttgaccttacgtgatccacccgcctcggcctcccaaagtttttggattacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcaggtaagcctttcccaggggtgcctcagtcctcaggctgtcccccatcccccaggagctcctggccccactgggtggggtgggaagaggcctggatgcctggcgccccctcccgcagccccactctcaccctggcaccaggctctgtggcacttcaggggtcagtttgtttctgggcttctggccactctcttgccctcgccttcccctgtccagcctgtgtagccttgggacatcccagggtggtcccatcattgccagagactggtgaagtaagtggccgagagccaaaacagtggctgccctggcctgggagcctcggtttcctcatccgtgaaatgggactgtaaccccctacacaggtcaggggaaaacggtgggattacaggccagggcccaggtcttgccccaggtcaggtgaagaacccccactgcctccctgcccagccccctacctggccctcaactctgtccctgggaccagggctgctcaggcccctcctgcacccgcccgcctccctctctccctcccagctaggctcatttgaagcccagagttatttggaaaaagcaacaggaccagccgggcacggtggctcaacctgtaatcccagcatttggggaggccaaggcgggaggatcatttgaagtcaggagctggagaccagcctgagcaacatagtgagactcccatctctttaaaaaataaaaataaaaaaatataattaaaaactaaatgaaaaaaccaacagaccccagagcagagtccagtggataaagccatccagggcttcaagccaggctgccccctccccaaccccagtgtccccaaccacagctcagctcggagaaggctgggagaaccggcagggtggtctcgagcgtccttccaggcgggattcagacactgtagctcctccagcccagccccgagaacttccccgaagccagctcttggcaatcgttgttcatatgaaaactgcccacttccctttagtgctattttggcctctgcagaaccgtggtctgtggcagcccccactccccaccccgcccagccctgccggcccctgggggcctcagagggtccaccctccgctccctccacctcagcccacctgctttcagaacctggatgggagagtgaaagtgagagcgagacagagacacaaagggagacagagacagagagagagcacagaatttttttaaacggagtctcactctgttgtccaggctggagtgcagtggcgtgatctcggctcactgcaacctccacctcccaggttcaagcagttctcctgccttacccttccaagtagctggggactacaggcacgtgctaccacacctggctaattttttattttttatttattttttattttttggagacagtcttgctctgtctcccaggctgggagtgcagtggtgcaatcttggctcactgcaagctccacctcccgggtacatgccattctcctgcctcagcctcccgagtagctgagactagaggcgcctgccaccacgaccggctaattttttgtatttttagtagagacggggtttcgccatgttagccaggatggtctcaatctcctgactttgtgatctgcctgcctcggcctcccaaagtgctgggattacaggtgtgagccaccgtgcctggcctaattttttatttttagtagagacagggtttcaccatgttggccaggctggtcttgaactcctgacctcagatgatttgcccgcctcagcctcccaaagtgttgggattacaggtgtgaactaccgcacccggccaacagcgcaggatgtattcagtctgggggcagacacatgactgtttgttaaatttcattttttgtttttagagatggggtcttgctctgtcacccaggctggagttcagtggtgtgatcttggctcactgcagcttccaactcctgggctcaagcaattctcttgcctcagtgtcccaagtagctggaaccacaggcatgtgccactgcgcctgcctaattttttcatttttttgtagagacagggccttgttacatcgtccatgctggtctcgaactcctggcctcaagcgatcctcctgtctcggcctcccagtgttgagattacaggcgtcagccaccacgcccagcctgatcccattttatttattcatttatttaatttattattattattattattattttgagatggagtctcactctgtctcccatgctggagtgcactggcgtgatctcagctcactgcaactcactgcctcctgagttcaagtgattctcatgcctcagcctcccaagtagctggaattacaggcttgcacctccacgcctggctaatttttgtatttctagtagaaacagggtttcaccatgttggccaagctggtctcaaactcaagtgatcctcctgtctcagcctcccaaagtattgggattacaggtgtgagtccctgtacccagcccgacctcattttatagatgagaaaactgaggcggggggctctcaggcagaggctagatttggtcccatgagccctcctgcaagacaagttgctccaacctcacaagcctgagatgaacttgggccatgctggaggggttgggggtacaccccgggttgggggcactgaggcaaggagagtttcgaggagggagaagggcagtgcccaggcgggccatggggaagagagagcagagctttcctcggacaacctcccggggtgacgtgggtcgtgccagtcacacggctcagaaattcacttgttcccactgactcacttggcttttggggagaggcctggtggcttctctgtgatgcgcctcttacagaggctcagggccgcatggagattccctgtcatcttaccgcagggatttgggaagtccagagaggtcctgagacttgtccaaagccacacagctttcaagggggacagcccaggtcctggtggacctcagggggatcccaaggcaggaggtaggcagcctggagctcctccattattattattattattattgagatagagtttcgctcttgttgcccaggctggatggagtgcagtggcgtgatctcagctcactgcaacctccacctccttggttcaagcaattctctgcctcagcctcctgagtagctgggattacaggcgcccaccaccacacctggctaattttttgtattcttttttagtagacacagggtttcaccatcttggccaggctggtcttgaactcctgacctcatgaaccacccgcctcagcctcccaaagtgttgggattacaggcatgagccactgtgcccggccatttttttttttttttttttttgagatggagtctcgctctgttgcccaggctggagtgcagtggcatgatctcggcccactgcaacctccacctcctaggttcaagtgattctcttgcctcagactcctgattagctgggatcacaggcgtgtgccaccacacccggctaatttttgtatttttagtagagatggggtttcaccatgttggtcaggctagtctcgaactcccgacctcgtgatctgcccgccttggcctcccaaagtgctgggattacaggcgtgagccaccacgccctgctggagctcctcccttttaagtcctgtttactgctccaagcctcaccttccccagctgtgggatggggagaagccctcctcactggtggccagggtgggaagaacacggcgggtgggggagagtggacactcgggagtgttggctccacaaatgcccaccatactcaaccccttcagagaccccaccaccctcaactctgtccccagccatctccagggggccaggtctccttattattattttttgaaacggagtctcactctgttgcccaggctggagtgcagtagcatgatcacagctcactgcagccatatatatgtatatatatatatatatgaaaaaatatatataaatatatatatatgaaaaaatatatataaatatatatatgaaaatatatatataaatatatatatgaaaatatatataaatatatatataaaatatatatatgaaaatatatatgaaaatatatatatgaaaatatatatgaaaatatatatatgaatatatatatgaaaatatatatatatatatatatgaaaatatatatatatgaaaatatatatataaatatatatatgaaaataatatatataaatatatataaatatatataaaaatataaatatatataaaaatatataaatatatatatataaacatatatatataaatatatatatatatatatttttttttttttttgtattttttttgtagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacggtgggtggtgtgcgtatgttttgctgaggcctggtcatcacgctgtggctccaaggctgggaccagccacagaccgagaagccggtcaggtgccagccagagattcagggctccctccctctgaacatcctgtctttagcccatccttggcatcccagctcatgtcatcccagccacctgcagcagtgccctagggccccatccctctgcggatcatgctcttgggccacctcctccaagaagccttccctgacctccctcctcccagctcccaccacaggcagaatctgggcttgcagttgtttcaggaatggaagccccattcccaggtcctggggggaccccaaggcaggaggtgggcagagaggggtcctgcgaagcatagaggagccctgagttgctctggggtgggcgagggcttccgggtgcgtctgcgtgagtggtggccacagactgtcacctccaggagccagggtgggtttactggaggcaacccactgtgggttgatgggcagagccagggttaggggcaggacactggggcctgaatcccatctttccacttagcagacgtgagctctctggcctcagtttctcgatttgtgaaatgcagtgaacctcgtcctcaaagggcagttgtctagattaagcgaggctgtgtgtagggctgtgtgcgtgcacatggggctgtcttgtgggcccccagaaccttccagcacttatcaagggtgaagatggcccacagggcagaggtgttggtttggggtcacatggggtgaacaggactggttctgtccttgcccagtgcaggagcggggaggggaggtggtgtttccgcagcctaggctcaggtatggggctgtccgagcacagtgggggtgtggggtaggattcctgaaaaaggggccccttgctcacgggcacctcccatttcagcatcacaagaggcaacaccaggagccaacatgagctcggggactgaactgctgtggcccggagcagcgctgctggtgctgttgggggtggcagccagtctgtgtgtgcgctgctcacgcccaggtaagcgggggtctcggggacgtgatggggagaaggtgtggacagtgcatctcagaggccctctcaggcccagacgtggctgtggtcagaagaggtggtcagatgaacctcgtgatgtgacccctgacccctaaactgccccctgaagacaatggtcaggtgcacccgagggctttggctttgctgggtcaactgtggtatctcgagccagagagattgccccagacgagggaggggaggcgaggttgcctgtggcatccacttttctagcctctcctcttctaaaaaagggtgagcaaatacccttttttcttttttttggacagagtcttgctctggtctcccaggctggagggcagtgatgcaatcttggctcactgtaacatccaactctcgggttgaagcgattctcctgcctcaaccccctgagtagctgggactacaggtgcctgccaccatgcctggctaatttttgtgtttttagtagagacggggtttccccatgttggccaggctggtcacgaactgctgacctcatgtgatcctcccgcctcggcccaaagtgctggaattacaggagggagccaccacacctggtcccaaatattctttaatatcaggtggccggtgatgattgacagtttggcccccaagtcctgtctgagtcctgctggagacaagacatggcggggggtgtctgacctcaggtcgcagctgctcccagaccctttgctaatcctggccttttcttgcaggtgcaaagaggtcagagaaaatctaccagcagagaagtctgtgagttgcctcgatgtccctagcctggtgtattcatgtgccctgggcatggacgtcctcaagggaattcctagcaccccatccttcaccccttcactcacacctcctccgtgccaagttctagtgggtccctagccatcagagaagggagagaaagtgtccaggggctgtccaggccctgctgtagcttgggttagggagggctttgggaggcggggacgcctgggctgtggggctagccactcttcagcttgcctgtgaacccctccagaagtccaggcatctggccaggcacgatggttcacacctgtaatcccagcactttgggaggccaaggcaggtggatcacctgaggtcaggagtttgagaccagcctggccaacatggtgaaacctcatttctactaaaatacaaaaatgagctgggcgtggtggtgggtccctctactcccagctactctggaggctgaggcagcaggatcacttgaacccaggaggtggaggttgcagagagccgagattgtgccactgcactccagcctgggcaaaaaagcaagattccgtctcagaaaagaaaaaaagaaaagaaaaaaaaaatagaggtccaccaggcacctgtgtcctcagcctccctttgaccccaatccccaggggctagtccgctctccccttgcaatgcaagagacagagaacccggcacagggtgaaatgtgaacgttgtcggagactcccctggaaaaaactgccggagctcaggggaggatgtgggcaagtccctcgggggaccagggaaggactgtgagaaagacccagggaagggcagtgggttcgacactgcagactggggctgaaacccagaacaacccaggcacatgggcagtggccacaggtgtcctttgattaagagaatggctgtgggcccaggaaaccttggaggtccatgtgcacccccgagcagtcactcatgacccacacacgcacacccgcacacacatccttcctcatttccttttgcaactgaaaaaccacagtgagatttgaaaatagaatcttcccatccttgctcatcgtgggccagggttagacctttctgggtctttctggccacgtggctttctggccgcctgcaacctcccccgatgccccccatgcccttgactcctcggacacttcccctctcccctcaggccctgcccacccccagccccctgattgatcttagagccatagatggtcagggccagactcagcgtccccatgtgggaggtggaggggagctgtttggtcttctccctggaatgcctgtgcctgcctctccatctgtcacctcggttgggctcagtcccaccagcctgcatgaagcgactgctgtgagcacaggctccgttcctctgttgcttctcccaggaagccacgtctgactgactctctcctgtggatttagggtatctctcctaaatcaggtcaccctgagccccagtcttcaaggagcttggaaggctgggccaggtacccattctggttcagaggaggagcccccaaacctgctttaataatgagctaatccactccattatctgtaatggcagcttccattttcaagagcacctcatggtccaagatggcagctggggtgccggccctcatctctgcattcccagcagcaggaagaaagaatgaacaaggatacaaagggtgtctcccagttgccagtgcccccgtttaaaaagatttattggaaatatcaacaaccttggcttgaatctcatagaccagagcttaatccatggccacactttggtgcaaggaaggctaggaatagtctattatttatttctttatttatttagagatggagccacatttacttttgttcaggctggagtgcagtagaatgatcttggctcactgcaacctctgcctcctggcttcaagcgattctcctgtctcagcctcccgagtagctgggattacaggcatgcgccaccatgcccagctaatttttgtatttttagtagagacggggttttctccatgttggtcaggctggtcttgaactcccaacctcaggtgattcgcctgccttggcctcccaaagccctgggattacaggtgtgagccaccatgccgggtctagagtgtgtgctttttttttttttttttttttttttttttttttttttgagacggagtctcgctctgtcgcccaggccagactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtgagtgtgtgcttttttaaggaattgcaaacgctccctgggaccagcaggtgggaggcagcctcatcgtcactcctggctgaaataatttaccccaagtcattgctgggtccctgagcacctgccttcattcaccctcatgccccagaatctcagggctacctccacagccctgtccacagacccctcctgacccgtctccaggggcctgggacccaccggcaggatgtggccctgttgaggccatgtcagggatgggtctggctgagagccgggctccagcccagggccctgtgtgagggttgggcacccagtgcacggaggggccagagaatggggatagcatggggagccgtgagaatgaggcctgaaagggcagcagttcctccccactgtcgccccagtccgtccctctgctttccctcctcatccctgcctgtccctccctcctgtccctgtgttcttgggctgtgggagtccaggcccaggctcagcacagcccatgcatttccaggcgtgaggaccaacagagctttacggggtcccggacctactcctgtgagtctccaagtgtccccgggttgggctctgggttgggggtgtccctatcaagttatctcggtccccattgacctgagaccgtggccaggcctgatgtggggggatgatggggtgagggggctgggctagctgggggcccagccaacaccccacttcttgccctttgtagtggtcgggcaggcatggccaggacccctggcggacatggcacccacaaggtaggtcacagtcccccaggaagtgacaagaatgaaagtcctggaggtcctcacctggtgagcccaggtcaagacctccctccctccccgagtcccagagctccagggctcagctatgaaggccccacaaggggtatggggggatgtgtcctggggggcctctcccctacagcccctcctttaactccctccttccccctccctgcaggaaggacaagctgttgcaattctaccccagcctggagggtgagtggcacagggcagggacagggacaggcctagccaagctgggactaagacaggcgaaaaccccatgggacaggcgtcgtgcagtgggggctgcggggccaggcgaggcctccccaggagagacacacaggctggggcagggcaggctcctggaatcggcctggcagggggagggtgcacactcgcacatgccccactgaggggacagggagcactgcaaaggctcagacacgggaaatagctggccctgccttgggctgcagcacccgagctgggtgcaaagcaggggccaggggagaaagcaattagctgggtctttcttccagatccagcatcttccaggtaccagaacttcagcaaaggtaggtaggctcctggagaaagggggaggccatggtgggggccacacccaggggctcaggcccaattctcgcctcctcccgcaggaagcagacacgggtcggaggaagcctacatgtgagtgaccttgatcctgtcccccctgcctcgcctctccccctgccccacctctccccctgccccacctctccccctgccccacctgcctgccacagccctgggcttcctggtccaggaaccacctcttgcactagaacgaggcatccaggttcccctccttctcctggcaggcaggcattgggcgacactgttgtctcttaggtaaccctgggtttgggggactggactttgccctgctctgggacacagagtgtcaggggcgggggatagagactcattcagcatcacccagtcaaagacaagctacaggacacccagaatccctcgggggtgttgcatcatctcacagatgggcaaacgatggggaatggcctaaggtcacatagcaaggtggctcaccaggtgcggtggctcatgcctgtaatcccaggactttgggaggccaaggcaggcagatcacctgaggccaggagttcaagaccagcctcgccaacatggtgaaacctcatctctactaaaaataaaaaattagccaggcatggtggtgcgtgcctgtaatcccagctactcgggaggctgatgcaggagaatcgcttgaacctgggaggctgaggttgcagtgagccgagatcatgccactgtactccagcctgggtgacagagactctgtctcaaaaaaaaaaaaaaaaaaaaaaaaaaaaagtggctccagcccctggtggctcaggggtcccaggaagtgggggtgggggaatcagagaggagatcctggcagacccccatggcccccaagaggagcaatggtgggagcagccctggcctcaccgcccccttatggagcccccaacccgatctccagcctgccctgaaacctgtgttgtatatgttttcttggccagagaccccattgccatggagtattacaactgggggcggttctcgaagcccccagaaggtgaggcgaaggacaaagccggaggtggaggaagtggtgtgggagctcagggcagaagccatacctccaggcaggagaggaggctgggcctgggttcgggtaaatcggcagagccggttgggtggacagaaggaggctggtgctgcaggcgggggccaagaagggatagggggcgggcgggtcagcgtgggagagctgtgggcacagggcgtgggagagaggagtgggccacagggcagggaactagagggctggcttggggaggtggggggaggccaggtccttgtcaacgaggactgagcatcttctcctgaccccagaaggtacctgggatggtgatccctgcaggctctgaggccaccagaaacctggtcgctgaatgcctttgctttataggaagggcaactgagaggccgggtgtggtggctcacccctgtaatcccagcactttgggaggctaaggtgggtggatcacctgaggtcaggagttcaagaccagtgtggccaacatggtgaaaccccatctctacaaaaatacaaaaaaaaaaaaaaaaaaaaattagccaggcatggtggcacatgcctgtaatcccagctacttgggaggctgagacaggagaattgcttgaacccgggaggcggaggctgcagtgagccaagatcgcaccattgcactccagcctgggcaacagagtgagactccatctcaaaaaaaaaaaaaatccccccaaaaaagggcaactgaggactcagggtgggcagtgcctgctgagaggtgcatgggcctgcggtttgaatccagctccatgacctggctcctgcctggaccatactgggtaggaccatggtgttggggggtcctcttctgccccccaccactgccacctccattttttttttgagacacagccttgctctgtcacccaggttgagtacaatgtcacgatcttggttcactgcaacctccgcctcccgggttcaagcgattttcctgcctcagcctcccgagtagctgagattacaggcgcctgccaccacgcctggctaattttttgtatttttagtagagacagggtttcaccatattggccaggctggtcttgaactcctgacctcaggtgatccgcccgccttggcctcccaaagtgctgggattacaggcatgagccaccccgccaggctggcagtgctcatttcttaggacccccaacatcactgatggattttgggtggggcatcagtcagagcccagcttccccattacaaggccaagatggggtgccaggcgctgaggtgccatactcagcctgggtccccgagcaaagcatcctcagcctgccctgccctatctggaagagtccagccccttcccggcagtggctctagggagagctcctgattatagagatgaacccctgaggctgcccctgcctccctccctctctccagccacccggcatgggcctgaattgcagcccccgcagagtaccccctccagagtgcatatggaggggatctcagaagacagaggctggacacagtgactcacgcctgtaatcccaacattttgggaagattgcctaagcttaggggttcaagaccagcctgggcaacacagcgagatcctctctacaaacaattttaaaagttagctgggcgtggtggtgcatgcctgtagttccagctactcaggaggctgcggggtaggaagatcgtttgagccgggagttggaggctacagtgagctgactttgccagtgctctccagcctgggtgacagagcaagaccgtctcaacaagaaacaaagaagacagaggagctcagggctcagggaagagcatgcaggggcaccaggccagcacccattaggaagctcatccagaagaaggcttgaggtcccgggggacccagagggctagggcttggcggaagaggtcccctgcaaagggaaggcaggacagagcgggaggatgagccaggctttgcagggtctgcccacacccccgtgcccactcctctctctcctgcagatgatgatgccaattcctacgagaatgtgctcatttgcaagcagaaaaccacagagacaggtgaggctgcccagccagaggcaggctggggctgggagcagcaggcctccttggccaggtgcccctgcactccccactgctcaaaggccgcccccactttgaagcctgaaggctctcggatccccaggtacctttcggtagagccttgcccctactatcctcggaggcagctctattggctcctggtgcctctgtgggactgagccaaggggggcctattctccctctctgcaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatgggtaggtggccgggagaagaggcagggtggtccacttagggcaggcttgagggactggcctggaagggcaggctgaaagtgggcttccctccagccagtccagctaaccccgcagtgatgcctgggtgcaggagcagctgcagagaccttgaaccacacaggacggcccttggcagccgcccagcctccagggtggggtcaggtcctcccgggcaggccgccccatccagctgcatgcatggagtaacgcattcacctgctctcacagcaggacgatctccggcaaatcccagagacaggacagacacacaccgccaggacctgtcgggcgtggcatttcccgcgggctgttttgtggagtctgggggtctgagtctgggggagcagtcatgggtgtctccatgtgaaccactcgatgacctgtctgcccgctggtccacagggcaactccagagagaagcatcccctggcccggtgggaagcccagacgaggaggacggggaaccggattacgtgaatggggaggtggcagccacagaagcctagggcagaccaagaagaaaggtacagcccctgctctccagctgccgtgggccaaggattggaggtcttgccaagctgcaggacccccaatccaagggaacagccgagagtgtgggtggaggggccatggtgggggctacagggtgcacccatgggtgctccaagagggcagcttggcgactctgttcctctgttctggccaggggcgtcaggcagggaattctggtgacttcaggggcaaagaagtgggcaccgggtgggtctcccaactccactgcatcctcctggctgcgaccttggaccaagtgacaacctcccagaacttagttcctcacttggtgcccacctctcagagaagacatcgcacacacggccgggcacggtggctcacgcctgtaatcccggcactttgggaggccgaggcaggcagatcacctgaggtcacgagttcgagaccagcctggccaacatggtgaaacttcatctctactaaaaacacaaaaaattagccaggcatggtggtgggtgcctgtagtcccagttagttgggaggctgaggcaggagaatcatttgaaccctgaaggcggaggttgcggtgagttaagatcacatgcactcaaccctgggtgacagagcgagactccgtctcaataaataaataaaaaaacagacattgcacacaaagcctcagcccagcaggcactcggtcaatgctggaaacagacaggaggcagggacgttgggaaatgtaacagtggctgagacgcgctgaggagccaccgcaggccagtgagatggtgcggcgctaagcgctcacacgtgcaccatctcttagcacccaaagccacagagcagttaagccacctgcccaaggccacatcttgaagtaaggggaggaggagatggaatccccagtggtcagacatcagacatcaaagcctaggctgggtctactgcttgggaagcacgatggacccccagagggccttgaaggctgcccaaagtccccatctgggagacccaggccgtcatctcagcgagcaggctggagggtggaaaccacagtgaacctgggtggtcaagagtcagccccagaggcaggtgcaggagtttgagccaaatgtgcagagccccacgtcattcattcaaccagtatccactgggcccctgctacgggcaagtcctgctctaggtgctgggaacaccaacataaagaacagcaaacccctgaccccttagaacttgcattctggtaggagagagaaaacagatagggctggacacagcggtcatgcctataaatcccagcacttcgggaggctgaggcgggaggatcctttgagcctctgagtttgaggccagcctgggcaacatagcaagacctctctctctacaaaaactttttttttttttttttgagacagagtatcactgtcactcaggctggagtgcagtggcgccatctcggctcactgcaacctccacctcctgggttcaagcgattctcgtgcctcagccttccaagtagctgggattacaggcacacgccaccatgtccagcctctataaaaacatttaaaattagccaggcatggtggtggatgccctagagtcccactgacttgggaggctgaggtgggaagatcacttgagcctgggaggtcaaggttgcaatgagccatggttgctgcagtgagctgtggtcgtgccactgcactcaagcctgggcaacagagcaagaccccatctcaaaaaaaaaatttaaaaattagctgggcatagtggtgtgtacctgtagtcccagctacttgggaggctgaggcaggaggatcgcttgagcccaggagttcaaggctacagtgagctatgattgtaccactgtacagccaggatgacagagtgagaccctgtcaaaacaacaacaacaacaagaaaacagataagaagacatggcatgttcactggtggtaagtctggcagagagaaacaaaacagggaagcggggcaggaagtagtgtggggttgtgggcaagacgcagtgttgcaatttaaggaaggcggctagggaagcctttcagagctcccttcctcaccccatctgggggaaggacatccaggcagaggggacaacagaggccccagggtggagtgagccccacaggtctgagcaaagccaggggccagggaggagcaggtgaggggaaactagtggaggtcgaggccgttggtggggaggctgaccaggcagggccagcacttggggttttactgcatgagatgggagggagggagggagatagaaaggttgttttttctttttttttttttttcgttcctgtcgcccaggctgaagtgcaatggtgcaatcttggctcactgcaaactccgcctcctgggttcaagcgatgctcctgcctcagcctcccgagtagctgcgattacaggtgtctgccaccacacccggccaatttgtatttattttattttattttgttttttgagagggagtctcgctctgtcacccaggctggagtgcagtggcgtgatctcggctcactgcaacctctgcctcctgggttcaggtttctcttgcctcagcctcccgagtagctgggattacaggcacacgccacaacacctggctaatttttgtatttttagtagagatggggtttcaccatgttggccaggctggtctcaaactcctgacctaaagtgatcggcccacctcagcctccccaagtgctgggattacaggcatgagctaccatgcctggctaatgggaaggttttgtacaaagactggctggatgtttctaattcaatttttctggctgttgggcagacaaatgggtactgggagagtgggtacaggaagcccaggaaggacccaggcactggtgccatctgggcaaggggtggcagcagtggagacaggggtaggcaacatggtgaaacgctgtctctacataatatacaaaaatttgccaggtgtagtggcgcatacgtgtagtcccagctactcggaggttgaggcgggaggatagcttgagtctaggaggttgagctgctgtgtgagctgtgattgcaccactgcactccagcctgggccacagagcaagacgctgtctcaaaacaaaaacaaaaagaagaggccaggcgcagtggctcacgcctgtaatcccagcactttgggaggctgaggcaggctgatcacctgaggtcaggagttcgagaccatcctgggcaacatggggaaaccccatctctactaaaaatacaaaaattagccaggtgtggtggcgtgtgcctgtaatcccagctactcgggaggctgaggcacgagaatcacttgaacctggaaggaggaggttgcagtgagctaagatcgcaccattgcactccagcctgggcaactacgtcttaaaaaaaaaaaaaaaaaaaaaaaaaaaaaagccaggcgcggtggctcacgcctgtaatcccagcactttgggaggctgaggcgggcggatcacaaggtcaggagatcgagaccatcctggctaacacagtgaaaccccgtctctactaaaaatacaaaaaattagccgggcatggtggcaggcgcctgtagtcccagctacttgggaggctgaggcaagagaatggcgtgaacccgggaggcagagcttgcagtgagccgagatcacgccactgcactccagcctgggagacagagcaagactctgtctcaaaaacacaaaaacaaacaaacaaaatgggccaggcgtggtggctcacgcctgtaatcccagcactttgggaagccgaggtgggcggatcacgaggtcaggagatcgagaccatcctggctaacatggtgaaaccctgtctctactaaaaatacaaaaaaaaaaaaaaaaaattagctgggcgtggtggcgtagtcccagctacttgggaggctgaggcaggagaatggcgtgaacctgagaggcggagcttgcagtgagccgagatcgcgccaccgcactccagcctgggtgacagagtgagactccatctcaaaaaaaaaaaaagaaacccagttattgatgtgcggcttctgttctcagccaggaggcaggctcaatggtgtccccaaaccagtggttatggttctcaggaacaaaatactgatcaaggcaaacctccttctacaaactttcctcttcatttaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaagcagtgattatcctgtgtctcctttctcctgcttcaggtaaaaaaccttttataaaaatataaaaattagccgggcctggtggtgcatgcctgtagtctcaactacttgggaggctgaggcaggaaaatcacttgaacccagaaggttgcagtgaactatgattgcatcactgcactccagcctgggcaagagggagaccttgtctcaaaaaacataacaaaacacggccaggcacagtggctcacgcctgtaatcccagcactttgggaggctgaggtgggtggatcacgaggtcaggagatcgagaccatcctgactaacacagtgaaacccgtctctaataaaaatacaaaaaaattagccgggcatggtggcgggcacctgtagtcccagctacttgggaggctgaggcaggagaatggcgtgaacccgggaggcggagcttgcagtgagccgagatcgcaccactgcactccagcctggacgaaagagggagaccttgtctcaaaaaacataaccaaacacaaaaagccttaagggaatggcggccacagctcttgtttaataaaaagggaccctgagagcatcagggctgcggatgggatcttagttcccaagtccagccgtctttctgggatggcccagggactcttcccatgagaagaaattaatgcgacaagttaggaaatcagaagaaacatctagaacccaactgccgcccacctgttacttcacatcctgaagtcctgactgtacaacctcagggacaagtttctcttcctttttttgtaagagtctcgctctgtcgcccaggctggagtgcaatggcaccatcttgcctcactacaatctccacctcctgggttcaagcaattctcctgcctcagcctcctgagtagctgggattacaggcgtgcgccaccatgcccagctaatttcgtattttagtatttcgtattttagccaccgtgcccaaatgggccaggcatggtggctcacacctgtaatgccagcacttaggaggctgaggtgggaggatcacttgaggccaggagttcgagaccagtcccagcaatatagtgagacctcatttctacaaaaaatttaataattagctgggtatcgtggtacatgcctgtagtcccagctactcaggaggctgaggtaggaggatcacttgagcccaagaggttgaggctgcagtgagccaagattggcccactacactctagcctgggcgacagagtgagacccaatctcaaaaatcaaaacaaaacaaaaagggaaaaaaatagtatcttaccaaaaaaaaaaaaaaggcaattctacaaattagtacgaaattctttggggaattctaaagcaagcgcaaagagtatggtctagaacacaggaagagcatcacggtgttttcctgagggctgggctgcatctctccactctgccgccctctctgaaaggctcgccacctggccattctgagaaatcagtctaaataggaaagacagcaaaccctgccctcgccctggggaagtggcgccttcaggcttctagaagaaccgagatgagcttgtgggtctactatctaatcgccttttctacttgtaggctgccaaggcccgtagagacaggaagctggtttttctcgaggcttcacatggtcaccttattgccaacaaacactgcaaggctttattagctaaaatgtcaacccacacacagatcagagaccgccctcagcttctctgcgcctttccgccccgtcaccgcatcaatggggtggaggccaaactcaaacacttgcggggcacagacgtcccagaagcaaacatgcaagtcacgggagtttatttatttaatttttttccccagatggagactctgtcgcccaggctggagtgcaatggtgtgatcttggctcactgcaacctccacctcctgggttcaagcgattctcctgccacagcctcccgagtagctgggattacaggtgcccgccaccacacccagctaatttttatatttttagtaaagacagggtttccccatgt

SEQ ID NO: 17518 - DNA, 152822 bp, Human
cctaagcagctgggatcacaggtgcctgccaccacgcccggctaatttttgtgtttttagtagagacagggtttcaccatgttggccaggctgatcttgaatgcctgacctcaagtgatccacctgcctcggcctcccaaagtgttaggattacaggcatgagccaccgtgcctggcctaatttttgaaacagagtctcactctgtcacccaggctggagtgcagtggctgaatcttggctcactgcagcctccacctcctgggttccagtgattctcatgcgtcagccttctgagtagctgggattacaggcatgcaccaccacacccggctaatttttgtatttttagtgaccaggtttcgctgtgttggccatgctggtcttgaactcctgacctcaagcaatccacccaccttggcctcccaaagtgctgggattacaggcatgagccactgagcccagccaaaagcgtcttattaatgcagagctagccaagcagtaggactggagttattactcaaataaatctccccaagaactcagaggctagggtttttatggataatttggtgggcaagggcccagggaatgggtactgctgattggttggagatgaaatcacaggggtgtggcaaacggtccttatgcactgagtcggtctctgagtgggggccacaggatgggctgagtcatgagtcacacaggtccaggtgagtcagtcggttgcccgaatgcgaaagtctgaaaaacatctccaaagaccaatctcagtttccacaatagagatgctatctataggaggaagtggggaactcacaaatcttgtgatctctcgccacatgactcctgagcagtcagattataaaaacgatgcgtaggttttagcagcgtccaggcccctcccataatcctaatctcacggcctttcgttagttttacaaaggtggttttggtctcttgtataaaaagcaggttaggtttaaggagtaactattatcatccttgtttcaaagttgaactataaactaaattcctcccccggttagcttggcctatgccccggaatgagtgaagacagccagcgcgtgaggctggaagcaagatggagtcagccacgctaaacttctgtcactgtcctaatctttgcaaaggcagtttggccaggaggctgtggggagaccttgtgggttttgccaggacctgggagattctcgatctatgtttggctgtccttctaagccagaagctccctggggttggggcctgcctggggtgagtccctccctccctgccatgcccagtctagccaaggtctagttcagggatcagggcaccacgtgggggaaggactgtgttccttgtgctgaattaggatttatggctttggggccggatgggaggcgtgcgcactgattcagtaggagcgctgctgtggtgtgtgtgtggttggtgggagcggggcgggcggggggcgggggggctggttggggggacaggggtaaaagcctatcagagggaggtcccatcagacaagatgggaccaagagtccagttggctctgctgcgactttcggcctgtcactgccttcctgcacatctcaggggtgggagggggacaaaggctgtaagagtaagaggtacctggcccaagccttaggactagaacccgggccaggcgggagtgaccagccgggacactcagggcctccgcgcgttccagctgggtgaccttgaccctccaacttcagccccctgcgcccggctgctctcccagtggtggtggggagcggtgggggtagacgggggcgcgcccaggcttttctaatccggcgctggtgggggagaaccgagggcgccaccgcccctccccgcaggtccggggccgaggggtgcggcgcgctctccccaccgcggtgcccaggtccccgggacgcaggggcgctgggtagcaaggggggtgcgcaggggcgcggggcgcggggcgggctaatcccgtatgtaaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggtaggagaaacttttgcggggggcgggcaccgaggcccttctccccttctcccccacccccgcccccgatcccctccgcctccgggggggggggtccccgcccctccccctctcaaggtgttacaggagctggggccggcttttgggtgcccggggaggcacgtgactgggattataattcgggcccggggggaggggagggacggccgccccccacctgcccgggaggggccgggagctgggagctgtcaccccctccctccttgccaccggctcttctggaggtggggggcgtcccgggccggcgcccgcaggctgctgcagttggcgaatgaggtcagtcgcgctgcccgcggtggcgggcgccggggtgggagcagagggggctgggaaggccgcggtccccgcctttccccccctccaccttctcccggtctgggccagcccctggcccgcgcccccaactcccaggcggagtccagtccagccaggattgccccagcagggtggttcctgtagtggatcccccgccccggccccggggagggggctggcctgtgtggtggtggccgctgaatcccgggtggaggggactcagaaggtggcagtggggggaccacaaagggttcagaggagtaagttggggatactcggtctgtgggtggtctctgagttcctgcagatgggtggagaggacagaggaggggccacagggtgctgaacacccacccgccccatcctaagtaccctgggcatgatgggcttgacacctctcctgggctcctcacccctggccagcagccagggagtgagaccctgcctcgcctggcgtgggcccagggaagggggccgctgtgccgctgagagttcgttccaccctcctggcagtgctggagggggctggagctctggcgtctggcctagtgaccctacctcccaggaccaaggtcctgcggtgggagtctcctgtgtccccatcccagctgaagcgagggtgctgggacataggggtctcgctgcagggcctgtgaggggagcactgactcttggatggagaatgtgccaaggggtaccccgggatggccctgggcctggcgggtgggagtggagggcaggcccccgcagtttttggagaagtgggcatttgctggggtttctcttagaagaggagaggggtgtctagaagccaccctggcgcgccgctgccatggtcggcctctgtgtgtctggctgccccgtggccaggactgttgactccttggcactggcccggggccttgggacttggaaggtgccccaagcagctcatttatttcagcagtgtcattccagaggggaagggcaccagcatcgattatttattctaagcaggaggaggtggctggaggctggtggctgctggcagggaggggctaggtataaggtagttaggtggccgtcatgaaccgccctatttggggcccaggagggtgtgagatagactctgacctcttctgagcaggcatctgcggaccaagggacaggcttggccccaaggtgacagggtatcggaacccccatcctgcctctggggtgtgggaggctcaagtccacacctcgttcttccacagcctgttctgagggtgacctagaaattggcagttctaactcagagggtcccacaggaccccacagaggaaactaggaaggaagggttgaaactccgcagccactcagagcctgcactcttaaaatgttcgagaacttaaggccgatggttgtaaaactgggtcttgaagacagctttgtagggggcacgctaaacctacttaaaaggactgttctctcgatgttgggagaagggtcatttatttgcagtatgctaatcacaaataatttttatctgttcattgaaggcagcctcccaggagcccggctagccttctgatgaggtggtagtcgtcagcacttggtgtttggcaatagtctgagtggcagctgtaatctagggtcttggaggtagctgtttttgcagcctgcttgactccagaggccaggccatccacggtttggtgacagcttggttgttggacctggggtcttgtggatggtgggtgatggcttgggacattcacgtcctaagcatgaccttggaaccatagactgcagctcccagatgattctcattcagggtctagtctctgaccactcactgcttcctcagccgactcataaatcctgtagtctggccgggcgcagtggctcacgcctgtaatcccagcactttgggaggccgaggtgggtggatcacgaggtcaggagttcaagaccagcctggccaacatggtgaaaccccatctctactaaaaatacaaaaaattagccaggcgtggtggcaggcatctgtaatcccagctgctcgggaggctgaggcaggagaatcgcttgaacccgggaggtggaggttgcagtgagccaagaccgcaccactgtactccagcctgggcaacagagcaagactccatctaaaaaaaaaaaaagaaaaaattctgtagtcttgccgttttcctgaatggcctggcttcctcctacccctggcctctgcacacacagttcctcttctctcgaaggttcttcttggcctttcccctgaggaggctggggggcttcctttattagccctgcctggctagggtagggggtcaggattatagaatttgcctcttttcctctccttcaggacttggcttggctgtggtatctttgggctgaagacttcctcgtcctcagggctggccatggttccacctttatatccccatgatgtcctctcttttttttctttttttctttttttgagacagtcttgctctgtgcccaggctggggtgcagtagtgtgatcacagctcactgcagcctcgaactcctggactcaagccaccctcccaccccagcctcacaagtagctgggaccgcagacaagggccactacacctggttaattttttattgtttgtagagatggggtcttgctatgttgcccaggctggtttcgaactcctgggcatgaggagtcctcccaccttggcctctcaaagtgctgggatgacaggagtgaaccaccgcgcctagccaacatcctttccttcctttgtcccaacattgatcttactcagatgtttacatctctctccccaattgcactagggacaggaagggatggaggcttgctcctcaaatacttgttaaatggctacatgtttgaatgaatgaatgaatgaaatcctgctcttgagccttgacctaaatggctaagcagactctctcctatttttcttaaatgctcatctctggggcaagttccccaccctggtaggagtcccagggtctctccctgaacttcctggggccccctctctccccactaccccagcctgtgtcttctcccaaccttaaccctgggggctttgctccccaatgtcatcctctctgtatctctcagttctctgactctcgccgtttgtaagtatctctctctcagatgcgtggcagccagggtcacagccaggttctttgggacaagccaggggtgtatgcccagctccatggggcctgcagaggcttcaggggacacccatggaagaagacctgcagggccaatttataaacagaggagcagagcaggacccagggcttggaatccatgctgagttacgtttttgtttttttttttttttttttgagagggagtctcactttgtcgcccaggctggcatgcagtggcgccatctcggctcactgcaacctctgcctcctgggttcaagcgattctcctgcctcaagtagccgggattacaggcatgctctaccacgcccggctaatttttgtatttttagtagagatggggtttcatcatgttggccagtctggtctagaactcctgacctcaagtgatctgcccgcctctgcctcccaaagtgctgggattgcaggcatgagacactgcgcccggtcctgagttcagttttgattggggggcttccgggataatatggggccgctaggacagggacccttagtgtgactggaagggaatttcctgaaggaattcatagcagaggtggagtggtgggaaggatggtttctgggggagaaggagatgcgtgaacctggccagaagacagtgtgttgtgacagatgattgctggtgagggggtaacagtctccaaggtgtagatgttgggggctccagatacggcaggaggggcctggcctctcggaatcccctcagccccatctcatagaaacatgtgctttctacccaggctccatactccggaagggaggcaggaccctgtcactttcttggcctactttggaagttctcagtcaggtatctccaggtgtggcagaggggctttggcctgtagggggtgtggtaatgtgggttttggaggcagaaagcttttcaggaaagccccctggtccatcacccccctttctttttttttttttgagatggagtcttgctttgttgcccacgctggagtgcagtggcacgatcccaactcactgcaacttccacctcccgggttcaagtgattctcgtgcctcagcctcccgagtagctgggattacagatgtacaccaccacacctggctaatttttgtatttttagtagagacggggtttcaccatgttcgccaggctggtcttgaacccctgacctcaagtgattggccctccttggcctcccaaagtgctgggattacaggttgtgagcccccaggcccggcctcatcatcacttcttcacccaccctattttggtagctctctctccactcgtcctgtggaactgatccattctcggtcccattcccttctctctgggccaatctgcacctaggtttgtggcttcatgagtatggagggtcgtgcagaaaggggccaggtctgtaggaacctgggttcatgccctggaaatttgcccatttaagataagttagggccgggtgcggtggctcatgcctgtaatccccagcactttgcacttcgggagaccgaggcgggcggatcacctgaggtcaggagtttgactagcctggccaacacggtgaaaccccatctctactaaaaatacaaaaattagccaggcgtagtggcgggcgcctgtaatcccaactgctcgggaggctgaggcaagagaattgcttgaacctaagaggtgaaggttgccgtgagctgagatcgtaccattgcactccagcctgggcgacaagagtgaaactctgtctcaaaaaaaaaaagataagataggtgtcctgaataagataggtgaaatgggtgaggatgtactttatcttacacggtcttagggagtgtctcaggcggtgaacagaactctctcgcccctgagctggggcctggctgacccagagctatttgtgtgcccacctgtcaccctctttcaggaccacctgcttcaggttgccagatttagcaaataaaaataaggatgcccagctaaaattggatttcagacaagcaaggactaatgcaatatttgggatgaacttctagctaaaagttacctgttgttgatctgtagttcagactgaactggaggtcttgcattttatctgccaaccctacaactgctgcctctggggcggtgagatggatggggtttggggaggggccagaggtgtgtgtggctgaccctggagttgggatcagggctcagtggaggccccggggatgatctggagcgagtttgaatcgagtggagctgattcactgaatcttggcttttttttttttaatttgtattgaaatgaggtctcactctgtcacccaggctggagtgcagtggcacaatctcggctcactgcagcttctccctccccggctcaagcgatccttctggctcagtctcccaagtaggtgggaccacaggcacacgccaccgtgcccggctaattttttgtatttttggtggagatggggtttcgccatgttgcccagttcctgagttcaagtgatctcaaagtgctggaattacagaagtgagccactgtacccagccagcagggtcctttttcatttttattttattctattttttgagacagtgtctcactctgtttcccaggctggagtgcagtggcgtgatcctacctcactgcaacctccaactcctgggctcaatgtgatcctcccacctcagcctctgcacctagctaattaaaaaaaaatttttttttttttagagatggggtcttgcgatgttgcccaggctggtctcaagctcctggcctcaagcgatcctcccacctcagcttcccaaagtgctgggattacaggcagtatccttctaatgtccttggtcaggcctcctccagcctgtggctcgagggtctagatctcctactggcctgggtggcatggagggtgtagtctaggtggcctgaggggtgcccagggatccccagtttgggaagtccttgtcttcagggatttctggccaatgtggtccgtatatttagagatgctgggaggagggggtgggaaattgctggaaacaccctattatacaccaagtaagattttcatgtaggattggcaaggcctgagtgctgggaaagtgtctgcaatggctacctttcaaagctgggagaccccgccacgggggcggttgtggacttgaggggctgaccccacagcacggaggctgctgggaattcctgcacctttgccatgctgccacctgaggcaggttcccagcacctgagctgcagcctctggagtgggggaaatggggggaaagtaaggggccggggtcatggggtccacgtccaccttccgcccgcctgggcagttttcttggatgtaaaagggagatggctctccccaacctgcctgggtcccagtgtggtgctgtagtccaagggacttggtgtgaccccgtggggatgccacagcatgggtgtgtgggacccccgggggcaggtctgtggtggagacagggtgggagggcctggcttgagggcttgcggtcctgggcacttgaggatgcagaagaggctgcatggttggggagggtaggtaagcagggggcagcttagccctttcccctcctgttccctgtgacagaggggagaccctccaggctgtttgtgtcttagatggttggccgagggtaggcctctttgctggctggggtctagcagggtctcaaggtgcattttctggctactggcagaaccaccatcaaagcaagtccgtatcttttcgtctatccatctgttgttacgccagccagtgaggaccttgcagaggcgtcaggcctgagggagtctcattaggtcctggtccccagcccccggctggcacatgagaagggcccactttatattatattttatttatttatttaagatggagtctcactctgtcacccaggctggagtgcagtggcgcgatctcggctcgctgcaacctctgcctcccgggttcaagcaattctcttgcctcagcctcctgagtagctgggattatgggtgcatgccacctcgcccagccaatttttgtatttttagtagagatggggttttgccatcttagccaggctggttttgaactcctgatctcaagtgatctgtccaccttgacttcccggagtgctgggattacaggcgtgagccactgtgtccggccccactttatattttattaaaaatatcgttgaggagtgaaggctatgctataccaggaacttgcctggctcacacccttatgtcgtccaacccccgtcaagacatagaacagcgctttgggaggctgaggcgggaggatggcttgaggccaggagtttgagactagcctagacaacatagtgaaacctccatctctacaagaagtacaaaaattagccaggcgaggtggctcatgcctgtagccccagctactcaggaggctgcggcgggaggatcacttgaggccaagaatttgagaccagcctgggcaacatagcaagaccccgtctcttaaaaaaaaaattagccgggtgtggtgatgtgtgcctgtagccccagctacttgggaggctaaggcaggaggattgcttgaccccaggagttagaacaatcctgtaacccctaaaagtttttgaagcccgtttgttcatccttgtctcttgtcctgaccccagcaaccactgatctgtcttctgtatatggttttccatttgtacaatgtcacataaatggaatcctacagtccacagcctctgaatctggcttcacacagcataatgcatttacggcattgctgggtacacgggtagctggtcccttctggtccctgagtagtgttccatggtgtggatatgccacatacctctagccactctcctctctagggaaatctagcaaaccggcttggccggccctgcatcagctcgggaccccccagaagaaggtggttcctctttctcattttcacaaaggcaccatctggctggcggggggcctgtggcctgcaccccatcactacccaccccccacatcaagagctgaccccaagccgggggagctgctcatctccgccctcagagctggaatttcatcttctgtttctggtgactcatactgtgagccccgcgatgaaattacacctgcctgccgctgccctccgggcctctggccccatgcgatcctcccgccgccatccaggtgggctctggagtaattgaggctatggggccaggacagctggaggttgagggcggtgccagggaggggagctgtctgtgccctggggtgtcttgcccatcatcttatgtatccccaccctgtgggagtctggggttcctggtggtgcgtctctggtcttcactcctgcagctgttttgcttggggtagaagtttcatgtttgcctgaaataagagcaggacttctgagggtagggaaggaaggtggtgaagccactgttgcaggcaggagcaggagttaggatcaaacggaacagggctggccgagtgatgtcacatctctgggctttggtttgttcatctgttcttattattattttgagacagggtctcgttctgtcacccaggctggagtgcagtggtgcaatcatagcttgctgcagtcttgaactcctaggctcaagtgattctcccacttcagcctcctaagtagctgggcttggaggcacttgccactacacccagctaatttttttattttgtagagatgggggtctcgccatgtcgcccaggctggtcttgaactcctgtgttcaagtgatcccgcaacctcagcttcccaagtgctgggattagaggggtgagccactgcgtcctgcctgttcatctttaagtgggagaacagaacactaggtttgcagggctgtgagactcagctgagggtaatgtgagtgtgtggattaccacagagccctggagggccccaggggccaccaaggagcgggtggtggggacatgtgaggctcaagcctcctgtgcccctttgggccagagtaggaccactgttgttttttgtttttttttttttgagacagagtctcactctgtcgcccaggctggagtgcagtggcgtgatcacggctcactacaacctccgcctcccgggttcagttgattctcctgcctcagcttctcgagtagctgggatcacaggtgcgtgccaccacacccgactaatttttgtatttttagtagaggcggagtttcaccatgttgtccaggctggtttcgaactcctgacctcaaatgatccacccatcttggcctcccagagtgctggaattacaggtgtgagccaccgcgccctgccctaggaccacttttaccagagttacctgttagagctctaaatacagttctggttgctaaatgtttggaatccactgctgcctgaggtcagccctgtgtgaacagtggctattctggtgaatgtttttgtggctagagcctagattatggtggtttacggactccagcctgtcacttgcctgaggctgagcctcagtttgaccctctagaaaatggaaccacagcaagtacctccacaggtttgccaggtgggcatgaatgaagcaggggagcccagcaagagtttgtcagtttcccattggcaaatccatgagtttcccagggctctcggcttcctaaggagatggagcttcctgggtgatcacatgtcttgcgtgggtgtcttgagagatttggggggtttttactttgtttttgttgttgttatttgtttgtttttgaaacagagtctccttctgtcacccaggctggagtgtagtggtgtgatcacggctcatggcagcccccctcctcctgggttcaggcacttctcccgcctcagcctcccaaatagctgggattacaggcacctgccaccacacccggctaatttttgtgtttttagtagagacggggtttcgccatgttggccaggctggtctcgaacccctgacctcgagtgatccacctgcctcagcctcccaaagtgctgggattacagacatgagcacaagccaccgcgcccagctggtttttactttgttatttaatttgttatttgtgaaatcgttgtggcccctctctaatgaaggttgccccaagtacctttcccctgtaccccacccttgcctcccacccctaccgggttccccaaagtcctcaaaggctggaccctggggccagcactcggtgggtagcctggaaagaggttagccctgtgcaggaaggaaggcccttgggtgctcctgggtggctccttgcagcagacaagacccaccgcccacccacctggctccagggtggtcctggcagctccaaggggtcttgtgactctctcagtctgatgtttctctcatgtttatccaggagctggtttttcaggcatggccgcttcttgcagtgaggccaggtggggagaggcagggctttggggaaggaggtggttacctctgctcccagggcacaccctggctgccagctgtgggtgcagccctctgggcaggtgggcaaaccacatcctccctctttgatcctggtccacctccccacctgccccgggccaccagctccctgagatattctcttctcagcatatccaaaggagagatgctcttggtggccctgggtcagaggccagggctccctcacttcacagcagggtgcagtggaaccatcagggtctttgaagccagacacacctaggttcaaatcccagcctgactgctgagctgctgtgtgaccacaggcaagtgactgtacctctctgagcctcatctgaaaaaacaaggatagttttcttatatagtattgccaggttcttgggaaaatcagtgtattcagttgcggggagctagctgccatctcagtgaagaacactttgtcagcttgtcacgtgatgaccccagaagctggccctgtgggagccccactcccccagacagtgaaccttggaccccatcattccaagatctgttcttattttctgcctgtctgggacacaccccctctgtccgtggggtgtggggtgtggggtgtggcatgcctcaatttatttattttttttgagacagagtcttcctctgttgcccaggctggagtgcagtggcaggatctcggctcactgcaacctctacctcctgggttcaagtgagtctcctgcctcagcctcccgagtagctgggatcacgggcgcccgccaccatgcctggctaattttttgtatttttagtagagacagggtttcaccatgttgcccaggctggtcttgaactcctggcctcaagtgatccacccgccttggcctcccaatgtgttgggattataggcatgagccactgcacccggacagcatgcctcggtttctgcttctgcaaactgggaaaacctcaaaggtagaactggttggtccccttggcctgccgaccccttagcccctcaaggtcacagtcagccatcccgcttgttagaggccaggccctgttctggggcgggggatacctgtggctgcttaggggacgggagacaatgccactcccaggtgtgtttgatggcagcctgcagaagtggctttctgcatggccctggaggacggtgatttggacagaagcgtagggccagagacaggacgtgacggtggggctgctgcattggctccaggtaaagatctgtatctgatggcctcactcccaggcagctcaggggttcccgtggctcctggaaaagctacagactaggcatggccaggccctgcctgtgtctctctgtgccagccacgatgagcctcatcgtttctaaaacgtactgtgctccgtctcgcttcctggaacgctgctgcctctcccctagagcgtgcgtaatgctccccggctgtgtccctgggctgatttctcgttgcaggtcttagctgggttgtcactcctctctgcaaagcttccctgacctcatctccctctccaggtcacgttaggtgcctcttgtctgtgtccccagccacagcccgcatcacaaacaagactataattgccctcgtgcttgtctgtcaccttcacagacagagtgtgacttccagtgggtcacggccccatcatcatgttgtcctccgcatccctgaccttagcaccctgcctgttgcggagtgggcatcctgtgcaaccttgtcaagtgaattagaagcaagctcggggtgggggcccatgaagggtgggggcctcctccaccctttttctttctttttttttttttttggagacagggtctcgctccattgcccaggctggagtgcagtggcatgatctcggctcactgcaacctccgcctcatgggttaaagcaattctgccttagccctccccagtagctgggaccacatgcacctgccaacacacccggctagtttttgtatttttagtagagatggggtttcatcatgttggccaggctggtctcaaactcctgacctcaagtgatccacccgcctcagcctcccaaaatgctgggattacaggggtgagcccccatgcccggcccctctccatccttcaatcccagctctcgttggcgctcctctacccatcccaggagctgcttctgccggcctggctgtggcgttcagaggcatctggagggcagtggcgatggcagtgggggcagcttgtctctctgagccgagtacagcccaatttggagcgtttccctccaggaaaggcagctgatgtgtgcagacagcacaagtgtggagtgccagaacagttaatcctctgggctatttatttatttatttattttgttttgttgttgagatagagtcttgctctgtcgcccaggctggagtgcagtggcgtgatcttggctcactgcaacctccacctcccaggttcaagcgatttgcctgcctcagcttcccgagtagctgggattacaggcatgcactaccacacctagctaatttttgtattttattttgtatttaattttttatttttattttttgagtcagaatctcgctctgtcacccaggctggagtgcagtggtttgatctcgactcactgcaacctctgactcctggtttcaagcgattctcctgcctcagtctcctgagtagctgggattacaggcgcccgccactgctcccggctaatttttgtatttttagtagagacggggtttcaccatgttggaccagactggtcttgaactcctgtcctcaggtgatccgcctctgggctatttagacacacatgcttgtgtgcatgcatgggtgtgtatatgcacatgtatgtgacattcctgaggccaccggcggtgacgaggcctgattacttgacgttctgctgaatcctgactactagcctggagctttactccccagtgtacacagctccccgagtcctggttagtggtaaagaggggactgtcccctgtcatttagggctgcatttggctacaggtaattaaacacccaactgtaaatatagcaaatatctaaatattaagccaggtcaggtgcagcagctcaggcatgtaattttagcacttcggaaggccgagatgggcagattgcttgagcttaggagtttgagaccggcctgggcaacgtagtgagaccctgttctctacaaaacataaaaataattaaaaaaaaaaaaaaaacccagccaggccgcagtggctcactcctgtaatcccagcactttgggaggctgagacgcgcagatcacaaggtcaggagttcaagaccagcctggccaacatggtgaaaccccatctctactaaaaatacaaaaaattagccgggcgtggtggcacgtgcctgtaatcccagctacttgggaggctgagacaggagaatcacttgaacctcggaggcagaggttgcagtgagccaagactgtgctactgcactccagcctggcgacagagcagcgagactccatctccaaaaaaaaaaaaaactgtgtgtgtgtgtgtgtgtgtgtgtgtgtgtgtgtgtgtgtgtgtgtagcctggcagactttagatattaaacctgacagttaaacaaaaaggagtttatttattcctcataagaaaatatggaagggccgggcgcggtggctcacgcctgtaatcccagcactttgggaggccaaggcaggcagatcatgaggtcaggagagcgagaccatcctggctaacatggtgaaaccccgtctctactaaaaatacaaaaaaattagccgggcgtgatggtgggcgcctgtagtcccagctactcgggaggctgaggcaggagaatgacgtgaacccgggaggtggagcttgcagtgaaccgagatcgagccactgcactccagcctggacgacagagcgagactccatctcaaaaaaaaaaaaatatggaaggtatttggaggataggatgggtacttatgagtaggtatttggaggctgggatgggtacctgtgagtaggtatttggaggctggggtaggagcgtggtgatgcttttcagggttcagtgatgtctccagagacttgattctgttcttctctaccatgttggattttctttttttttgtaagtttattttaaaactattcctttaaagtgtataattcagtgttttttttaaaatatattcacagagttgtgcagtattcatcactgtctaatttcagagcatttttatcatcctaagaatctccccccattaagcagtcagccctcattccctcctcccccatcccctggcaaccactaatttactttccatctctgtagatttgcctattctgggcgtttcttgtagatggaatcatgtaatatgtggtctttcgagtctggccttttctcagtgagtataatgtgttcaaggttcatccacattgtagcgtgagtcaatgtgcctttctttttatggccaaataatattccatttaatggatagatcatatttatctgttcatcagttatggacatatggggtgtttctactttttattattttattttattttgagacagggtcttgctctgtcacccaggctggagtgctttggtgggatcatggctcactgcagcctcaaactcctgggttcaagggatcctcctgcctcagcctcccaagtagctgggactgcaggcaccaagccaccacccctgactaatttttaaatatttttttggtagagacggcatatgtattagcaaggccctgtctctaccaaaaaagataaaaattatcatattctttattatgatatcattataccataaaattcaccattttatttatttagtgtttttagagatagggttggccaggctctgttggccaggctggagtgcagcggtgcagtcttggctcactgcaacctccatttcccaggctccagctattctcctgcctcagcctcccgagtagctgggactacaggtgtatgccaccatgcctggctaatttttgtatctcttgtagctgtgttgcccaggctggtcttgaacccctggactcaaacaatccacccacttcagcctctcaaagtgctgagatagataagcataagccaccacacacggccaaattcaccattttaaaatacgctatgcaatatttttagtatcatcatgaagttgtgtgaccatcgccaccatctaagtccgttcattttcgtcactctgaaaagaagcctgttacctcattagcagtctctccattccccagcaccccccactccagcccctggtaattgctaatggttgtctctctgggtttttgatagcttatttataacattcagccttcacctaccatatgactaggtatttacctatgagaaatgaaagctcaaattcacataaaaacctaaagaggaatatgtatagtggctttattcataattgccccaaactggaaacaattcagatgtcagactgcccagtgaataaacaaactggaacatccatactgtggaatattagttagcagtgaaaaaggatgaatgatggataccacaccaccacggggaaacctcacgagcattgtgctaagggaaggaagcagactggaaaggccgcttccaacctagttctgttcatatgtggggttttttttttcgagacggagccttgctctcttgcccaggctggagtgcaatggcgtgatctcggctcactgcaacctccgcctccctggttcaagcaattctcctgcttcagcctcccaagtagctgggacaacaggcgtgccaccacacctggttaattttttttgtatttttagtagagatgggatttcgccatgctggccaggctggtcttaaactcctgacctcaggtgatctgcccgcctcagcctcccaaagtgctgggattacaggcgtgagccaccgtgcccggcctctggttctagtcatatgatgttctggaaaatgcaggattagggacagggtttgcctgggagtgggagagtttttggggagatggaactgaaatgcgttttgattacggtggcagtcacctgactgtttgcatttgtgaaaactcatagaaatatggccagaggctcatgcctgtaatcccagcactttggaagactgaggcaggaggatcgcttgaggtcaggaatctgagaccagcttagacagccaaaaaaattagccgggtgtggtggcacacagctgtagttccagctactcaagaggctgagccgggagaattgcttgaggctgggagttcaagcctgcggtgagctataattgtgccactgcactctagcctgggtgacagagcgagaccccatctctacaaaaagatttaaaaattagccaggcaccgtggcttgcacttgtattcccagctactcaggaggctgaggtgggagggtggtttgagcccagaagtttgagaccaaactatgtttactgggtaacatagcaagacccctgtctctatctttttgaaatatttaaaaaaaaaaaaaaaaacaaaaaaaaaaacaaaaaaaacggccgggtgcggtggctgacgtctgtaatcccaacactttgggaggccaaggcgggcagatcatgaggtcaggagattgagaccatcctggccaatgtggtgaaactctgtctctactaaaattacaaaaattagccaggcatggtggtgggtgcctgtaatcccagctgctcaggaggctgaggcaggagaattgcttgaatccgggaggcggagtctgcagtgagccgagatggcgccactgctctccagcctaggcgacagaatgagactctgtctcaacaacaaacaaacaaacaaacaaaacagaacactcatagaactgtatgtcagaaagaatgaattttattgcatgtatattacactccaggtaaaaaggggcctggcctggaactggcctttccagagtaactccacttggagttcaccatctcatttgttctagttggtgccaccatcccttctaccaatggtgagttttggtctgtcaagttggccaacctgagttgtgcatagggccggggccagatgctgcagtggggcccccctctttccccttccttggacatcctaacccctcttggggtttcccgagcttcttggatggagggagccatagaatgttagaactggagggaacctcagaatatactggcctcttctctttttcagatggggaaactgaggcccagggctgggaagacacttgactaaggttctagagttacgaggatcaagatctaaaaccacatctggccgggcacagtggctcacgcctgtaatcccagcactttgggaggccgaggcaggaggatcacttgaggtcgggagttcgagagcagcctgggcaacgtggtgaaaccccatctctattaaaaatacaaaaaaaaatttagccaggcatggcggggggtgcctgtaatcccagctacttgtgaggctgagacatgagaactgcttcaacccgggaggcggagattgcagtgagccgagatcgcaccactgccctccagcctgggcaacaagagcgaaactctgcctcagtaaataaataaataaataatcaatcaatcaatccacatccatgactcttggtctgggcctccttgccctcctgcagatgcctctggagcctcccttgtctcctgctcctggttcgggaggctggacaggcccaagctggccccacagctggtgggaggctttgctgcagcgtaccctggacagggcagagttgggtagggaagggagagtggtcagagcatctgcaacaccgcagcggaggagaggagagagtgcggtgaaggctggcaagtggttgattatggggagctgtgagaatggttgatggccccccagggacagacaggagaacagagcactggtttctgctctttggagctcctgacatcacctggagtaacccccaagcctcatgatgtgttcaggtagatcccagcaaatgcagaattggggtcagcctggttgggatgacaaccagaagagcttcctaagggaaggaccccaggagaacctggtgggggcaggggagagatcttggccggtgtcccttcccaagggaggaacccagtctcagggacgtagtcccgccccctggtttattctggtattgctgtgtccaccagcctggggctgccaagagctctggaaacttctgtgaggttgggcgtggaggttgcatggtggcagctcagggcttttttttttttttgagagagggtcttcctctgtcgcccaagctggagtacagtggaacagtcatagctcactgcagcctcaaactcttggcttcaagtaatcctctcactttggcctcccaaaatgttgggattacaggcatgagccactgcgcacggctttggggattcttattggctgtgaaccccgtgattcattgctcccattttcttggtttagtgcccactcctgcagatgaggggaggcagactgaacctcctggagtctggggtctgggtggtgagcctgcccacttccaggaactgtccataacccacccaccatcctggacagcccgcaaccttggtagcacaggacacttgcccactgccctatttttggctcagaaaacgatatcttcagctgggtgcagtggctcacgccgagctgggcggatcacctgaggtcaggagttcgagaccagcctgaccaacttgatgaaaccccgtctgtactaaaaatacaaaaattaaggctgggcgcggtggctcacacctgtaatcccagcactttgggaggccgaggcgggtggatcacctgaggtcaggagttcgagaccaggctggccaacgtggcgaaaccccatctctactaaaaatacaaaaaaaaaaaacaaaaaaattaactgggcatgctgatgggcacctgtaatcctatctatttgggaggctgaggcaggagaattgcttgaacccgggaggtgagttcaaccactgagccgaggtcgtgccactgcactccagcctgggcaatgaagtgagactctgtctcaaaagaaaacgatattttcttacctatggggtcccctctggttttcaggactcacaatgcctgcaggaagcccacctcaggtctcactgtagcccccctggtggggaaacccctctgcctctagcagggcaggcagaaaagatgtgtttggaataaataatgagcctatgggagagccactcccatcttggtgcaaatatttgtgtgtgaatcactcatctggacagtgggactggattgtggttgacagtgagccatgcctggggggctgtgcaggggacattgtaggggtgcagggccatgtttactccagatcccagcagacttcactttgaagctggcccctgactctttgtgctgtgtgaccttgggcgagttgctcagcctttctgagcctctacatcctcatctgtaaaatggggagagtactgttgtgtttgtagtgttgctgaggtgggttgcgagatgcccatcagcagcacagctcctgccactgatggctgcaacgcaactgtgatttctcagaaatgtcatcccaggcccagctagccctgaggcccaggtggggttttgagggaaagggatctggctgggagcagtggctcgggcctgtaatcccaacactttgggaggttgaggcgggaagactgcttgagtccaggagtttgagaccagccttggcaacatagcaaaactccatctctacaaaaaaaataaaataaaataaaattagccaggtatggtggtgtgtgcctgtagtcccagatactcaggaaggatttgggacgatcacttgaggctaagagtttgagaccagccagggcaacatagcaagactccatctctacaaaaaataaaataagtagctggacacgatggcacacaccttaagtcccagctacttgggagtctgaggcagaaggatcacttgaacccaggagttggaggctgcagtgagctatgatcacgccattgcgatcataggctgggtgacagagcaagagaccctgtctcttaaaaaaagaaagaaagaaaagaaaaatgatactcaacccttgtccattgggcctgactctcacctcccacctctactttgtgaggaagggacagggtgttattatgtcttcattggagggtactggggcccagagaggggaaggaagttctccagcatcacacagccactcgaggctgagcctccactagacccagacctcctggggcctggcctcatgtgcgttcctgagactacagggttttggtgaggggctgccctgccatctgttgctgtaccctagggaggggagggtgtggcccgggctggactcctccaagttgctctgtccctgggttttggaaggggaggggccgcttcatgaaattgcaccacctggccaaggctcgggcaagcccaggttggatgcaggtggccaggcttttctgacaggtgagggcagaagtggaagtaatgcaggtgttcagagaaagggccggatgtgtgtgcatgcgcacacccagctacaaaacaaggggtgccattcctcagggaccaggccattaacgtgagccacccgtctgatgcgtagtcacccgccggggtgacgggggacttcctggactctgcggcctgatcctgcctgtctggtgacattcctgatctggagtacacattgggcctgcagtgggtgctttggtgtttgtggaatgaatgaatgggctggcggcacccactgatgagcatctgccaagatgtctgtgtgcgtggaggtggcaggtgtggtccaggtacccgataacggatagacacctgtacaaaacagcctcttctccaatgcctggtggtggtgagggatgggggtgtggctattttgcagttggatggtgtggacacttacaagtcaactaatcccgatgctctggactcctgtctgtaaaatgggatggcgtaggtgtgggctggtggtgcctggtgggtcccgcccaagccccagagaaggggctgatggcagctagttgttatttttattactaaatcatggctcagcccagcctggcctggcaagcccaagttcctggtggatgtctgcctcttccacgcccgcttggaagccttctgaacctccttttttttttttttttttttttcttttgagacggagtctcactctgtcgcccaggctggagtgcagcggtgcgatctcggctcactgcaacctctgcctcccgggttcaagcgattctcctgcctcagcctcccaagtagctgggatacaggtgcacgccaccaggctcggctaatttttttatttttagtagagatggggtttcactgtgttggccaggctgatctcaaactcctgaccttaagtgatccgcctgcctctgaacctcccagatttcatcggttccccaccgtactctcctgcctctagcctttgcccaagctgaccttggccccagtcttccccactgaacagccacccagcctttggggccagtgctcctgggccgatgccagccatccatcctggatgtgcccacgcctggtcactccccacatgaggagctgatgatctttggtcaccgtttataaactttagcttctctttcctcacccaggagctccagggcaaggagtgggcctgattcacccccgttcagggactgggtcctaacaggtgtggtgaaaatgagcacttagtcagcgtcccacagcatctaaaagacgggaacaagggctgaggatgtgggtaggcccaagactggaaatagggaagcctctggaatggggactagaagatgaaagggctctggaagatggggcatccaagtgtttaaagcaagaacggggctgggcgtggtggatcgcgcctgtaatcccagcactttgggaggctgaggagggaggatcacttgaggccaggagtttgagaccagcctggccaacatggtgaaaccccatctctactaaaaatacaaaaattagccacacatgccagtgcgcacctgtaatccccgctactcaagaggctgagtcaggagaatcacttgaacctgagagacagaggttgcagtgagctaagatcgcaccagtgcactccagcctgggcgacagttttttttttgtgtccaaaaaaaaaaagaggtgcggggagggccagagggcatttggggtgggacggggcagggcagggctgggtgactggaatggggtgactataatgaatgctttggagtaggtcagggcaggtggggaggccagatgccaggggagggagggggcatggggatccttccatctggggccaaggatggcaaggccctcagacaacttctagcccaggttctccattgacagatggagaaactgaggcccagggaggggcagtgctagtgctgaggttttacatagcaggtgggctgttccccagcccactgcagggcatagcctgccctgggacacctgtcctcacccgttggctcagtggttgcaggggcatgggtgggtagaggtcggggagtgagccggctcaggcgggcagggctgggggccccgtgagccagcgccccaggattagatcacccacgagtaatgggcttttttccgtccagccttttcccgacaagaaaaggcctgatgttcctcatccgtgttgttctgagaaggcatgtttatgtctggcaagcgaagggttcttgggagacaggatcccagggcccccctgcactgcctggccccaggggttggcaccgccccagagctggtttcctcccactgtctcctgacacccagcccccacgcttttcagatgcctgcctgagaacaaataaatacttctgcaccatgcacatgagctcagataagcctccggggctcagccagaactgggggcaccaaatgcccgggttccctgacccctagctgggtgccaagcctgcatttcccacccagcactccccaaccgccccttgcgtggagggacagagatatactgtgagcaacacgggacctgatgtcaggggtggacagcagctcggcgggtgatgtcagcttgagcaatcgtccccgtcatcactgctgttaagtgagcgggcacttggtgtccccaggcccagcgccaggccctgttcacacattctcacgtggggctctcacagagctgagagcagtagaattaccatcacccttttgctcagtggggagaggaaagtttgagcattgtgtgtgtgtgtgtgtgtttagagacagggtcttgctctgtcacccaggctggagtgcagtggtgcgatcatagctcactgtagcctagaactcttgggctcaagcgagcctcccacctcatcctcctgagtagctgggattacaggcacatgccaccacgcccaactaatttttatgcttttagtagagatggggtttcaccatgttggccaggctggtctcaaactcctggcctcaagtgaaccacccacctcagcctcccaaagtgctgggattataggcatgagccaccagccccacctttttttttgagatagggtcttgctgtattgtccaggctggagtgcagtagcgtgatcatggctcactgcaacctctgcctcctgggcccaagcaaccctcccaccccagcctctggagtagctgggactacaggcacatgctatcacactaggctaattaaaaaaaaaaaaattatagagatggggtctcactatgttgcccaggctggtctcaaactcctgggatcagaaacctggtggtcattccaggtgcctcccttgggaccccccgtcgccagctcctggtcccaaagctctgccccgtcctccatcccctgctgctgtctgcttcatgcctggctgtctctggcctgggctgtcgcagagacttggcaactcctggctccccaactccaagcatgacccgacagttcctccgccgtagcttcctgggatccccctcactgcccacgtctcacccccgccccacaccctgcagcgaggctgaccttccgaggtccttggcctcaccccaatggccacgctggtctctgcccaccacttcctgccctgccctgcacactccagccatgcagagctggatttgttccccacccacccacccactcccacagcctctggccccgctcaggcccgaccaggacacgtgggcggcccaggctggcggttgggtttcctgggcagccagtaatttggcactccttcaaacaggtctttatttattcagcatttatttctaggggaggtgggtgctgcggtggggcagggaaggcgcctcccttgtagaagagcagggcctgggcacagtgcctgtctcccctcctcacctgcaaacgccaactcccctgggagggtcccggcagctcaggtgtcacctcctccaggaagccccaccctgactgcctcacccgccgtcctgggcttcttccatgccacttatttttatctttcactgaagcataatttacttccagtaaagtacatgagtacatgaatcttttttttttttttttttttttggagacagagtcctgctctgtcatctaggctggagtggcgtggtcttggctcattgcaacgtccccatcctgggttcaaacaattctcctgtctcagcctcctgagtggcttataggcgcgtccaccatgcccagctaatttttgtatttttagtagagacggggttttgccatgttggccaggctggtctcaaactcctgacctcaagtgatctgcccgcctcggcctccctaagtgctgggattacagtcgtgagccatcgcacccagcccaagtacataaatcttaagcatcccgtgtgatgaattttcccccgacttgtatactcatgtaaccatcactcagctcaaatccttgcactgtgttttaatcttttttttttttcccagtagtctatttttttggtcattttccctgccagcctgggaatccttcaagggcaggagcacctgctgttgggccctgtgcggtgtgggacacagtgtgagagagtattggtgcctgtgagctggtggctgtgtccccacccctgtgattgtccccacgtgtgtgtgtgacggaggctgtggccgtgggaacatgtggatctgtgagcctggccaggggccccagtgcaggggcaagcgccccctcctccactggaagagagccttgtccgatcccccagccaagggcctttgcagggagccgtggccctgctggagagtccccgccggctgacagcccggagattagtctccaaggccacaacgccagttgccataggcacgcaggcccgcgtcaggactgcgatttctcatcctggtcacgcaggcaggcggccgcccctgcccgcctgccaggatccaggctcaggctttaaataacaagggtggaaacctgaaccgcggagccgtctgcccggcggatcctggcctcccctcctggtagagcaggcatggggcggcctggaccccgcatactgccggcggcggcggagtccctccgtgcccgccccgggggacgggagagaaatggagaaacctgagtttgggggctctctttgagtgctcctagtacctgatgcacagcccgagctgagaggagacagccccttttcctaaatcccgtcctccacgtggaggaaggacgccctaccttccagaagcctagatgaagggcagatggggcttcgcatggccaggcctcagatcggcttcccccagcccctccagggaagaggcaggaggctccctcacttccccttggaaggcagcatgaatccctgtacttcctggactgcccctttgcccccgcctggggccaactttcctgtcatggggtggagcagctgtgttggatggttggttttgctttttgttttgctctattttttatttaaaaggaaaatttttttagaaatgaggtcttgctctatcgcccaggctggagtgcagtggcgcaatcccagttcgatgcattcttgaactcctgggctcaagccatcctcccacctcagctttctgagtagctgtgacgacaggcgcgtgccaccacgcccggctcatattttaaattttttgttagagatggggtcttgcgatgttgcccaggctggtctcaaactcttggcctcaggcaatcctcctgcttctctggctcccagagtgttgggattacaggagtgagccaccacgcccagcctgcttttgtttttaaaggatgaggtttctgttgtttctttccaaattgtaaaagtaatacttaccttaggtgacttagaaaatacagaaaagtagagggaagcaaagtcaggcatggatcccaccctgagatgcacggtctggagtttgcatcccgggctgcactgtgtatgcccctgaggtcatcctgtccagtgttggaatcagcctctgctgggcatcaggttgcctgcacctactccttgtttatatgtgggtgtgtgtatctgtggatgtaccaagtgaaagctttggggaaacatctttgcatgtaaatctttgcatttgggataattaactcaggattaatttatagaattataagtcctggagcgaagggtgggaacagagttaaaattgaacttcctgaaacacgtcacagcgtcaccaaatcgcttggctgggaggactgtgtgcacccagggcccttctgtggggtgggccaggatttagtgtgaaactcatggctgctaggctgggaagagctcgaccacaggtgtggggttttgtctccagtgacattcccagctggctcttgcagcccctgccctagtgacagcatggggtgagggggccagaggaggctggaggtggagccctgcctctaggcggaactgtaccatctgtagttgcagggcaggattaaaaagggacagttttgctgtttgtttgtttgtttttttctgtcatctgactgggtgtcccaatacctgatgtctcctaaaactttttttttttttttttttttttgagacgggcctccttctgtatcccaggctggagtgcagtgatgcaatctcggctcactgcagcctcaacctcatgggatcaagtgatcctcctgccttagcctcccgagtagctgggacgacaggcatgcgccaccacacatggctaaattttaaattttttgtagagtcagggtctctctgtgttgtccaggctggtctcaaatttctgggctcaagtggtcctcctgcctcagcctcccaaagtgctgggattacgggtgcgagccactgtttctggccttatgcacacttttcattgagaacaaagttatttgttgtaagagaaacaccttgataactgttcacacactaaactacccaggtaaccagcacccagatcaagaaacagcattgacaagcccctctcacccccttccagttactaccactctccctgacccaccacgataaccgccgttccatctcctggcttcagaatgtggcctccttttgaaccttacataaatggaattctaccatgtgacctcagattctttcatcatccttgcgagattccaccgtggtgttgcgtgtctttgtggtttgctcatacgtctgatgccttttccaatagacggggcacccaggaggagtcagtggaaacacatgtaccgtggaaacagatcaggtcttgcgctgaaattcggatacctctgaattactgcccatcgtcaaagaaataaagtttatttccctaaaggatgttttgtggtgaataggaaagaatttgcaatcagcgtagctgttaagcccacaggagagcaagttgtattatgttgtgagcctgggttgggtgtgcagagatctggggttcagtctgacgcctctgggccgtggtttccctagatggacatgcaggtggttagatgaggggcccatctagctcagtgctgtgatgctaagcatatacttctcagtgctaagaggttgttttccaaagtgtttgaagtttgctcttaagatcttatttaggccggtcacagtggctcattcctgtaatcccagcactttgggagactgaggcaggattgcttgagcccaagaatttgagcccagcctgggcaacatagcaaggccccatctctaaaaaaaaaaaaattttttttttaattagctgggcatggtggcatgtgtctgcagttccagctacttgcgaggctgagggaaagaatcgcttgagcccaggaatttgaggctgcaatgagctatgattgcagcactgcactccaggctgggtggcagaacaagactgtctctacaaaaaaaatttttaaaaatcaggcatggcagcatgcacctgtaaccccagctacttgggaggctgaggcaggcggatggctggagtccaggaatttgaggctgcagtgagccatgatcgtgccactgcattccagcctgggtgacagagcgagactccatctttacaaaacatttttaaaaaaattagcagggagctactcgggaggctgaggccggcagatggcttgagtccaggagtttgagggtgcagtgagccataatcacgccattgcattccagcctaggtggcagagcaagactctgtctctttaaaaaaaaaaaaatcttatttaccaacttggctcatttctaagtggagcaaaaatgcagtgtctcacttctgctctgcctgaattacctccaggccagatttcttggtggaaggaaggagccgtgtagatacagccagagtctcccaggtgcaaagaccctctgagaggccttgataagtgggcagcttccactgagcagcccccagagatggagactcagtgcccacacagcagcttgttcttccattctgggacagttcttcccattaggaatgttcccttgtgttggctgaaagcctgtgtccctaaattctctgtcagcgtaacggcaatgaacctggacttgggtcttcaggaaccaaagccatggagtcaaggatttggagagatggtatattcatcaccgggcctaacatgatggtctttttttatttttaaattgagacagggtctcactctgtcacccaggctggagtgcagtagtgtgacctcagctcactgcaacctctacctcccaggctcaagtgatcctcctgtctcagcctcccaaagtactgagattacaggcatgagccaccacacccggccatccttctttttttttttttttttttgaattggagtctcactctttcacccacccaggctggagcgaagtggtgcgatcttggcttactgcaacctccaccctccgggttcaagcaattctcctgcctcagcctcccgagtagctgtgattacaggcacctgccaccacagccagctaatttttgtatttttagtagagacgagatttcaccatgttggccaggctggtctcaaactcctgacgtcaggtgatccacccgcctcagcctcccaaatgttaggattacagtcatgagccactgcacccagcctgtctttcctttttaaggctcagtaatattccattgtatggatagactgtggttttttatccattcatcatcggacgctgggacggtttctgccttttggctattgtgaatactgatcctatgaacatggctgtacagatgtgtctttgagactattactgttttattaacaacattgctgtaatgagggatctcaaatctggagtggatctgagaaatcgcctctttcaaccccttatccaatgcttgagtccttccttccagaatcccactgagacttcttctggcctcagatgcgtgggtgggagacatgccacctcccgacacctctgaccaagggcccggagctgggtggcttagggtgcaggaaagaggcttgtgagtgggatcatgccagagggatgtgcatcaaggcatcctctagctacagatgccccaggggaggcagcagtggggctgctgcaggagaaacctggaatggatgtttggacacactttcctcaatggccaggattgatggacagtggaattcatcagacgagtcttggagactgaggcctttaaaaatagatgcagctggctgggtgcggtggctcacgcctgtaatcccagcactttgagaggccgaggcgggcggatcacgaggtcaggagatcgagaccatcctggctaacacggtgaaaccccgtctctactaaaaacacaaaaaattagctgggcgtggtggcggacgcctgtagtcccagctactcgggaggctgaggcaggagaatggtgtgaacccaggaggcggagcttgcagtgagccgagatagtgccactgcagtctggcctgggtaaaagagcaagactccatctcaaagaaaaaaaaaaaatagatgcagctgggagcagtggctcacacctataatcccggcactttgagaggccgaggcaggtggatcacttgagggcaggagtttgagaccagcctgggcaacatagcaagactctgtctctactaaaaattttttaaaaaattagccgggtatggtggcgcaatcatgtagtcccaggtactcgtgagcctgaggcaggagaattgcttgagtccaggaaggtggggctgcagtgagctatgatcgtgcctctgcactccagcctcggtgacagagtgagaccctgtctttaaaaaaaaagaagaagaaagaaaagaaaatgcctcccatggaatctgtttctttttttttttgagatggagtcttgccctgtcacccaggctggagtacggtggcatgatcttggctcactgcaacctccgcctcccaggttcaagcagttctcctgcctcagcctcctgagtagctgggattataggtgcccaacaccacgcccagctaatttttgtatttttagtagagatgtggtttcaccatgttggccaggctggtctcgaactcttgacctcaagtgatccgcccacaccgccgtggagtctatttctgttaggaatgtgtttgttgcaagcaacctgagaaacagaggcttaggagagaggggtgtctcgtgtaacaggaggcatgggtgggtggtccagccgcaggcagctgctcaggcacatctgaggggcctgcgccatctctctctctctcctctggctgagggctttggtcatcctggcctaaagtggatgtcagccaccaggcagggcatagggagtaagggattgagccccccattgcctgcttccagggaaactctgctcttttgtttgggaatgcctcactggttagactgtgtcttgtggtcatctctggctgcaagagagtataggaatgggaggattttgtgttgtggcccctacagaagaggagagcaagggagaagttggttatatggggattgaggtaccagccacacagcatctgtctgcctcacaatcccagcacgttcagctgggcatggtggctcatgcctatagtcccagctactcaggaagctgaggcaggaggattgcttgagcctaggagttcaggaccagcctgagcaacatagcaagaccatgtctctacaaaaaaaaaaaatgaaaaaaaatagccaagcgtggttgtgtgctcctgtaatcccagctactcaggacactgagggtggcgtggggaagatcccttgagcccaggagtttgaaaccagcctggacaacatagcaagaccctgtctctaaaaacaaagaaatgagacgcattagacaaaagttcccaaaagttggactcagtgatgtagatgagagaattacaagataacttttcttttcttttttccttttgagatggagtctctgtcacccaggtgggagtgcagtggcgcgatcttggctcactgcaacctccgcctcccaggttcacatgattctccctgcctcagcctcccaagtagctagaattacaggcacccaacaccatgcagggctaatttttgtattttaatagagatgaggtttcgccatgttggccaggctggtcttgaactccggacctcaggttatcgaccgcctcggcctcccaaagtgctgggattacaggcgtgagccactgcacctggccagggtaacttctctctttgtctctattccctttctgaatatgaaagctttccagttctacttgatatcgtaagaaatactaagtcacccaaagtgtaacacctgttttttgcagtctcctatctaagaactaaccagacccgactctgcttagcttctgagatcagatgagatcaggctctttcagggtggtggggccgtagactgtttttgcaatctctaggaaattttttttaaagccagagaaagataaattatccacattacttaaacaatttttaaaaatatacaagaaagcctagcttatttaaagcccaaaacactgtaattccattggtaacaaagatgttaaacatttaaaatgtgattaaatctaaaattggtggcttctgaataaactgtagttttgaatttgatacagcaaatctgtggcaatgttgaacaaaacaacttatacataatgcatttttatattttaaactaacaaagatgcttcagaaatatagaggacatttttaaaagaattacttatattttaatcttttcaaattttccattttgtttccatcacttccatttttttcagaatattgtgcctcctcaaacatcatggtaagagggtggtgggactagagatggagccctcagcataaaaaataaagttagccgggtgcagtggctcacactcataatctagcactttgggagcccaaggtgagaagatcacttgaggccaggagttcaagatcagcctgggcaacacagtgagaccctatctctaaaaagtaaaaataaaaacttagctgggtgtggcgacacacgctgtggtcccagctactcaggaggctgaggcgggaggatcgcttgagcccaggagttggaggctgcagtgagctatgatcacacccacttcactccagcctagagacagagtgagaccctgtgtcaaaataaagaattgtagcacactcagaatcttcaaatcttgctctgggtatcaaaatcggatgtaggctcttcagctgcagttggaaaggaaattgtaaaatagacctgtagtcaaaaacaaatgggtgactttacaactggtaaagactgacttaagtaggatgtttttagctgcaaatgaaagaaacctctggctgggcacggtggctcacgcctgtaatcccatcactttgggaggccaaggcaggaggattgcttgagaccaggagttcagaaccagcctgggcaacatagtgagaccctgtctctaacaagattttttaagtgagccaggtgtggtggcaggcgcccgtagtcccagctacttgggaggctgaggctggaggattgcttgagtctaggagagatcaagatcgaggctgcagttagctatgattgcatcactgcactccagcctgggtgacagaagaaaaaaagagagagagagagaagaaaagaaactctagtcctgggggggtaaaaaaggaaagaagaaaagaaacctctactaagagtgccttaagaaatatggacttttgcctgggcgcggtggttcattcctgtaatcccagcactttgggaggccaaggtggcggatcacctgaggtcaggagttcaagaccagcctggccaacataacaaaaccccgtctctactaacaatacaaaaattagccgggtgtggtggtgggttcctgtaatcccagctactcaggaggctgaggcaggagaatcatttgaacccaggaggcagaagttgcagtgagccaagatcgtgccactgcactccagcctgggcaacagggtaagactccatctcaaaaagaaaaaaaaagacttttactgtttcacccaaagcttagagatggcagatctggggtcatacaggaccaagttcttccacgagttcaccctgccatcctcagataccctcacctcccgggctgattcttttcatgtctctagttggctgtcatggtcgggggtgtcacatgcaggagaaggaggacatccctggtttcagtccctttttttatttgagacggagtcttgctctgttgcccaggctggagtgcaatggtgtgatctcagctcactgcaacctccgcctcccgggttcaagcgattctcctgcctcagcctcccaagtagctgggattacaggcatgtaccaccacacctggctaatttttgtatttttagtagagacggggtttcgccatgttggccaggctggtctcaaactcctgacctcaggtgatctgcccaccttggcctcccaaagtgctgagatgacaggtgtgagccaccactcctggcctggtttcagttcctttctaagggcaaggacagctctcctagaagtccctcatgtctcagtggccagaattgggttctggcctctccttacacctgtcccagctaggggaaaaggagtgccttgctctgagccttggagaatcaccaaagttcctcccagggactgggagggcccagctgccccaagcactggttgttgggacaacccagcaaagtttgtcccatctttagataccaggacacaacggggggattctgttagcagggagtggggcagaggacttggaggacagcttttggggtcagatccaggactggaactcagattttttttgtgtgtgtgtgtgacagagtctagctctgtcccctgggttggactgcagtgctgcagtcatagctcattgcagccttgacctcccgtgtcaagctatcctcctgcctcagcaccccgagtagctgggacaacaggcacgcaccaccacacctggctaacttttttgtttttttgtagagatggggtctcactgtgctgcccaggctgatcttgaactcctgggcttgatcctcctgccttagcctcccaaagcactgggattacaggcgtgagccactgcgcccagtgagaccccaggtgtcttaaccatgaccccagactgccttctactgcactgcggctgggtgtaagaccccctcccgctgcccagcccagagcctggcctgagcagatacgaatggaaggccagggctgtgactggcagtgttcttcccggctacagtgacagtggtggtgggggagggcaggaatccaggacccccaggccactctacccccactggggagcctctgggactagagagggagtattcagagggaggctgaggctgctggggagaaaggataccccccccccgcccgccttccagaaggggagaaatttcttttttgtttgttctctcaagcttctttttcaagaaacaagcatatggcagcggatggtgcgggggccgtgtttgggtggggtgtgtgcctgcctttgccttttacgtggttgggtgtatttttttttttctccatcagctccaacgccccagctggtccatagggcagtgagacttgaatcacagagacgcttctctggtgtccagaaaaatccggctctttctagtggcgcttccaagggggaagagattggagagctctccagcaaacccaggcctgagctttgcagaggtctgagctgaggactgagtgtccaaggggctgaggatgtggactgtctttgtgaggtggggtacagccagtgaaggagccagtgttaatttcctgaagctgctgtaacacgggccacacagacttcgtgccttaaagcaacagaaatttcaggccgagtgcggtggctcatgcctgtaatcccagcactttggaaggctaaagtgggcagatcatgaggtcaggagttcaagaccattctggccaacatggtgaaaccccatctctactaaaaatacaaaaattagatgggcgtggtggcaggcacctgtaatcccagctactcaggaggctgaggcacgagaatcgcctgaaccctggaggtggaggttgcagtgagctgagatcccactgctgcactccagcctgggtgacagagtgagggagaaaaaaaaattctttttttttttttttttttttttactttgaggttcttgggtacaagtgtgcaggtttgtgacataggtaaacttgtgtcatgggggtttgttgtacagattcttttttcacccaggtattaagcccagtacccaatagttatttcttatgatcttctccctcctcccaccctccaccttctgaaaggccccagtgtgtgttgcccccctctctgtgtccatgtgttctcattgttcagctcccacttataagtgagaacatgcagtatttggttttctgttcttgtgttagtttgctaaggataatggcctccagctccatccatgtccctgcaaagaacatgatcttgttcttttttgtggctgcatagtattccatggtgtatacctaccacattttctttacccagtctatcattgatgggcatttaggttgattccatgtttttgctgttgtgaatagtgctgcagtaaacatacgtgtgcatgtgtctttattgtagaatgatttctattcctttgggtatatacccagtaagggattgccgggtccaatggtatttctgtctttaggtttttgaggaatcaccacactgtcttccacaatggctgaactaatttacaacagtgtataagtgttcctttttctccacaacctcaccaacatctgttattttcttgttcgtttgtttttgtttttgtttttgttttgagacggagtcttactctgttgtccagactggaatgcagtggtgcaatctcagctcactgcaacctctacttcctgggttcaagcaattctcctgcctcagcctcccgagtagctgggattacaggcacacactaccattcccggctaattttttttttttttttttgagacagagtctcactctgtcgcccaggctggagttcagtggcgtgatctcggctcaccgcaagctctgcctcccgggttcacgccattctcctccctcagcctcccgagtagctgggactacaggtgcctgccaccacgcctggctaattttttgtatttttagtggaaactgagtttcaccatgttagccaggatggtcttgatctcctgacctcatgatctgcccaccttggcctccaaaagtgctgggattactggtgtgagccaccacgcctggcccagcatctgtcattttttgactttaataatagccattctgactggtgtgagatgatatctcattgtggttgtgatttgcatttcactcatgatcaatgatgttgattgagtcttttttcataagattgttggctgcatgtacatctccttttgaaaagtgtctgttcatgtcctttgcccatgtttttatgagaacaagagaaatttctattctcacagttctggaggccaaaggtccaaaatcattaccactgggccaaaatcaaggtgccgacagtgccatgctccctccagaggctctcggggggaatctgttcctggcctcttctagctcctgggggctgccagcactcctgggcttgtggccgcatcactccagtcttcaaggccagcatcttccaatctctctctacttcgtcttcacttggacttctcttctatatggatgtccagtcttcctctaccctatttttaaaaaatgtttgtagagctggggtcttgctgtgttgctcaggctagtctcaaactcttagcctcaagtggtcctcctgacttgaagtgatcctgctgccttggcctcccaaagcactgagattacaggaatgagccactgtgcctggcatgacctcttcttcttcttctttttttttttttttttgagataggggtctcactgtcttgctcaggctggagggcagtgacgtgatctcagctcacagcatccttgacctcctgggctcaggggatcctcccatctcagcctcccgagtaactgggactataggcatgctccaccacacccagctaatttttttttattttttgtagagatggggtctcactatgtttcccaggctggtctcaaactcctgggctcaagcaatcctcctgccttggcccccaaagtgctgggcttacaggtatgagctaccgcgcccggccatgacctcttcttataaggatgcatgtgatggcatttagagcctacccggctaagccagaataatcccctacctcaagatccttaatcacatctgcaaagtgattttgccatataaggtaacacaggctctggggattaggacatggctgtcttttggaggtcatttttttgagcctatctcgggtctctaagggcaaactccagcagccattctagtagacaggttctcctgtgatagatgccggccaggtaaaggagacaaatggaagatcccagctgacccacctcggctctgtcccctctgaggggaccttattctcatttatgtggactccctaagccatatatctaggctggagtgcagtggtgtgatcttggctcactgcagccttgacctcctgggctcaggggatcctcccatctcagcctcccaagcagctgggactacaggcatgcaccaccacacccagctgatttttttattttttgttgagatggggtcttgccatattacccaggctggtcttgaactcctgaactcaagccgtgtccactctcccaaacagctgccccctcttggggggtacagcagcgtcagcctggtgtgccctcagggtgtatccgttatttatcttggactgcataaaccaatagcccaacattagcagtgtcaaacaacagtcatttcttcttttactcttcacattgtgagagttgtctgagctcagccagatgggtcttactcaatctctcctacaattgcagtcaaaaggttgccggtgggagttggaggctgcagtgagctacgatcgcaccacggcactccagcctgggcaacagagcaagatcccgtttctaaataaaaagttagcagggcttgaggtcattttgaagatgtttcacttgctggcccggggcctgagccgaggaacagctggggccccttgggcttctctgctgccccccggcccctccagcacggtggcctcaggatagtcgggcttcccacgtgtcagctcagagtccagggcaagggtctgagagtgagtgagtggctgggggaagtctagcgcctttggggacctggctgcagaggtcacgtgttggcgctgcccacacattctgttggttcaaagtgggtctttattcaaatcacattcaagaggagagaattagatgacaccacttgttgggagaagtattaagaacttatttatttatttttttcactttgggaggccgaggtgggaagatcctttgagcccaggagttcgagaccagcctgggcaatatagggaaactcccatttctatttaaaaaaaacaaaaaaccaaaaaacttatttatttattttttagagacagggttctcactctgtcactcaggctggagagcagtggtgtgatcacagttcactgtagcctccacttcctgggctcaagtggtcctcttgcctcagcctccccagtagctgggactacaggtatgcactaccatgcctagctaattttaaattttttttgtagagatggggggtctcactatgttacccagtctggtcttgaactcctggcctcaagcaatccttctgcctcagcctctcaaagtgctggattacaggcatgagccaccacacctggcctaagaatgtattgtcagatttaaaaccattgcaggaggatggaccagagaagagggccctggggccccagaatgggggtttatctgccagctggattccaggggtctgagtacccaggtgtctggggtgggagagtgggtgcaggctccaggtgggcgtgtcccctttgggaagggcgggacagggccctccagagcccaggcccaggctctgggctgaggctaggacagtctcagagcatttcccgctggacagccccagaatctgactgcagtctgtgccaagagcacttcggcgttctgctccactcctgccagccccaccacggacgtcacaccccatcgggctcccttgtgccttagtgcctttgcctgagctgtcccctctgtctggactgccccatccctcaccattcaccttcttcatggctcatgattcttccaaacttgcatcaacggcccctctcttcggaggcctttccaggccttgttatgtgtagcaggcccgggcacacacagatgaaagcaatcagccctgttctccaggagccagtgcatgggggctctgacacctccacatcctggaggaggagggaaggaggggctgagggagcccaaccgaggggcacaacaggaggtgttgacgagcccacaagagctaagagggagccagcagcggggaagggcatttcttaaaaagggcacagcaggtgcaaaggcctgagcgagagtgcaaggcccacccaggggcctgcagactggagtgtggggctctggagggaagacaggttcagcttgatctgtgatgtgactcctgatgggacagtgagcctttggagggtgaggtcatgccctgcgcgtctctgtgtcccagcacgactgtggctggggccagccaccttctctgtgaaggttttcactgcattcagactgtgctgggactggccccaggaggacttggactagcgtgtgtgtgagtgagtgtgcatgtgtgcacacatgtgtctgtatgtgtggacatgcatgtgagtttgcatgcatgtgtgtgcatatgtgtgtatgcatgtgtgagtgtgcatgcatatgtgagtgcattgtgtgcacaagtacgtgtatgtgtgtatgcatgtgagtggctatgcgtgcgtatgtgtatggggtgtctgcatgtgggtgtgcatgcgtgtgtgggtgtctgcatatgtgtgtatgcatgtgagtgggtatgcgtgtgtatgtgggtgtgcatgtgtgtgggggtgggggtgtgcatgggggtgtgcatgtatgtgcatgtgtgtgtgggtgcatgtgtgtgtgcatatatgtgtgtgatatatgtgggtgtgtgtgcatgtgggtgtcaatgtgtgtgcatgtgtgtatgcatttgagtgtgggtgtgcatgtgtgttcatgtgggtgtgcacgtatgtgtgtgtgtgtgtgttcatgtgggtgtgcgtgtgtgggtgtgcatgtatgtgtgggtgtgtgcgtttggggggtgtacatgtgtgggtgtgcatgtgtgtgggtgggtgtgggtgtgcatgtatgtgggtgtgcgtgtgggtgtgcatgtatgtgtgcgtgtgggtgtgtgtgtgagtgtgcatgcatgtgtgtgttgacttgctagtgctcacacttacctctggggcagagatgtgcttgttaggtgccccctccctctctccactccattccagcaaaggtcactgagtgtcctctctagtcttaggaacgacactcgacagtggacaatgagaacaaccaaacacttcctctcttcccccctccccccattttgaaaaattctattaaggccaggcatggtggcttatgcctataatcccagcaggttgggaggctgaggtgggaggattgtttgaggccaggtgttcaaggccagcctgggcaacatagcaagaccccatctctacaaaaaaatttaaaattagccaggcatggcggtgcacacctgtagtcccagctgcttggaaggctgaggtgggaagatggcttgaacccaggaatttgaggctgcagtgagctatgatcacaccactgcaatccagcctgggcaacagagtgagactctttctaaataaaataaaataaaatataaaaacagaactactatacaattcaacagttccacctctgggtatataccccaaatcattgaaaacaggtttaccaagtgatttgcatactcatgttaatagcagcattatttgcaagagcggaaacgtggagtgcagttgcacagtcacacctcactgcagccccaacctccgcaggctcaagccatcctcccgcctcagcttcccaagtagctgggactacaggtgtgcaccaccacacccagctaatttttgtattttctgtagagatggaatcttgccaggctggtctcaaactcctgagctcaagcaatcctcctgcctcagcctcccaaagtgctgggattacaggcctgagctactggacctggctggtagtcctatttttaattttttgaggaaccgccatgctgttttccacagtgcctgtaccattttgcatccctaccagcagcacacagggttccaatttccccacgttctcaccagctcttgtttttttcctgtgtgtggttttgtttgttttgtttgtttttgttttagacagagtttcactcttgttgccccgcctggagtgcaatggcatgatgtcagctcactgcaacctccgcctcctgggttcaagcaattctcctgcctcagcctcccaagtagctgggattacaggcatgtgccaccatgcccggctaatttttgtaattttagtggagatgggtttcaccatgttggtcaggctggtctcgaactcctgaccttagatgatccgcctgccttggcctcccaaagtgctgggattacaggcatgagccaccgcgccccgctttcttgtgttttttatagtaggtatcctggtgggtgtgaggtggagtttagatttgcattttgctaatctttagtgatgttggacatcttttcatctgttttatggccatttgtatatcttcttaggggaaaggtttactcaagtcatttgcctattttttaattggattattattattaatggagatgatgtctcgctctgttgcccaggctggtctcgagctcctggcctcaagttatcctctcaccttggcctcccaaagtgctgggattacaggcatgaaccactgcatccagtcttagttgttgagttttaggaggtgtctgcatatcctggatattaatcccttaccgatatactatttacaaatattttcacccattctgtggtttgcctttttattccattgattctgtccaaaacttctctttactcatagagcaaaggttgtatatctctaaaccaagcttcttcccttgcttctctctgtggaaacaacagggtattatccttccactcctgtacccagagaactcctattcactcttgaaaacccacctcaacagtcatcaactcagggaagccttatttgtcaggcccctcctcccccaaaactaagtaaataaaacatttaaataaaacataggtaacccctttccccattgtcaagctctgtgcctgcgcgagcttctctgcttgtccttctttcgtggtcctgtagttcttttttttttttttaaataagatggactctcactctttcacccaggctggagtgcagtggcaagatctcagctcactgcaacctccaactcccaggttctagcaattctcctgcctcggcctccctagtagctgggactataggcgtgtaccaccacccccagctaattttttgtatttttagtagagatggggtttcaccatgttggccaggctggtctcaaactcctgacctcaagtgatcctcccacctctgcctcccaaagtgctgggattacaggcatgagccatcgcacccagcctggtcctgtaattctctctggacacactggccctgtgagctggaggagggcaggcggagcctggcacagagcagcctcttggtaggtgttgagtgaatgagtaggggtggtgaggggaggccacggaaggcacccaggctgtgttcctcccactcccagccttgccacgacctaccaggtctccagctcctgctgagctcttgcagggtggcccctccccacttacagctcactgccttggactaggtcccagccaatggcccggcggaggtgtcctcactgttcttacccagtatgacctaggcgggagccaataagcacagggaatgagtatcaccctgagggttcaaaagtgtgcaaggaagggaggaagggaaggaaggaaggaaggaagagaagggagtgggggagggagagagagaaggaaggaaggaaagaaggaaggaaggaagggagcaatgaatgaatgcatacatcaaggaatgaatgaatgcatatacacaaaggaatgaatgcacacaccaaggaatggatgaatgaatgcacacactaaagaataaatgaatgcacacaaaggaattaatgaatgtacacaaaggaatgcatgcacacaccaaggaatgaatgaatgcacacaccaagaaatgaatgaatgaatgcacacatgaatgaatgcatacacacaaaggaattaatgcacacaccaagggatgaatgaatgcatacaccaaggaatgaatgagtgttcacaccaaggaatgagtgagtgaatgaatgcacacgaaagaaagaatgaatgtgcacaccaagtaattagtgaatgaatgaatgcacacaaaggaatgaatgagtgaatgtacacaccaaggaattagtcaatgaatgcacacacacaggaatgagtgaatgaatacacacaaaggaatgaatgtacacatcaaggaattagtgaatgaatgcacacacagaggaatgagtgaatgaacctgccacttgtggagagtgaaaaaagcctgagagatccccagatgagggagcccccatgtgtgcccctgccgttgagaggcctggacatgctggtgcatggtgtaagggcttgggcttgggctgagctggctcacaggcgacccatcaagtgtcacaaatgaccttgaaccgctgccacaaatgaccttgagcagcacgcttcccctcccgagccttagcctccccagatgtaacatggattagaagaaccacctcatggtgcttttctgaaaatttggtaggcctaacgtggtggctctcgcctgtaatcctagcactttgggagggaggccaaggtgggtggatcgcttgggctcgggagtttgagaccagcctgggaaacatagtgagaccctatctgttttgttaaaaaaaaaaaaaaagaaaaaaaatttggtggggtgatgggtgtgccagttggagagctgtgacatttgtttttttggttcaaccccaagccagtgcagacaagtgaccctccccagccagcgggccaggcctctcagtgtcaccctggctgaggttgttcgtgtatgtgtgtgtgtgtgtgtccctttctttactgtcctcattctttgcatcacgtgtgtggtcttttctgtctcatacacgcacacccgtcgcatttgcatgctctgacacacagacacacattgatgcttccttttttaaattttttatttttggaggcagggtcttgctctgtcgcccaggctggagtgcaacggcatgatcacagttctctgtagcctcgaactcctgggctcaagtgatcctcctgcctcagcctcctgagtagctgggaccacaggtgtggaccaccacacctggctaattttttttatttttgtagaggtggggtcttgctatgttgcccaggctggtacactcctgcttctttatgtatgtatgtatttattctctttttagaaaattatttcattgaatcgtcctttaagcacacacttttctgaagctctggggacacttggggagaagaggaggggagggttctagctgtcctgtagggccacattggtcctgggtgcaggacaagcccaggcaggagaaacggaccctgctgaggggtctcctctttgcctcttccctgggtcccagctgggtggtctcgcctgttcactgccgggcagggttgggcagtgcagagccgagcccaccgctgtgtcatcattccacgggggaaggggcttgaaggctgcgttgtggggtgatgggaacccggatttagttggtatgacccgagctcaggtttcagctttgcgacatccttgtggtggggtcttcaggtgggaattcctcctctgtaaaatgagagcttgtgagaattaaactggtcccggcatttgggaaacagccctgtgactccttccgtctcttccctccggagggggcggtccttgagctctactgagcccatgccagcgagagtcgtcatggccgagcccctgggccagattccaagttccatgccaccttggcacttacttttttggctccagtcctctttggctgtcccctctgtgaagggcatctaaggtggtggatgggggaggggagtttgtttgtttgtttgttttggttttttcttttttcgaaaaggagtctcactctgtcacccacactggagtgcagtggcgtgatctctgctcactgcaacctcgacctcctgggttcgagcgattctcctgtctcagccacctgagtagctgggactacaggcacctaccacagtgcctggctaatttttaaatttttagtagaggtggggtttcaccatattggccaagctggtcttgaactcttgacctcaagtgatccacccaccttagcctcccaaaatgctgggattacaggtgtgagctaccgcgcctggcctttgttgttgttttgagacagggtcttgctctgtctcccaggctgcagtacagtggcacaatcatagctcactacagcctcaaactcctggctcaagtgatcctcccgtctcagcctcccaagtagctggcgccacaggcatacacccggctaatttctgtattttttgtagagacaggattttgccatgtttcccaggctggtcttgaacttctggcctcaagccatcctcccaccttggcctcccagagtgctggaattataggcgtgagccaccatgcccggccagaaaggggagtttatttaaatgggccgagccaggagctttgtcttagccttgttcttctgtctacatgcccttttcccacctcccactaggctgcacttcactggggtaaatcggtcagaaccagctagtgggaacaacctgtaacacctgtttccagacatccaggctttgggctgcagaataggctcgcacctgttagctcactctctgctagcctcctaactggccctgagcgccaggtgcagggtgtttgggattggaaatcacagctggatttctgttagttcactgtcaccctggccccagggctggctagaaagtgggcgctctgggccggacttctatgggggtcccccagcctggaggcagccctgccttgagtcagggcagcactgattcagacgtggccacgagtgcttggctaatttttggctcagggtccgggcaggcctccagctcttggcggccggcaaatctgctgctgtctgggcaaggagtccctggcaagacggggcaggtggcaggcaggcagggaagctgagcttcttggagtctggaatagggaacatccctagaagatgacccaggccctgcacctggctgggtgtaagagtcccctgtgaacttaaaaatacagtgtccagggctgggcgcggtggctcacgcctgtaatcccagcagtctgggaggccgaggcgggcggatcacctgaggtcaggcgttcgagaccagcctgaccaacatggtgaaaccctgtctctactaataatacaaaaattagccgggtgtggtggtgcacgcttgtaatcgcagctacttgggaggctaagtcaggagaatcacttgaacctgggaggtggaggttgcaatgaactgaaatcatgccactgcactccagtctgggcaatagagtgagactccatctcaaaaaaaaaaaaatacagtgtccagggccccgctgcccagggagcggtcacctctgatgaggtagggcacaggagcccgggcactgaacagcaggtgttggcagcagctgagctaccagccgtccttgcttcacaggtgggcggagcaaaatcgggagctgggtgatgggacagatgtgacagtcgctcttctactattctcggactgtaacctgggatcttcccagtggacttccctccacccatcccagctctgccttttgggggcttcatgtctttctcattattattattactttaatatttcagcttttaggccgggctgtaatcccagcactttgggaggccaaggtgggcagatcacttgaggtcaggagttcgagaccagtctggccaacatggggaaaccccgtctctactaaaaatacaaacattagccaggcgtggtggtgggcacctgtaatcccagctacgggggaggctgaggcaggagaatcacttggacatgggaggcggaggccgcagtgagccgagatcacaccactgtactccaatctgggggacagtgagactgtctcaaaaataataataattttaacttttattttagattctcagggtacatgtgcaggtttgttacaaaggtatattgtacgatgctgagatttgggatacaagtgatctcgtcacccaggcagtgagcatagcacccaataagtcgtttttcagcccctccttttcccctctctccctgcttttggaggcctcagcgtctgtcattcccatctttatgtctgtgagtacccaacgtttagctccccttataagtgagaacatttgatatttggttttctgtttctatgttaatttgcgtaggataatgatgtccagctacttccatgttgccgcaaaggacatgattttgttcttttttatggctgcataatattccatggtgtgcatgtaccacattttctttatccattctaccgctgatggacacatgggttgattccatgtctttgctattgtgaatactgctgctctgaacagatgcgtctctcaccttattaagggaagttgactttttgaacccaaaggatggacatttgggatatttctcttccttgcgagtgtctgcgttttgggctgctgagagaggcgtctgggctcctgttcccattgctccctgcgttgcagtgtgaccaaccatcctaggtggcctaggactgaggggtttcccaggagacggaactttctgtgtaaacccaggaatgtcgagttgggcccagttggctgtgtgtcagctctgcgtgtgagcagctggtctgttccctgcatccctgtgaatgtgagaagcgtggtcttcctaccgcatggtgacagcaaggacaccagcaaggctggagacagacagccttcttccccgctgtgcactggctgaggcctggagctagtgcctttcttgtctctaagatagagtgatgctggaagaaggatagtagctcatgcgggccaatgctgccatcagaatttttacttttttttttttttttttttttaatggagtgttgctctgttgcccaggctggaatgcagtggcgccatctcggctcactgcaacctccaccgccggggttccagcgattctcctgcctcagactcccaagtagctgggattacaggcgcccgccaccacgccaggctaatttttgtatttttagtagagacggggtttcaccatgttgtccaggccggtctcaaactcctgacctcaagtgatctgcctgcttcaccctctcaaagcgctgggattacagacatgagccactgcgcctggccctgctatcagaatttttattttttatttaaaagacagggtcttgctgtgtcacccaggctggagtgcagtgttgccatcatagctcactacagcctcgagctccttgtctcaagcagtcctcccgcctcggcctcccaaagtgctgggactataagcatgaaccaccgcacccggcctctgccttcattttctgtttagaaccattcccactttacaaatgaaaaatctcgggctttcaggactcacccgaggtgctcctagcagacgtgggcctgggtctcatcttcccccgcttctcctgctgcattcttgctccaggcacgtggaacctgcctctccctccatctgaggccctttgcagggagtggctgtctctctccatgctccccaagtgcacccacctgggctgtggctcgggacagggggtcctacaagcccggatgaccgagacaaggagctggggatggcccacagcccagcccctcttccctctctgtgtccctccctcctggagtccctggttccttcctaaacggattagagcctttaccggaaggagccggccgctgtctggggcagccggggggccagggctagatggctgtctggtgcctcctgctttgccctgattcgatttgggcctcagcagctgggaggctggcagccctaaggcctttctgggaatggttcaagggacgggcttgcaggggatggcttgggggagggggacaccttccagcccccaggcaggcagacctctcagctggatcttttatgaagtctggtcgcatgcaagaccctcaagcgggcttcctgccacggaacatccccagccgtggccactggccacctcgtggttcatcagcgggtgtcatccaaggcctgtgtcccatccatggcctgtcatcccctccgcatcccttaatacagcagatttcaaacttctataaaattgcaacccagaagaagaaatgtcttttataaacatttagcagcaaactcaacatacattttggccaaacgcccaccggccagttgtttaaatcaatatttatccacagccaaaaagcagaggagagccagaactgaggccagagccgagctctgatgcatctctcatttctcgggatgtttctgtccctgtggttggacacctctggccttgtgaagtgtgatgcactgtcacatctcctgttctgtgtcattggccaatgatcatatatcatgacctgctggaaggcctgtctgtggctgggaccacacgccttgggccttatgcacactgggcactggtcgggatcctggggtgcaacagtggcaggcagacctggtttctgccctcaaagagcttacagatggcaggggcacccatggcggcagaagacaccccaggcctggtgccctttgtggtgccagccccatggtcctcctgcctgggccttccctaccccattgggtgcagaaactccctgtctgcaggtaggagacagagggtaggttttcaggctcccttgggaactgcagccctgctctctgccatcaacacccagcaggggccacacagagagcaccgggactgagcccatagaggggaaccgagaggcccctgcctctagtctctgccttctttgcttggattggtgcagggacagctgccttgagggcaggccctggcactggggcagcctgtgggtgccccctgggtcaagaaggagaggggcagggtagaaccaggagccaaaggaggctgatctttgcatctcatgggtgcccagctggacactgtcatacccaggaagcctgtgccatgccatggggacccacaactgggggccctggacttgagggggaggatgcagctctgtcccccaggaaccccattgcaacaggacacagtcctgccctggggagcccctgacctgagacaaagcagcctcggccctgctgtatctttccatacccctgatgccaagtctcctggctaggagggaaactgaggctggaaggcctcggcgggggtggcattggcctcgggagcatgtggcttgatgcagaaatgtgacggcagagctcagaggcatgcggaagggaggggaggacatcaccggctcctgacccagctgggcttcaggttgggggtacaggaggtgggcaagcaggttggacaattaaaagcttcgatgaggctgggtgagtggcttatgcctgtatttccaacactttgggaggctgaggtgggcagatcacctgaggccaggagttcaagaccagcctggccaacatggtgaaaccccatctctactaaaaatacaaaaattagccagacgtgtggtggcacctgtaatcccagctacccgggaggctgaggcaggagaatcactcgaacccaggaaggggaggttgcagtgagccaagattgcaccactgcactatagcctgggcaacagagtgagactctgtctcgaaataaaattaaatttaaaatttaaaaaagcttcaaggacaaccagcagatgatggcaggaccaggaagggtgcttcaggcagcgggaactgaacctgcacagactagggaagcatgaacatcggtacatctgggagtggcacagcttagagggcctggagcatggagtgtgagggggaactggagtgagggacaggagaccaggtaactagaataccaggctgaggagttgagagctaatatgggcagtagggagccatggagggtgtgtgagcgagggagggctgtggccagaattgcacacgccgggagaggtggcagttggggcctgtccaacagactggtcctggtgctgggctcagcttgggtgtgcagacttaggagggtgtgccacaaggtgtgagttatcctgccacctgtgcccaggcctgtgcaggctctaatcccatcacacataaagcccttgggcccagggaaggtcagccctggatacagaggcggtcttgggagtccgggggtcaggtggattggggtgggcagccaccatatgagacaagccccctgccttgtgcccaccaccactgcctcctccctccccacaggcgaccatggccttgctgggtaagcgctgtgacgtccccaccaacggctgcggacccgaccgctggaactccgcgttcacccgcaaagacgagatcatcaccagcctcgtgtctgccttagactccatggtgagtgtccccacccacccaagaggaggggacagggtgagcgtccccacctgccttgtagctcaagtcctacctcagctactcgaaggagctttcactgacctgaacctcagtttatctgactgcagctagggccacgatgcctgcatcaagggtgtgagatgtgagacttcagcgagatccagtacataaaaatctagccctggggccgggcacagtggctcatgcctgtaatcctagcactttgggaggccggggtcggtggatcactaggtcagtggttcgagactagcctggccaacatggtgaaaccccatctctactaaagatacaaaaaattagctgggcgtggtggcatgcgcctgtaatcccagctacttgggaggctgaggcaggagaattgcttgaacctgggaggtggaggttgcagtgagccgaggtcgtgccattgtactccagcctgggtgacagggcaagactccgtcttaaaaaaaaaaaaaaaaaaatctagccctggaataaacactggctctccgccctcgtccccttgtcccttcacccctcttgccattcccactttgtccctgggatgaaccacatgcctatctcctagcaggtgacctgggggataatgtgtggggagccattcactagaaagatgtaatccccaacgttaaagcaagagttctaactgcatctcgggcaggaagagagaaaccgagctttgtataatacatcactcccctggcgctattgcctacatacctagacctataacaatttatcccaaatgaggacatcataataccattttcctctagccttttcctggggggaagttctgtgatggaagtgttaaaaaaaaaaatctggcccagcacggtggctcacgcaagtaatcccagcacttttaggggccgaggcgggtggatcatttggggtcaggagttcgagaccagcctggccaacatggcaaaatcccatctctagtaaaaatataaaaattagctgggcctggtggcacatgcctgtaatcccagctactcgggaggctgaggcaggagaatcacttgaaccctggaagtggaggttgcagtgagaagagatagcaccactgcactcccgcctgggcaacagagggggactccgtctcaaaaaaaaataaataaaaataaaaaaattagactggcatggtggcacattcctgtaatcctgcctactcaggagggatgaggcaggagaattgcttgaacctgggaggcagaggttgcagcgaaccgagatcgtgccactgcacttcagcctgggcaacagaggagactctctcaattaaaaaaatttttttaaataaaaataaaattaaaaatctgtctaacatcagttagctgcgctcctgcattttaggatgatgaagcacagagagggtagtaccttgcccaaagtcacacagcatgaccagttttgttttgttttgttttgttttgtttttgagacggagtttcgctctgtcgccaggctggagtgcagtggtgtgatctcgactcactgcaacctccgcctcccaggttcaagcaattctcctgcctcagcctccccagtagctgggactacaggcccccaccaccacacgtggccagataatttttgtacttttagtagagaccgggtttcaccatgttggccaggatggtcacaatctcttgacctcgtgatccgcccacctcagcctctcaaagtgctgggattacaggcgtgagccactgcgcctggcccagcaagaccagtttttagagcgaacttctgggtacaaagtctccccgaaaaataaaggacctccttcaagctgttcctgctgtaggtggctcaagggctgcttaagtggtgtttggggcagcggtgggagacacccctggaaaaggggctgggtgccacactctctccatgatgacccctcccctatgcagagtgactttcatgaggagggggccccaggagctcagccctgtgtcccaaagtactgtgagcttggcattgatggaggtgtggctgatgtgggcagtgatgggcgatgccatggccactagtgacatgtggctatttgcaatttttttttttttttttggagatagggttttgctctgtcacccaggctggagtgcaatggcgcgatcttggctcactgcaacctccgcctcctgggctcaagtgattctcctgcctcagcctctggagtagctgggattacaggtgtgcgccaccacacctggctaatttttttgtatttttagtagagacggggtttcaccatgttggccaggctggtctcaaactcctgacctcaggtgatccacctgcctcagcctcccaaagtgctgggattacaggtgtgagccactgcccctgattcatttaaattcgaattcgttaaaacgaaataaacaactcagttgttcagttgcaccagcctcattttacgtgctcagtagtcagaagtggctggtgtctatggattggacagtgcagaggtagaatgttttcatagtcatagaaagttacactgggttggccaggcgcaatggctcacgcatataatcccagcaccctgagaggctgagtggggcagatcacttgaggccaggagtttgagaccagcctggccaacatggtgaaactccatctctactgaaaatacaaaaattagccaggcatggtgatgcatgcctgtggtcctagctattcgggaggccgaggcaggagaatcgcctgagcctgggaggcagaggttacagtgagccgaggtcgtgccactgcactccagcctaggtgacagagcaagactttgtctcaaaaaaaaaaaaaaaaagttctacttggcagcagtggtctagtgagtgtttcagagcctccttggaggagcacatgaccctatagttatcctagcagtgcgaacaagacaggctcccccgtccctgggccttttaagggtttcctgagggaccctatgggtgacaatgatatttgcttagcagtaacttaagtccagcctcctccaaatgctagggtcttttggtgacctgtagggagggtgggctgaagggatgtgccttcgtcacccgcccccaatctcatcctcttccccaccagctctgggtgcctttaggtgggtgagttttctgccatggtctcggcgtcttcagctgagcggtgactgtgggatgaagcagctctttcagctgtgatggatgagaaacagctggatttatttgttttattttttgttaatagtctacagtgttcccgcgcagaaagggaacagcaagcttttgttttcatcttagaagaaaatgaatgccctgtgttttaattttccagtagggaccctggaggacaggcttcctggccccacgccgcgtgcaccttcctaaccagagcgactccaggctggggctggcacaataggcaagattatggcccagagaggttacctgtcccaggccacgcagcacagaactgcgtttggaagccagactttatagctgccagcactacctgactcagatgaaaaccagcatttattagacacaactgcctgccacaggcttcacagtcagggttttcctggtggggtaggtcagagacctgagatgctggtggtcttggttgtagggaccccctacattaaggcctctgggctatggggctgcagacctcgactctggggccatgaggatagccagctgcctgtatacccatatagggtgtcccagtttagagatctttttcctccaaccattgaatccccatacccaagcccagtggcactgtggaactgggctgcttgtccccaattctatagacgtggaaactggccacgcagagtggctcacgcctgtaatcccagcactttgggaggctgagacgggcagatcacctgaggtcaggagtttgagaccagcctggccaacatggtgaaaccccatctctacttataatacaaaaattagcaaggcgtggtggcgggcgcctgtagtcccagctactcgggaggctgaggcaggagaatcgcttgaacctgggaggcagaggttgcagtgaaccaagattgtgccactgcactccagcctgggcgacagagtgagactgtgtctcaaaaaacaaaacaaaacagatgtggaaactggagcccagaggagggacgtgacttgctcaagtcccacagcagaagtggccgaggtgggattgcagccccagtctgtccagtccccgcctgtcctgcagttcttcccacctcctcctcatccaggacttgagaggggccaagaaaacccagcacggcattgtccctggggctggggctaaggggggcctaccccaaggaggaggaccttggagggaggagcagaggacacttgtcctcctccaccccccatcgccaatgcctgcagggccatttcattcagtcccactacagaatctgagaccaagaacagtagaggggccgtctgtccctggagctgctgctggggtctcaggcagctgggagctcacatcccacccccgaagtggatactagaggtgttcggagtatggggagcccttccgctcacacagcctgcccttcccacagtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgtgagtaccccagggctccggagggccgggcccgccatttcccgagggcaggcgctctagcccatctctgggtccccaaccctgtctagccagggtggcggtgtgtggggagtgaacctaacaagctaggttgtctgagattcccgatgtggtgttattgaggcagcccctgagttgatagagactggctgggtgaaccccagggtaggccagagccagccacttccatctgccttttccagatggggacaccaaggccaaggctgctgctcagttcttcctcttaactatgtattcctgaacacaaggaccaaatgcacttatgccaacacaattttttttttctttaaatgagacagagtcttgccctgtcacccaggctggagtgcagtggcacaattttggctcactgcaacctctgcctcccaggttcaagtgattctcctgcctcagcttcccgagcagctgggattacaggcacctaccaccacgcccaactaattttgtatttttagtagagacggggtttcaccttgttggccaggctggtctcgaactcctgacctcaggtgacccgcccacctcagcctcccaaagtgctgggattacagatgtgagccgccatgcctggccatgttccaataagatttattgaatgcctgctgtacatagcatcttttctgatgctaactcacctaccctgacatcaacctgagggggcaggcactgtcatggctatagtcagggttaacatcttaggccaggtgcagtggctcatgtctgtagtcctagcacttcgggaggctgaaatgggaggatcacttgagcccaggagttggagaccaggctgggcaacatagcaaggcctctgtctctacaaaaaatttaaaaattaaccaggcttgatggtgtacacctgtagtcccagctgcttgagaggctgaggcaggaggatcacttgagcctgggagttcaagactacagtgagctacgatggcacccctgcactccagcctgggtgacagtgagtccccatctcaaaagaaccatggtatagcatgaggttaagagaacgggccgcctgggtccacaactgctgtgcctcaacccactcatctgtgaaaggggaggacgggtgggtctgagggttaaacgaattggtaccttgcaagcacttagggcagtgtctggcacttggttcacactcagtagacaccagctgttgttactattattagtattcacctcacacccctaagatcagctgtttcagggaagggcatcccccagcgctgggcctagcattactggggtgcagccgcatccccagccagccccccacccccctcagccctcagagcctagaccttctccagggccaggatgggggactgggccgggtagaatggacagcagcaggtcgtgtggcaccccagccgcccagagcctgaggcggtgcacctgccttctagagccacgcagagccgctatttatagcaccaggaactcggctggtttatttcaagctccgcagatcccagaggagaataggctccaagctgggagggggccgcaggcccctcctctcatctcctttccaatgcagcttctagaacattccccaaggatccaccaacactctccggtccccaccctggcccagcctggcatgaacctgctgtttgcaacccacggcctccttggagcaggggttggggggtgcctcccaaccctctgccggagggttttctctccctccggcagagcagaaaacggtggcatagattggtcaagacagtgttcgtgtcagagcacagaaaggcatggatggggccgggcatggtagctcacacctgtaatcccagcactttggtcaggagttcgagaccagcctggccaacatggtgagaccccatctctactaaaaatacaaaaattagctgggtaaggtggcaggcgcctataatcccagctactcgggaggctgaggcaggagaatcacttgaaccctggaggtggaggttgtagtgagccaagcttgtgccactgcactccagcctgggcaacagagcgagactctgtctcaaaaaaaaaaaaaaaaaaaaaaatagaaagacacagatggaacattcatcgaacctcagttctgagctggaatagctggcctcccgtgaacattcacagactgaggctcagagagagaagggactaacccaaggtcacacagcaaattagaggtgaccagaggtgaggcccagccctgggaactctgagatgaccagccctggccctcagtggggtggttggaatagggcttgctcactcattaattcttcattcattcattcacttgtgtatcacattgtgtgccagtctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagtaagatccttcctcattccatttgggggccccagggagggtgggagcctcggtccccacccagcagagggggccccctcctgtcccactatgggccctgggcaaagccggaccccaaggcatggggctactggctaccccagcccttcctcatctctgcattcccagacacagaagttctgctccagccgttttccaaacctccacccctactgtccctgccctggctcaagtcactgccacctctcgcctagaaatagccccaggcttgccacggtctccctgcttccagaccagctctctacacctgccctgcaaccaagggtatcttctcaaagcacaagtctgatcattaatgaagctcttctctccacagccttcgggggctccccatcaccctgagcatggcacaggggcccacacacccatcctcatcccctccacaccttcttctcccactaggtgacagggccctactgacctctctacagaaccacttccagttctccagcactcgctggtgcatttcacatgccctggacttcgcgctgttacatcttttgagactgcctttcccctcctgtgtctggcagacacctgcgtggcactgaggctctgctcctggaagccccctcacagtgggtttaggcccctctcttggcacccacagtgccctgtcccctctccagcccaagagctctccagagtcaggggctgtgtctgccctttctagctgtctccagcctacagttcagagcccagcaacagcaggtgcttggagaatgtttgttgaatgactaagtgaaggctgattgctcagccatgtctttcctgcaggaagaggagacctggcctcccttgggaagcgtcaggttgcagagggcctcagggccccagtggtggtcttcacacgccctgggaaacatcgggcaggtccctttggtgctcagggtcccacctcattcatttctgatttggctttatcccttctcctactgtagcctttggttttatggagcaaaggtctgtgaggaaacttctgctgttcttatgtcagaaggaggggtacccagaggccctgggtggtcacactggccaccctgggatgggggacttgccacgcatggttggctgtgcctctgtcgacacttttgccagctgcagggccccgcgcccctgcccgccttgccctggccccccttgtccactttgggcagaattcaaggaggctatgagaggatgggcctctttctggctcagggtgggggctgtagcatggaggtgacaacagatatcccagtgcccagtcctcagtccccagcctgcctcccctcctctgtgcccccgagcccccatctttgttcctgcgtcttctcagtctgtctctttctcctctctcctgtctttgttgttgttgttgttgttgttgttgttgttgttgttttgagatgaagtttcactctgttgcccaggctggagtgcaatggcatgatctcggctcattacaacctccccctcctgggttcaagcaattctcctgcctcagcctcctgagtagctgggattacaggcacctgccaccacacctggataatttttatatttttagtagagacggggtttcaccatgttggccaggctggtctcaaactcctgacctcaagtgatccacctgcctcggtaatcccaaagtgctgggattacaggcgtgagccaccacgcccagcctctcccatctttttctcaatcccctatttttgctccctctccacttcctcttcttcttactttctctcccccctctcggtctctctcccttcctccctacacctttttttttttttttttttttttgagatggattctcgttctgttacccaggctggagtgcagcggctcactgcaacccacctcccgggttcaagcgattctcctgcctcagcctcccaagtagctgggattacaggcatgcaccaccacacccagctaatttttgtatttttagtagagacggggtttcatcatgttggccaggctggtctcgaactcctggcctcaagtgatcctccctcctcagcctcccaaaatgctgggatgacaggcgtgagccaccacgcccagcccttatagctttttccttgcagcctggctcatgcaagtccccacttctccgtctcttctgccctcttttctcctaccggattgtctgcctctgctctgtcctctgggcccttgagtccccgatttcccctccagccaggtgcccagagtggagaggggcttggtcggggagggcagcagggaacctgcttggtgggggagccccagccccccagatgcagacaattgggccttgtccacaccacccacccccagcctgcaggcggttattctgcacaaagtctgcagttatgaggggtccatgggaaccccgcaccaaggggagccactcagcactgcccccactctggggcacagcagccccgaccccagcctggctgccctctcataccaggcccctctcctggactctcccctacaggcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggtgagtgaggtagccggcccggggctgggctggggctgggccagggccgggtcagggccgggggctggaggccacttagccagaggggaagggacttgagatgcccgtgggggaccctggtggtgaaagctcccagtctgatggtggaggtgaagtgaaagcgaagtcatagaacaggatctgagccaggtcattaagccttgaagtcttcccagggaagttgcattgcagagagacttgaagagacatgacttgggacaaaatagcaccaaagtggtcgggtacagtagctcatgcctgtaatctcagcactttgggaggctgaggtgggaggatcacttgaggccaggagttcaagaccagcctgggcaacataccaagaccctgtctctgccaaaaaataaaaataaaaaaaattacccaggtgtggtggtgcacacctgtcatctcagctgttcaggaggctgaggcaggaggcttgcttgagcccaggagtttgaggatgcagtgagctgtgattgcgtcactgcactccagcatgggcaacagagcaagaccccatctcttaaaaaaaaaatatggcattttaggtgtcagaaacgggagaaccatgtcctgtgcttgctcaggttgtaaatctggggttaattagggatccaggggagattaggttgttgaggctggtctgaggcagtaccagttgtcaggagagccaagaaggcagcctgagggcttaaggttgaacccatctctgctaagtgccccaggcaatgcagaggcaggaaggggaggggtgcagcaggagacaggaggcaatcaaccgcacctggcgggatctgaacagtggattggagcagaggggcagggcccaggtcctccggtggcctagctctgtggccctgggcacaccattcccacctccgagcctgcatccccacttgtgaagtggaagagcagctcctgtcctgccctcctcatggggctgttatgttctgcagagggcagggatgcggggttttcgggggaagagctgcaatgtgtgaaacagatgtacaaagctgtccatgtgtcctctcctttactcaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggtaacattgctgctgggatctccaagtctagggggtgggacagaggtcactcatgcaggggacagcctcccagggcaggtcaggatgcctgggccctcttaggttggaaggagccatgtctgggcatgggagtgggactggacagatggtgtcctggctgagacccccttggaccttgggtctctgctcagccatctgtgaatgatgtccttggccttggactaagaggacgcctgcgaggactccctgggtcccagctactcgggaggctgaggcaggaggatcacctgagcccaggagtttgaggctgcattgagctatgattgcacacctctgcactccagcctgggtgacagcacagctctgtctcaaaaaaaaaaaaaaaaaaaaaaaaaaaaaagcaccagcgatatttcaggtgtcaaaggtgggagatccacatcacgtgctataaaggaagtaagcatactagtcatcctcatgcattccatgaggacccattccaactgaatgagcacccactgcatacccagcctgattaagggcactgggggaagtaggtcctggaagtaggtcctggggtgaacaggacaaaaggaacaactgcaggtgaggagcacctggattcatatcctggctcctctacttagtggctaggcatcctggggcaaatctctactctctgagcctcagtttcttcctctataaaatggggatgctagtggtacctgcttcccagaagtgttatcatgattaaatgacagatcggtggcagtagcatctcctgagagagggttagaaatgcatattctcaggcaccactgcagtcttgctgaatctgaagctttggggatgggacccggtagtctttttggataactctgccaagtggttccaatgtgctcaagtttgagagttgctgaattaaagcgctgggtcttgccaggcatacctgtaattccagctctttgggaggctgaggtggaaggattgcttgagcccaggagttcgagaccagcctgggtaacatagcaagatcctatctctaccaaaaaaaaaaaaaaaaaaaaagcgtttgggtctaatgcttggcctgtagtaggtgcttgtaagttatatatactattattattattattattattattattattattattattattattataagggggaaaaaagcccaaatatgtgggctgaccagggcttcgaacttatacatgtaaaacaagtgttcttacctggaaaaggtaacctccgacatccctttcttgttaacctggctttcggctagcagattctggtgcagaatgtcttagacctctggtcaggggccttgccttgagtttgtgatcacaggaatcagttattggatgtccctggcagatgaggctgttaccccagagccagggcctgtgcactggggccagatctggggaaccctcttgggtcccacctggaaccttcttccttctctcccttgtccaggacagaagcccactgggcctggtgggcctctcatccagaacgtccatgcctccaagcgcattctcttctccatcgtccatgacaagtcaggtaggacagcgcccacgaagcaccccggcctgagtgggaatctgaggttggaggtggtgcttattgaaatggaagtgtatctcctgggtctttgtgaaagaaaggaggaacagctctgctcaaggggctgcaagtaaactggggtgtaatagttatctattgctgtgtgataaactaccccaaactaggcatggtgtctcatgcctgtaatcccagcactttgggaggctgaggcaggagggttgcttgaaaccaggagtttgagaccagcctgggcaatgtagcgaaatgctgtctctacaaaaaataagaaaaattagtggatgtggtggtgcctacccgtagtcccagctacttgggagactgtggtgggaggatcacttgagcccaggagttggaggctgcagtgagctgtgatcgcaccactgcactccagcccgggcaacagttagaccctatctctaaaaaaagttgtaacaaaaaataaaataaataaccccaaaatggagcttaaaacatcaagtgtttattacctcacagtttctgggggttgggaattcgggactggccgagttgggcagtgctcggtcagggtctttcatgaggatgcagtcaaaatgttggctggggctgctgtcatccaagagctcaactggggcgggaggagacgcttctgagctcattcacacggctgttcgtaggaggcctcagtcccccaccatgtgggctagccttgacggggctgcttgagcatcctcacaacatggccactggtttcctccagagttattgatccaaaagagaggaacgaggaagccacgtggcttttatgacccatccttagaaattgctgtcatattctatctgttagaagccagaaacatgatccagccttccctctgtgggagaggaattaaactccaccttttaaaggcagtgatatatttaaaaaaaaaaaaaagtggacagatttttaaagtatcacacagaaggcctgagtgtaggaaagtttgggattcagttataccaagaaggaatgcagtaggacttgccagcagttttgctttgagggcctcagcctcacctccaggaaaaggttctgtaagaaaacccagtcctaggccaggtgcggtgactcacacctgtaatcccagtgctttgggaggctaaggtgggaggatggcttgaggccagaagttctagaccagcctgggcaacttagtgagaccccatctctacaaaattttaagaaagaaagaaaacccagtcccctgggatcagaatggaggaccctcccccccaacaacaacccaacctgtcactgccccaaacaaggtccagccctggcagggaggagatgtgaatgtccagatggaacagtatcatgacaggcccatgggccagggacacaagctgggatagaatctcactgggttatcacaagcaagatactcagtttctttgagcctcagttttcctatctgcaaaatgggactaatatctctgtttaaaacttgtcataaggaattaaataggatattattatatatataaagtacttagcacagataagcacttaacaagttaaagttgttacttttactgattataaatgaaccaatgatcacttgttattattcaatcaagacagaggttttgagagagagaccagcagagctgagagtttgggggaagccaacaaggccagtgctgagtgagacctcagatgtaggaggtacaagggttagattctcaagatcaagactcagcccttagccagacatggtggtaggcacctgtagtcgcagccactcaggaggctgaaatgggaggatcgtttgagtccaagagttggaggctgctgtgagctatgatcacaccacagcactccagcctgggcaacagagtgagaccctgtctgtaaaaaagaaaaaaggaaaaaacacagccaggagtgttggctcatacctgtcatcccagctgcctggggggccgaggcagagggatcacgtgagcccaggagttcaaggctacagtgagctatgattgcaccactgcagtccagcctgggcaacagagtgagaccctgtctctatttttttaaaaaaatttaaattaaaaaataaaatactcgacctcaggccggacttggtggctcacacctgtaatcccagcactttgggaggccaaggcgggtggatcacctgaggtcaggagttcgacaccagcctggccaacatggtgaaaccccatctctactaaaaatacaaaaataagccaggtgtggtggcaggtgccctgtaatcccagctacttgggaggctgaggcaggagaatcgcttgaacctgggaggcagaggttgcagtgagctgagaccacgccactgcactccagcctgggtgacagagtgagtcaccatctaaaggaaaaaaaaaaacataagactcgacctctttttctgctgaagggactgctcttccagcctcctgtatgtctggggcaggatgggctcgggatggacaggctgagcctgttctgacaccacacccgtgggagaggccagagacaaatgttagggcaggaacgggcagacgggggaccatcagagcaccctgaattcgtgtatggtccgaggtgggagagggtggaaggactgggggctggggccggcctcgggggctctgggggtgaaagcccggtggtcatggccggtggagggcgtgtgaccgtcccgtggggccctgctcacttgtgcctcctgtgttttgatagagaagtgggacgccttcataaaggaaaccgaggacatcaacacgctccgggagtgtgtgcagatcctgtttaacagcagatatggtgagtgggcggcgcggcccgccgtgtggccccagcagccgtgttgagcatctcattacgtggcaatcactcgtgttccccaacacggcagcgggagccatatgctggctcccgcgcgccggcaccgctaatgtcatccgtcgcgggctcctcctgtctgggtagggggtggttgtgtcaatatttcccttccagattcttcagggggcggaactgatggcaaagccccagacctgggctcagtggcggggagcgggacaggttgggggcagagattacccatctgggggccgggcgcagtggctcatgcctgtcatcccagcactttgggaggccacggtgggaggatcacctgaggccgggagttcaagaccagcctgaccaacacagtgagacctcccatctctacaaaaacaaattttttaactaggctgggtgcagtggctcatgcctgtaatcccagcactttgggaggcagaggcaggcggatcacctgaggtcaggagttcaaggccagcctggccaacatgccagaaccctgtctctactaaaaatacaaaaattaactgggtgtggtaatacacgcctgtaatcccagttactcagatcctgaggcaccagaatcactggaacctaggaggtgcaggttgcagtgagtcgagatcgtggcattgcacttcagcctggtgacacagtgagactctgtctcaaaaaatataaataaatacaaattaaaaattaaaaaattaaccacacacctgtggtcttagctacttgcaggctgaggtgggaggattgcttgagtccagaaggttgaggctacagtgagctacgattgtacccctgcactccagcctgggtgacagagcgagaccctatctctacaaaaaaacaaacaaaacagattgcccatcaggggaactatccataaggcccagaaaaatctctgttggcctcatgtgcaagtcccccacagtaacacaccatttcccacctcccagctttacctgtgctgtgccctctgtctggcacagtcttttcacattttagggacaaattcctaattgttctttgagactcgtcttgggagtcacctcctctaggaagcctttgggtccccagcctgggccaggtaggcctgggtaccctgatggttccctctctgtgacacattgggaacttgacgccccctgcctgccgctgtctccctgagggccaggactgcacccaacccctctctttgtccctagcacccaggacagagtcaggctcatagcagatgtcagcccaccgcactctggaaagaaaacacaagtggtaggcgctgtggctcatgcctgtcatcccagcactttgggaggccgaggcaggtgaatcacttgagctcgagagttcgagaccagcctggccaacatggtgaaaccccgtctctacaaaaatacaaaaattaactgggcgtggcatggtggcatgcacctgtaatcttagctactttgggaggctgaggcagaagaatcacttgaacccgggaggcagaggttgcagtgggccgagatcacgccactgcactccagcctgggtgacagagtgagactttctctcaaaaaaagaaaagaaaatcattaaggaaagaatttaaaaagaaaaaaaaaagaagggaggataattccaaggaagaaacagtctcaataggctgggaagtcaggggtggcttcatggacgaggtgtcttgtgaccacgtctggggcagcctctgcgtgtgggctggaccttccacattgacatggggctgaacaagactctggaggccttagtgaggagcctgggatagccagctacctttgatgtggccaccctggcccagccacgcctcctcactcctcagagctgcaaagggctgtctgcacctgcccctgagtctctccccgccccaggcaggtgtgagccaggcggaggttgggggaggggaaccagggaggagccggctctgcctgccttgggagggttctgcccaggccagtgttctggcctgtcccacgctctggactttccaaaatgccaagccttttccaaatgtcagttcctgagtcacatccaaagagtgttgggtgtggagtggtcaagatcttgttccccataaagccggagctccctctggggagctgcgtgggggagaaggcagctgcccagtactggggaccccacgggtggtggggacggggtctggcagcccaaggcattccactggtcgtgggtgagcaaaccctgctcccagctctaccagccaccaaatctgggtgaattgggccagtgacagtgtgggtggtacaaaggaggaagaaacagaaaaattagaattgggggaaacattaggcttcaggaagtctcgaggacatgtcctctgggatgatgctgggaccaggtgaggggccgaggagggtgcatggtggcactgcatgaaggcagccccttcccaaggggcaacagcagggttcgggggttggccctctgtccactgaatctccccagtgctgaaaagacaagccccaataaaccagatgaaccagacggagacaaattcacaggcactcaaaggaccaattgctcaagggctggggctgggggtggctgctgatgtgggaggtgggggggaagtggggagagatgctttgccagctgttgagatttcgaaggtttcatttgacaacgagctaagtgtgacatctcagtgggatctggatgccaaagccgccaacgcagacctgggccgctgcatcaacaggaaaacagtgtcagaggcacccaagggagggcccaagcagggctggagggaggtccagctctgggctggcacttacaggaacacagacaaagcatagtgtggccagagaagcagggctaggacagggaggggcctgaggaacagccaggagatatgggagcctggagggaggacagtgtatcgaggccccgtccatggtcatacggggaggcaagagtgaagtggatactcaggtcaggggaagggtgacccatgaaagtacttgcttaaggccaggagcggtggctcatgcctgtaatcttagcactttgggaagctgaggcaagaggatcacttgagcccaggagttcaagatcagtctgggcaacatagcaagaccccgtctcttcaaaaaataaaaaagtaaatagctgggcatggtaacacatgcctgtagtcctagctactcaaaaggctgaggtaggaggatgactttagccagaagtcgaggctgcagtgagcaatgattatgccactgcacttcagcctgggctgttagcaagaccctgtctctgaaaaagaaagaaagaaagtaccagcttgtattaggaacatagtaggtgcttaaaaagtatttggtgtggggccggggactgtggttcactcctttaatcccagcactttgggaggccaaggcaggcggatcacctgaggtcaggagttcaaaaccagcctggccaacatggtgaaaccctgactctactaaaaatacaaaaattagctgggcgtggtggcacacgcctgtaatcccagctactcgggaggctgaggcaggagaattgcttgaacccagtcagggagtttgcagtgagccaagattgtgccgctgcactccagcctgggcaacagagcaagactccatcagggaaaaaaaaaaagtatttgatgaatgaattaatgaaaacgtgtagctggggtcgaagtgaatgactgaaatggcacaagtctgggaaaacagagcaagtagcctgggcatgagcctggattctgtctgcttggctgttggcagagccgtcagcttctggggtgtgttttgtttatggcgctggtgaatgaagggcgtgccaagctcctccctggaagaaggcacacacctgtgctcacctgtgcaactactcgcctgccaggagctaatctcaagcttgggcacttcctttagccatttgtatattcactatgcagaaagcacttagtgtgtgcccagccccattgaggtcgcagtggcaaggcagaaaacaaaacccctactctttttcagacagtctcgctctgtcacccaggctggagtgtagtggtgcaatcacagctcactgcatcttcgaactcctggactcaagcgatcctccagcatcagcctgccaagtagctgggactacaggcccaagcccggctaattttttgtatttttatagagatggcttcttactgtgttgcccaggctggtcttgaactcctgggctcaagcatttcccaacaactgtagccttccaaagtgctgggatgacaggcatgagccactgcacctggccaaaacccctgttcttatgcagcttcctttctagacagtacacatagagatgagtgtggatgtagtgtcaggtgatgaccagtggatgacagacacagcaggggagggaatgagggatggaggaggctgtgttaggctgccaaagtgctatttgagcaaacacctgaaaggagggagggagggagggagggaaggaaagatgggtggatggatggatggatggatggatggatggatggatggatggatggatgaatggatggatgggcagatggatatacagccgggtgggtgggtgggtggatggatggatggatggatggatggatggatggatggatgaaaggatggatggatgaatgggcagatggatggatggatggatggatggatggatggatggatggatggatggatggacggacaaccgggtggatgggtggatggatggatggatggatggatggatggatggatggatggatagacggatggatggatggatggatagacggactgatggatggatgtttatggatttctaggagaaagggatctgagcagacagaagagcaggtacaaaggcattgaaccgagtgtatgctcctggcctgtaggggaagcaccaagggggcggcaggggtagggggagcacacagaggcatgaagggggcagatgaggccagaggtgatgaagtcacatacgtaggactttggctgtcaccaaatgagatgggagccactggacattttttatttttattttttgagacagggtctcactctgttgcccaggctggagtgcagtggcatgatcttggctcactgcagcttcgaactcctaggctcaagtgattctcccacctcagcctcccgagtagctgggaccacaggcgtgcaccaccacacctagctttttgtattttactttctgcagagatggggtcttgctgtgttgtccaggctggtcttgaactcctgggctcaagccatctgtccacctcagcctcccggagtgctggaattacaggcatgagtcaccgcacccagcccagccaatttcctaacagaaaagtgatatgattttgacatttctgcaggatccctctggccgctacatggccagagtggagtggggacggtgggaggtgatggggaccgcagctcccgggtcctgtgtgtccagcagcctgtctaacactcagccttgctgtttggttgtctttccagcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggtgcgggtggggctgggcgcagtggctcatgcctgtaatcccagcactttgggaggccaaggcaggcagatcgcttgaggccaggagttcgagaccagcctggtcaacatggcaaaaccccgtctctattaacaatacaaaaattagccaggtgtggtggtgggtgcctgtaatcccagctacttgggacgctgaggcaggagaatctcttgaacccgggaggcagaggttgcaatgagccaagatcatgccactgcactccagcctgggtgacaaagtgagactctgtctcaaaaaagagaggtgcgggtgggcgtaggggtctggccttctgctccgggcttggcttgggctccgggttttggggcatgtgggctaagcaggggcctggggaggcaatgatggggcaggggcagaatgaatgggttctctaacttaacacagagaataagacgagtctgagagagaattctgttatagctccttgtgtagctgtgtggcctattccttctgggccttttgaggattgaatggaaaatgcaggcacggtgtctggcctaatcaggcactttgtaatttttttttttttttttttttgaatagagatgggatcttgctatattgcccaggcctgcatagcctgagtgtcagagcaaggccctgtttcttaaaaaaaaaaaaaaaaaaaaaaaggcggcaggggtggggggaagggacaatgatggcccccccgacccaagttttcctaacataaaatgaaaaagtggatgaaacacacctgacatgtagcagatgtttaataagcatgaggtgttttttcattgtccttatttcccttgtgaattaaaacatcattaagtgcatcggtgcacctgaagacatttccgacctgggcgtccttgggcaagttacttaaccactctgtgcctcatttacataaaccaggcctgataccagcccaggcaacatggcgagaccccatctctgcaaaatatttaaaaagttagccaggcatggtggcaggtacctgtagtcccagctacttggaggctgagatgggaggatcacttgaccacaggagttcgagactgcagtgagctatgatcgtgccactgcactccagcctgggtgacagagtgacaccccatctcaaaaaataaaaaataggccaggcatggtggcctggattacgcctgtaatcccagcactttgggaggccaggatgagtggatcacctgaggtcaagagtttgagaccagcccggccaacatggtgaaactccgtctctactaaacatacaaaaattagccaggtgtggtggcgcacgcctgtagtcccagctactcgggaggctgaggcatgagaatggcttgaattcgggcgacagagattgcagtgagccaagatggcacaactgcactccagcctgggtgacagcgagaatccatctctaaataaataaattaaacatagaataaccaggcctgataattgtccatgcctcatagtgttgatcggagagtaaattaccagatgtggatgaaatgcttagaacagtggctacagcttcagagcctccaagtacacttttttctattacacaccccagcctcatcatttaaccatctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaaagtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggttctagctaagccagaacttaggaggagaaagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataataaaactgcaggctgggcacagtggcttacacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggagtggggcctccagcgtgaaaacagaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcatttttttttttttttttttcagatggagtctcactctattgcccaggctggagtgcagtggtgctatgtcggctcactgaaacctccgcctctcaggttcaagcaattctcctgcctccgcctcccaagtagctgggattacaggcatgcaccaccacacctggctagtttttgtatttttagtagagacggggtttcaccatgttggccaggctggtctcaaactcctgacctcaggtgatccacctgcctgggcttcccaaagtactgggattataggcttgagccaccacgcccggctggttccatgcatcttacctggatgacttgggtccctaaatgggcccctgggtgcccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacaaggccaggcacagtggctcttgtctgtaatcccagcgctctgggaggctgaggcaggaggatcacttgaggtcaggagttcaatgtggacaacacagtaagaccctgtctctacaaaaaaatttaaaacttagctggcattggtggcgcatgcctatagtcccagctacttgggaggttgaggtaggaggatcgcttgaacccaggagttcaagtctgcagtgagctatgattgcaccactgcactccagcctgggtgatagagcaagaccccaactcaaaaaaaaaaaaaaggatcccacggttcaccttgtgctgccacgatcggttggcagctctgctctgtgccgtcctgtgcctgtcactgagtaagatgcaggagaagttgggcaaaagccctcaggataaacgaataagtcattcagagtaggtgctggtgggaaatgggcttgagtcactcacctggggccagaagaggcccccagggagttgtgagcagattagaccctccaagaccgccccaggggttggcccatgctttccctaactgtgcaaaaatggtttgggataggctgggtgccgtgggtcacgcctgtaatcccagcactttgggaggctgaggcaggtggatcacctcaagtcaggagttcgagaccagcctggccaacatggtgaaaccccatctctactaaaaatacagaaattagctgggtgtggttgcacacgcctgtaatcccagctactcaggaggctgagggaggagaatcccttgaacccgggaggcggaggttcatggggaacccagcaggaaattagaatagaaccaaaaacgccagtcatgggaggcagagctgggggagcgaggctgacaatgactcctgttttcacgctgagagaccccactcccctgctgagatcgcgccactgcactccagcctgggcgacagagcaagactccatctcaaaaaaaaagttaattaattaattagattaaagtacaacaattagcagggcatggtggtgcacgtctgtagtcccagctactcaggaggctgaggcagaagaatcgcttgaaccctggaggcggaggttgccgtgagccaagatcgcaccactgcactccagcctgggcgacaaagtgagactctgtctccaaaaataaaaataaaaataaacggtttgggatgttctgaggttccagacatgccctctcctgcctgcatgtctgccggatgcccaggtctgtagctgtgcatgtgtcactcagtgaccatcaccaaaggggactggaggcatctccccgagccctgggagagtcctccagcctgcactgttctcatgcctgtctctcttctctccccaggatgtttgatgagcgaattttcacaggtatgtggggaccatctagtccattctgaagtttccggattggttccccaacagaacccgagctgccaccaccctggacttggtcctcctgagcgcctcccctcaggcagggagggaggctgggctgtggtttctgtgtcctgggacagaaatgggtcccaggcttctaggtgctgacagactgtcaggacaacccctcccagcttcaaatgccctggacagagagtactaaagctggacgctaaccggtgccaggttggtgaacctgagcctgtgccaggctctctttgaagctgccagcatattttattttaatctgattccaacaatcctatgaaggtggctccactccactactctcacgtgcagacagaggaacggaagcccagctggtgagcacgggtccctgctgcatgcccagcagtgtgactccagagcccatgcagtggcccgtgggccagcacacctgtcccaggaggaagatgcgggctcttcccggggtagcaaaagcatcacggttcttggggtgatcctggcaccccagttccggtcccgcctcccaccagctgtgtgactttgggcaaggtcttgtgggcttcagtgtccacgtctgtgagatgaggataagggcgccttcctctgggctcctggcacgatgacatgagagcctggtcttgtgatgcagccatggggaagccccggcccttttctgagggctcagcccccatagtgtgttggagggcaggagaaccatctctggttgctgcctcccattcctcctgccccttgctctcccaaatctctggccacctctggcactagggctgctgttcctccttctggcgtcagagtctctccccaggacccgttcctggctgttggctggacgtggcgcccacaaggacaggcagaggccaggccctatccccgggattcccccagcttcacacacagacctttacccaggggctctgcagcaagaggaggccagagggccttcaccctgacctccctgactctccccacagggaacaagtttaccaaagacaccacgaagctggagccagccagcccgccagaggacacctctgcagaggtctctagggccaccgtccttgaccttgctgggaatgctcggtgaggccccgcccctggccccggaggcccgcggccagccctgctctgggctgaggcagtgttacctgcaagggggtacccagggcggctcccaccacaccaccacccctcgaaggtgcaaagggagggcaagggaaaacagactccacctacttccctctgcctagagaactctcacatagagaactctcccgcccccaacatctagccagatgtcacctctctcagaagcctctaaatgcccacactaggccaggtgcggtggctcacacctgtaatcccagcactttgggaggccgaggcgggcggatctcttgaggtcaggagttcgagaccagcctgggcaacatggtgaaactcccatctctactaaaaacaaaattagccgggtgtggtggtgcgcatgtgtaatcccagctactcgggaggctgaggcaagagaatggcttgaacctgggagggagaggttgcagtgagctgagattgcactactgtactccagtctgggtgacagagcaagactctatctcaaaataaatacatgcccacaccaggccggacttggtggctcactcctgtaatcccagcgctttgggaggctgaggtgggtggatctcttgatcccaggagtttgagaccagcttgggcaacatagtgagacccttgtctctacaaaaaataaaaagttagctgggcgtggtggctggtacctgtggtcccagctacttgggaggctgagatgggaggattgcttgagcctgggaggtaaaggctgcagtgagctatgatcgcaccactgcactccagcctgggcaacagagtaaagaccttgtttcaaaaatacaaacatgcagctgggcatgatggctcacgcctgtaatcccagcactttgcgaggctgagccaggcagatcacctgaggtcaggagttcgaaaccaacctggccaacatggcaaaaccccgtctctactaaaaatacaaaaaaaattagccaggcgcagcggcgcatgcctgtagtcccagccactcgggaggttgaggcaggagaatcgcttgaaccctggaagcggaggttgcagtgagccaagattgtgccactgcactccagcctgggcaacagaacaagactccgtctcaaaaaaaaaaaacaaaaaaaacatggatgcatgtatacatacctactacatgcatacatacctactacatgcatacacacctacctacatgcatacatacataccaacaccaggtctgatgcctgtcctgagtgcccaccagaccctgcccccagcactcagcttggctaccatccaccaacaccccccaagcacattctgacctcttaggggcaggggtgggccgtttatcccagaatccccacatcatatcaggcctctccctgcagttccctgggagggagggaattaaccaaatcatctgtcccagggttcctgccaccttcattccccagccccttccccagatttttaaccctttccaggccctgcaggtctcagtcccccacaagcagtgatcaaacccccagtgtgccaagcctaggatccccagagctcccagatggtgaagaagggggatccccagatggttcaccccaggagagtgagcaggtgcctggctcggccacccctggagattgtggtccctggagacaagacacggggaatctgtcttcctggtggaggtggggagcaccatcctggagggccaggggccgatggggacagggatgccttctgcagtggcgcccgcggtgggccctgactgcctggaggggcaaggctggggcagggtggccctggacttggctgacaggtgtcatttcctgcttcccttcacaggtcagacaagggcagcatgtctgaagactgtgggccaggtgagaaggaacagggcccgctgtgtgtgtggtgggccgggagggcaaccaccagccctacccggcagccttggggaggagctcaactcagcccatgagcctggagtgctaacgagcctcctctgcccacctgcctccactaggcctcgcagagctgaggtgcaaggcatgctgggagcttactggggtcagggacatggagagctgggtgctggcatcaccactgcctcctgtcgatgcccagacccaggctgcaggttcttggaccagcagcctcccctctggggggcctcagtcaccgggtctgtaaatcggagcccctaagcctggcctgagggctcccctgacctccaattccagtttgggcggagccagggggctgacatgacttgtcctaggtagggcctcactaacaagttacagacaccagaatgttctggaaagagtcactctgcccagtcgggatcatgccagacttgacaggattcttcctttcctccttgcaggaacctccggggagctgggcgggctgaggccgatcaaaattgagccagaggatctggacatcattcaggtcaccgtcccaggtaagggacgggcatctgaccaccccctgcagaaatcagggccggaccgttagcctcctgagggtctgccctggtgaagaagtggcctccaggccgctgtttctctctgtggattctgagagccatcggggtactgtgaatgctttttctggccacatctgtcccctgcgttgtgaatcagtgttctcagctctgaccttccagaaggtcccctcaaaacttcacctccctggcttggcttccctgggatttgtgaggctggacagaagaaaaagccatgggtgtgagaggctctgagtttgaccctaccccctgccaagcctcattttccacatcttcagaggagaggatagatttgggcgctggagcctcagtacggggtgactgttagaagccaagagggtgctgggcacagtggctcatgcttgtaatcctggcattttgggtggctgacacgggaggatggcttgaggccaggagttcaagaccagcctgggcagcatagcaacacccacatctccacaaaaaatacaaaacattagccagatgtggtggtgtgtgcctgtcggtgtagcttctcaggaggctagggcaggaggatcacttgagcccaagagttggaggctgcagtgagcagtcatcccaccactgcactccagcctgggcaacagagcgagaccctatctcaaaaaaaaagaaatgactgggcgcagtggctcacgcctataatcccagcactttgggaggccgaggcgggcacatcacctgaggtcaggagttagagaccagcctggccaacatagtgaaaccccatctctactaaaaatacaaaaataagccaggcatggtggctcacgcctgtagtcccagctactcaggaggctgaggcaggagaatcgcttgaacccgggaggcggaggttacagtgagccaagatggcgccactgcactcctgcctggacgacagagtgagactccatctcaaaccaaaaaaaaaaaagagacagaaagaaaaggacccttgtctgtggggagactgggctgggtgggccctgagggactgtgacaggagtatgacaggcagaagatacccgtgtcattcggagttttgtcttcagacccctcgccaacctctgaggaaatgacagactcgatgcctgggcacctgccatcggaggattctggttatgggatggagatgctgacaggtaagaaatggacctgggctggtggtgcttgggactcagctctccagggagcaaagggaaaggggtgggccaggccgtccccaggtgtttcttggtgtcagccgtctgtagtagaggaaacccaatatatgcctgaccctaatccaaggctgggttccttttggaaacctcaagtaggctctatttatttatttagagacggagtttcactcttgttgcccaggctggagtgcagtggcacgatctcggctcaccgcaacctctgcctcccaggttcaagtgattctcctgcctcagcctcctgagtagctggaattacaggcatgtgccaccatgcctagctaattttgtatttttagtagaggcgggctttcgctatgttggtcaggctggtcttgaactcccgacctcaggtgatccacctgcctcagcctcccaaagtgctgggattacaggcgtgagccaccgtgcctggccataggctccatttataacaaggcccagcgtccttcccaggagccacctgttggaattaatttgtccatttatccaacaactatttattgagcatctgttgtgtaccaggtcctgtgtaaggggctggagacaaagcagtgaaccaagcagaagtccccacctcctggggtgcacatcctcatgtgaagagatagatggatagtacgcaaataagtaaaataggcagggtaaggtggctcgtgcctgtaatcccagcactttgggaacccaaggtgaggggattacttgaggctgggagttcaagatcagcctgggcaacatagagagacccatctcttaaattttttgagatggagcctcactctgtcacccagactggagtgcagtggcgcgatctcagctcactgcaacctccacctcccggcttcaagcagttctcctgagtagctgggattacaggcgcccgccaccacgcctggttaatttttttgtatttttagtagagacggggtttcaccatgatggtcaggcaggtctcgaactcctgacctcaaatgatcctcctgcctcagcctcccaaagtgctgggattacaggcgtgagccaccacaccttgcctcaacaaatatttattgagcacctgctatgtactaggtcctgcgtaaggggctggggaaaaagcagtggaccaaacaggtgtccccacctgctggggtacacatcctcgtgcggagagataaacagtaagcaaataagtaaaataggcagggtgaggtggctcacgcctgtaattccagcactttgggaggccaaggcgagggtactgcttgaggccaggagttcgagaccagcctgggcaacatagcaagactccatctctaaaagatttttttttaattgactgacacagtgtctcacagctataatctcaacactttgggaggccaaggcaggaggattgcctcagcccaggagcttgagaccagcctgggcaacatggtgaaaccctatctctacaaaaaatacagaaattagttgggtgtggtggtgcgtgcctgtagttccagctacttgggaggctgaggtaggaggattgattgagcccaggaggttgaggctgtggtgagccgtgatggtgccactgagtaagaccctatcttaaaataaataaataggtcaggtgcattggcttacaactgtaattcaccattttgggaggctgaggcgggcagatcacttgaggtcagagttcaaaaccagcctggccagcatgatgaaacccccttctctactaaaaatacaaaaattagctgggcatggtggcgcatgcctgtagtcccagctactcaggaggctgaagcaggagaatcacttgaacccaggaggcagaggttgcagtgagccaagattttgccattgcactccagcctggacaacagagcgaagctctgcctcaaaataactaaatagatagatagatagatagatagatagataaaaattagacaggaacggtaggacctatgtgtagtcccatctactcaggaggctgaggcaggaggatcctttgagcccaggagttggagcctgcagtgggctatgatggtgccactgcactccagtctgggtgccacagcaagacaccatctcaaaaaaaaaaaacaaaaataggctgggcatgaagaattgcgtaatcctagcactttgggaggccgaggcaggcagatcacctgaggccaggagttcaagatcagcctggccaacctagtgaaaccccatctctgctaaaaagaccaaaaaaaaattagctgggcatggtggcaggcacctgcagtcccagctacttgggacactgaggcaggaaaaccgcttgaaccttgggaggcggagtttgcagccgagatcacgccactgcactccagcctgggcaacagagtgaaattctatctcaaaaacaagcaaacaaaaataggcaacaaggcaggatgcttaggatgtaacactaagcaaaagaggaaaaattgattgtgctttgcttacaactgtgttgcaaacgtaatcactggggacaaacaagggtagagcaaaacagtagcagtgttaggcaaaatgatttgcgttttttattttctaaatcagttatgatgcacttctaatactttggtaatgaagaaaaaaatatgatttgtccagcacaaactgggcatgaccagacttgacagcagtctgtggcgtagctatccagagagtttggttgacgccaagctcaggctgagatgacagcatggcgtggcgcctaaggaattggcacggtgcccagctgggtttgcagtggccttagaaaacaccatagaagcctccatgcagcactcacagccagaggctgggtggcactgcaggggttgggggccttggatgagcacagcatcattgctgtttgtttcacagagcagaacacaggctcagcaaggctcatccacctccccaaggtcacacagccttgggctggaaaacatgtttcccatgcagggttccttcccaggcaccccagtcaaacctgatgaattaagaaaattctggctgggtgtggtggctcacacttataatcccagcactttgggaggccgaggcgggatcacctgagatcaggagttcgagaccagcctgcccaacatggcgaaactccgtctccactaaaaatacaaaattagctgggcatggtggtgcgcacctgttatcccagctatttgggaggctgaagcaggagaatcacttgaacccaggaggcagaggttgcagtgagccaagatcgcaccattgcacttcagcctgggtgacaagagcgaaactctgtctagaaaaagaaaaaaaaagaaaaagaaaattctgatggtagtcacatctgtaatcccagctactcaggaggctgaggcaggagaatcgcttgaacccaggaggtggaggttgcagtgagctgagactgcaccactgcactccagcctgggtgacagagcgagactctgtctcaaaaagcacaaaacaacaacaaaaaaagaaaattctgagatgtccaggaccaccatggattagaggattttgcatttgtgtgctttttctgtttacacatatttgatatgaaacagttaaatgatacagaactgtgtaatacattgagcaggtgcagtggctcatgtctgtaatcctagcactttgggaggccaaggtgggaggatcgcttgagcccaggagttcgagaccagcttggacaacatggcgaaaccctgtctctacaaaaaattttaaaaagtagccagccgtggtggtacatgcctctagttccagctattgaggagactgaggcgggtggatcgtttgatcccaggagtttacaaccagcctggggagcatagcaagaccccatctctacaaaaaaaaaaaaaaaaaaaaaaaacaattagctggatgtggtggtacctacctgtagtcccagctattcaggtggccaaggagggaggatagcttgagcccaagaggttgaggctgtagtgagctgtgattgctccactgcactccatcctgggcaacagagcaagacccaggaaaaagctccagtcacatcctcctcaggcaaccactagtattcctagcatcttccttttgtatgtttttatctatgtgctaattcatgtgatgactattttaaacaaattgtcccttgtattctcacctggaagtttttttgtttgtttgtttgtttgtttttgagacggagtctcactctgttgcccaggctggagtgcaatagcatgacctcgctgcaacctccgcctcctaggttcaggcgattctcctgcctcagcctcccgagtagctgggattacaggcatgcgccaccatgcccagccaatttttgtatttttagtagagacagcatttccccatgttggccaagctggtctcaaactcctggcctcaagtaatccacccatctcagcctcccaaagtgctgggattacaggtgtgagccaccgtgcccagccgaggactttgtcttgttcccacgtgtcctcagtgtctagaacagactagcttgggaggtgcatgcaaaatgatctcagcctgctttcgtgtgaaggccagggtaggcacctgtatggaatcggggtccctgatcccattggagtgggtgccatgcttcagagttggggccccctggcctgccattccccagctatctggcctgacgtcggcagtgcatggcttaggagatgatgaatgtggcttcccggcatcctctgttctcttttagacaaaggtctgagtgaggacgcgcggcccgaggagaggcccgtggagggtgaggccctgtctacccctgacattttacacccacccccaccccatctctcttcccctgccgcccacctccccttggcctctgggtctcttcgttctctccacctcatctctctccagcaccctggtgtgggggtgggaatcctgtgggctgcctgatatgggaggagatttaaggatttgtcttctagaaccaggaagttcctggtcaaaggtgagagcagttcccactgctaaggaaaattgcaagcctttgtttttattacacaccctgctgctttgcgcaaaggttttaagactgggaactgagcctcctctatctgagcaagtagattagaggcctgaaagcacaaaatttgctttgtgtccagcagacacgcccattctcaggaacgtgagaattccctccctgctgagaatggaagtaggacagagagagagggaggccagggtgagggtgggtctgtttcatctctgtagtatcctggaatggaatgagtgagtgtcagaggagagaattgtcacttccccaaacccagcctggcaggaggaaccatgaagtcttaacacagttccgctgccacctggtggcagcctgctcaatttgcaggcttagtgggtacccactagttctatcacatgctacactcagtcacatacctagaaagacccatggtcactcctagtccacagaaccttccaaatcttcattcaggctggcggtgccctagatttgatttcgcaaacaagaatgtgagcccaggaattgtggacctgtctgcgtgtgccatttctgaggaaataagttacccaccgccccagccccagccttcccccattccaagatcccaccacagggccaatgttggtaccagcagagcaggaacatcagccgagaagctgccaccaaccagcctcaacagactgccttttgccttccagacagccacggtgacgtgatccggcccctgcggaagcaggtggagctgctcttcaacacacgatacggtgagcaagaagtgggacagggtctgggggcatcccggcccccctccagccgccctgtttgcagaagggctttggtcgcatccccttgcctgttcccatcccagctgttctctgggcagggacaagggagagagggaagggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctaggtgattccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgaccttaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacaggggttgaggctcctggccctgtggcaccgggtggccctacagcagccatgtctctgcagccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggtaaggcccaaccaggtccatgggagacagcaccggccctgctcagcaccaaggggcaggagcagcaccaaattgccatcaagcaattcttgtgcctcagccacctgaatagctgggaccacaggtgtgaggtgtgtgccaccatgcccagcctttttttttttttttttttttgagacagagtctcactgtctcccaggctggagtacagtgatacgaacttggctcactgcaacctccgctctggcttcaagcgagtctcctgcctcagccccttgagtagctgagactacaggtgcgcgccaccacgcccggctaatttttgtatttttagtggagacagggtttcaccatgttggccaggctggtcttgaactaccaacctcaagtgatccggccacctcagcctcccaaagtgctgggattacaggtgtgagccacggcaccaggcctttcttttctctctctcttttttttttttttttttttttgacagcaaggtgttagatggggtttggctgcagttggcagacatgaggctccccaggcctgccagacccaaagccaccgaactgacccctctcgcagtctcaggagagcagtgttcagtttccccagatgcagaatgggaacgtcccatcagctcacgggttctccaggctggcgtgttggtgtcctgggccgggggctgggagcaatgccctgtcgtcccagaatgggaaggaccagcagtggcttctacaggctgtttctgtttccttgagcgtgttgtgtttttgccaatgagggcccgggacagcacccatggacataccctgtgtgcccagctgggataaaaagtccctttgggcccgggcgcggtggctcacgcctgtaatcccagcactttgggaggctgaggcgggtggatcacgaggtcaggagatcgagaccatcctggctaacacggtgaaaccccgtctctactaaaaaaaaaatacagaaaattagtcaggcatggtggtgggtgcctgtagttccagctactcaggaggctgaggcaggagaatggcatgaacctgggaggtggagcttgcagtgagcggagattgtgccactgcactccagtctgggcaacagagcgagacttcgtctcaaaaaaaaaaaaaagtccctttggagaaggtggtggcagttattgagtaaaaatgtggttgggggatttcaggaacagtggctcatgcctataatcccagcactttgggaagctgaggtgggaggattgcttgagcccaagagttcaagaccagcctgggcaacatggcaagactgtgtcactataatttttttttttaaactctggtgtggcagcacatgcctgtagtctcagctactcaggaggctgaagcagaaggatcacttgaggccaggagttcaagactagcatgggcaacataacaagaccccatctctacaaaaaaattttaaattagctgggcatgatggtgcacacctgtaatctcagctactcaggaggctgaggtgggaggatcacttaagcccaggaggggtttggaggctccagtgagctatgattgcaccactgcactccagcctgggtaacagagcaagactcttcctcaaaaacaaaaaaaaccagggaatgggaggatcatatttccattttgtgtttgttacttctgtgttactgtaatagcacatatttaggcttggtttacagctgggcatgacggctcatgcctgtaatcccagctggcatttgggaggccaaggtaggcagatcacttgaggtcaggagttcgagaccagcctggccaacatggtgagatcccatctctactaaaaatacacagattagccaggtgtggtggctcacacctgtaatcccagctgtaatctccctgtcatcaggagactgaggcacaagaatcacttgaacccgggaggcggaggttgcactgagctgagatcgtaccacgacactccagcctgggcaacagagcaagactctgtctcaaaaaaaaaaaaaaaaataggcttggtttggttgaaagtggcaagaaagaagagactcttaagggtttgttcctccaggagaatagatagttctcaaactgggagactcacagcgtcatttttcatacagtggcgaggagatccgctgggacagggagctctactgcagggcctgctctgtgccaggagggaggctgctgctccatgacacacaaagagcagatagcaaaaagctatgcaacagggctggagagcaagagtcatgattcgtgcagtagaagcaaaggcttcagcaggccaggatgaatgcagccacatgcccggtgtgtctgggcatattaaaaggaagattgagccaggcatggtggctcatgcctgtaatcccagcactttgggaggctgaggtgggcagatcacttgagatcaggactactgaaaatacaaaaattaaggccgggtgcggtggctcacgcctgtaatcccagcactttgaaaggccgagttaggcagatcacctgaggttgggagtttgagaccagtctgaccactatggagaaaccccatctctactaaaaaatacaaaattagccgggcgtggtagcaggtgcctgtaatcccagctactctggaggctgaggcaggagaattggcttgaacccaggaggcagaagttgcagtgagccgagatcacgccgttgcactccagcctgggcaacaagagcaaaactccatctcaaaaaaaaaaattagccaggcatggtggcatgcacctgtaatcccagctactcaagaggcaaagaggagaatcacttgaacccgagaggcagaggttgcagtgagccgagatcgcactcctgcatttcagcctgggggacagtaacactcttgtctcaaaaaaataaaaagggaagatcacatttcaggtggtttaaggataaactcatgatagacatatagcccatcagatgtgtgaaaacagggaaataaagattcacaagagaatatgtgtaattatagtacagtaattggctctactatatacatgtatagtactgtactggttgaaggagggcttctttcaacaaattctcagcctgagcaatgtgtgaaaccccatctctagggaaaaaaaaaaattagccaggcttggtggtgtgcacctgtagtcccagctacttgggaggctgaggtgggaggatcgcttgagccaggaggtcgaggctgcagtgagccctgattgcaccactgcactctagcctgggtgacagagtaagaccctgtctcgaaaattttttttttttaatttttttaaaaatacattccgtccaggcgtgatggctcacgcctgtaatcccaacaccttgggaggcccagataggaggatcgcttgagcccaggaatttgagagcagcctgggcaatgtatcaagaccccatctctacaaaaaattttaaaaattctcacacctgtaatcccagcactttgagaggacaaaacaggagggtcgcttgaggccaggagttcgagaccagtctggtcaacatagcaaccccatctctattttatttttaaaattaaaaaattagccaggtgcagtggtgtgtgtctgtagtcccagatacttgggaggctgaggcggaaggcggaagaatagcttaagcacagagggtccaggctgcagtgagctatgatggcattactgcactccagtctgggtgacagagcaagacctcgtccctttaaaaatacaaagagaggccggggcatggtggctcacatctgtaatcccagcactttgagaggccaaggcagatggatcacttgagttccagagtttgaaatcagcctggccaacatggtgaaacaccatctctactaaaagtaccacaaattagctgggcgtggtggtgcacacctgtagtccgagctcctcgggtggctgaggctcaagaatcacttgaacctgggaggtggaggttgcagtgagctgagatcacatcactgcactccagcctgggcgacagagcgagactccttctcaaaataaataaatatagggtttataaataaataaaacacaaagagacaaacaaactaaaaaaccatcctggatgcctgccaggtcccgggcttgcagcccagcagtaaatgccaccaagtcctgccctggagttgccgatgtcacccagacaaaatcaaaatgtcatgtcaggtagagataactgctgtgacaggatataatgcagagtgagggggagagagggacaggaggaacctggataagaaggtgacattgaagcggtgacccaatgaagggagagggccagccaggtgcataaagagtgtgggagcaggccaggcgtggtggctcacacctgtaatcccagcactttgggaggctgaggcaggcagatcacgaggtcaagagttcgagaccagcctgaccaacatagtgaaaccccgtctctactaaaaatgcaaaaattagccgggtgtggtggcgtgtgcctgtaatcccagctactcgggaggctgaggcaggagaatcacttgaacctgggaggtggaggttgcagtgagccgagattgtgccattgcacttcagcctgggtgacagagggagactctgtctcaaaaaataaataaataaaaataaagactgttgggacagagaaaaagtcatgcaaagtccctgaggcaacaacgtgcttgggtgtttgaaagcttgcaaggtgcccttgcagctggtacagggtgagtgagggaaggatggtgaggttgaggcccaagaggtagcaggggaccaggcgtgtggcccacgcctgtaatcctagcattttgggaggctgaggcaggaggattgcttgagctcaggagtttgtgaccagcctaggcaacatggtgagaccctatctctataaaaaagaaaaataggccaggagaggtggctcacgcctgtaatcccagcactttgtgggggttgaggagggtgtatcacctgaggtcagaagttcgagaccagcctgcccaacatggtgacaccccatttctaaaaattcaaaaattagccaggcatggtgagggggtcctgtaattccagctactcaggagactgaggcaggagaattgcttaaacccaggagacagaggttgcagtgagctgagatcgcgcccctgcactccagcctgggcgacaagagcaaaactctctctcaaaataaataaataaaaaggtagcaggagccagatcacatggattttgggccagcttaaagagtttgaattttattttattttttaaaaagtcttaagagacagtgtctcattctggtttgtttttatttttgtttttgctttctatgcctattccctcaaaccataaactaggggcacccgggcagcttgaggtcaggtgccaattcaacagcaagtcctcatgaatgacattttttatggctttgtgcagagacaccttgtgctcatgagcattggttttttgttttttgtgggttggtttttttgttgttgtttgtttgttttctattttttgagacagagtctcactcactctattgcccaggctggagtgcagtggcaccatctcagcttactgcaacctccgcctcccgggttccagcgattccccggcctcagcctcctgagtagctgggataacaggcgcatgtcactacacctggctaaattttgtatttttagtagagacggtgtttcaccatgttggtcaggctggtctcgaactcctaaccttaagtgatccatccaccttgacctcccaaagtgctgggattagaggcgtgagccaccatgcctggccttttgtgggttttttttgagacagagtctcactccaggctggagtacagtggtgctgtctcggctcactgtagcctccaccttccaggtttaaacgattctcctgcctcagcctcccgagtaactgggattacaggcgtgagccaccatgcctggccatgagcatttgttttaagagacaagtctttctttagcccaggctggagtgtagtggcacaatcataactcactgcagccttaaactcctgggctcaagcaatcctgcttcagcctcctgagtagctgggactgcaggggcacgccaccacacctggctaatttttacattttttgtagagaaggggtctcgctatgttgcccaagctggtctccaactcctgggctcaaagcgatgcccctgcctcagcctcccaaagtgctgggattacaggttgagccaccatgcccagccttgagcactttttaaagtcacgatggctttctccacctgtcatttggaaagggagacaggtcagtgcagtggccgacgggagaggccgtctggtgggtttgaggccagctcctcctgttactccctgtggccttggcagccggctgtgctatttaaggggaagcactgtcgctactctggcctgggactcaggggctctgcccagcttctgcctctctaagtttactgctgggaagtcacttcccctttcagaacctgagttctcccataaagaggaggggcctaaatgcagtccgaagccttttctagctcctgagactgtggttcaaggcagggctatgcttcccctcccagccctggccccgtgaccccagctctgtgcctggcactgtacagaagcctaagagatgcccaccgccagagcgggcaccaaatcctcatctactggggaccccaggggtgccctccctgagagtttggcctttgggctcactcccaggcagagactcctcggagttgctgcttgattacccctgtgacagagagctcattacctctccaggcccattacctctccagagagctcattacctctctgctccatggcctaccctgccatcccccgacagcccccttctggccagcatgattttcccagtgtcctctacccaccacaaaccccagccccacaacaggcttgctctaacaggacaagttgtgctgaagatggggccttcagaagcagtgctgtatgacaaagaaggttgactcatgtctggacagggctttctggagtctgtggagctaaagacattagcataatacagagctgggcttggtcactggtgcttccgactgcagtaacacagcagctctcagacgtgagccgtagatctcagacctttccagaagcttggagttcttgcttcgtagtgggccccgactgtttctactcttttctttcattttgagacggagtcttactctgtcacccaggctggagtgcagtggtgctatctcagttcactgcaacctctgcctcctgggttcaagccattcccctccctcagcctcccaagtagctgggattataggcacctgccaccacacctggctaatttttgtatttttagtagagacgggtttcaccatgttggccaggctggtctcagactcctgacctcaagtgatctgccctcctcggcctcccaaaatgctgggattacaggcgtgagctactgcacctgaccttgtttctacactttaaaccagctccacgggaggccacctgaggccacctgctccaatcccaggcagtgacaatcgtgcaatgtccctggagcaggagtgagatatcagatggacctgttcaggactggggggggtctcactcccagctggatccttcaagcccagcgcagccccccagattccacatgtggggcggcagggactccaggcctgaactatgcatagccagaagggtccattgcagggctgtgtagactgaggcccagagaggagggctgagcagtcccagagatgcttggagggacctctgtgatagcctcgcttgtgttttccaggcccgagctgctcactgagggagtcaaagagcccatcatggatagtcaaggtacccagcgcggggtcgggagccatggtgtgggcgggcaagggagggccccaggcctctgccaccagcccctcctcctgctgcctctgtcctgctcccatcctggccctggcattctccccacacccccacattgggtttcccctaacgatgccatcttgggtcccaggaactgcctcctcacttggcttctctccccctgccctgcccccagagagggattccggggaccctctggtggacgagagcctgaagagacagggctttcaaggtaaggttgagctcacggggaggtctgttgtcccagcaccaggacattgacctggtttgggtttggagggccaggctggaagtggggaggagctggcccccaacttcagggcctaagggaccaggcaagccaggttggcagcccaggcccggctgtaccctgccagctctgtgttagagactccaggggagagggggtgcctacaggtggacggtcgggggagcccaggagcctgcctgccccctccctgccccaccccccagaggtagctgacacgcccactcctttttcagcaatcagctgtggtcttagtgctttgaaatcagaataggagccagacgcggcacctcacgcctgtaatctcagcacttgggaaggtcaaggtgggaggatcgcttgaggctgggagctcgagacaagcctggacaacatagaacccgtctctatgtctatttttaagaaaagaaatcagaggccgagtgcagtggctcacgcctgtaatcccagcactttgggcggccgaggcaggtggatcacttgaggccaggagttcaagaccagcctggccaacatggtgaaaccccgtgtctaccaaaaaaatacaagaattagttgggcgaggtggcgtgcacctgtgatcccagctactagggaggctaaggcgggagaatcgcttgaacctgggaggcggagattgcagtgagccgagatcatgccactgcactccagcctgggtgacagagcaagaccctgtctcaaaaaaaaaagaaagagagagagagagagagatggtggtctgggatccctccagcacatgctggcacttgtctttgtttgtttgtttggatggagttttactcttgttgcccaggctggagtgcaatggcgtgatctcagcccactgcaacctccgcttcccgggttcaagcaattctcctgcctcaggctcccaagtagctgggattataggcacgtgccaccacacccggctaatttttgtattttttagtagagacggggtttcaccatgttggacaggctggtctcgagctcctgacctcagatgatctgcccacctcagcctcccaaagtgttgggattacaggcatgaaccactgcacccagctttttttttttttttttttttgagacagagtcttgctctgtcacccaggctggagtgcagtggtgcgatcttggctcactacaacctccacctcccaggttcaaggggttctcttgcctcagcctcccaagtagctgggattacaggtacgcaccaccatgcctggctaatttttgtatttttagtagagatagggtttcaccacattggccaggctggtttccaactcctgccctcaggtgatcctcctgcctcagcttcccaaaatgctggggttacaggcatgagccgccgcgcccggtcacacttgggcgtttttaatgaacactttctgggtgagggtgtcttggtggctcatgcctgtaatcccagcacttttggaggctgaggcaggcagatcacttgagcttgggggttcgaggccagcctgggcaacatggcgaaaccccatctctaccaaaaacacaaaaaagaaattagccaggtgcggtggtgcacgcctgtggtcccagctactcagaaggctgaagcaggagaatcgcctgagcctgggaggtggaggttccattgggagccgccaggcccatcccctgtgtctgtggggactgcccatcctcctccatctgctagatcagctgggcttccattccctcgcttgtctccagccccctagtgacttcatgaagcccccgccccctgcctgccagcccagggcacaggactccgtactctatggtgtccctcccctccggggcttatttattggtttggtggttttcaaatgtcatcaattaacttaatttccaactcatcactgttgtggcaacagtgcatgtccttctgaaaaaaagacatctccatcaacatgtcggtgctgaaggacctgaggggcccactccaaagatcctttaattgccggagaaggagttccccataattagaaaatcatcttccttaaaagtcaccaagtgctttttcactcaacagcccaaacccataatcgttttgcgctttgcagaaaattatgacgcgaggctctcacggatcgacatcgccaacacactaagggagcaggtccaggaccttttcaataagaaatacggtaagcagtgcagaacccccggggagggacacgcagctgctgtgcacagagaagtgggaggcttcccagttccagccgagggcatttctggggaaacaattcacccctttacatgtatttcttgagcatatactacgtgccaggcactgtctcaggcactggggatattgctgtgaataaaacagacacagtccctgtactcatgagccttgcagaccaatgaggtgagatacactttcaagaactacacacagaatttaatagacaagggcccggcacagtggctcctgcctgtaatcccagcacttttggaggctgaggcaggtggatcacttgagctcaggagttcgaggccagcctgggcaacatggcaaaaccccatctctaccaaaaacacaaaaaagaaattagccaggtgcagtggtgcacacctgtggtcccagctactcaggaagctgaagcaggagaatcgcttgagcctgcgagggggaggttgcagtgagctgagatcgcgccattgcattccagcctaggcaacaaaagcgaaactccgtctcaaaaaaaaaaaaaaaaaaatggagcatatgacatgggagcatattggtgtggctttttctttcgtttcttttttttttttttttttttttttttttttgagacagggtctcactctgtcacccatgctggagtacagtggcgtgatcatggttcactacagcctcaaactcctgggctcaagcaatcctcctgcctcagcctcccaagtggctggaactacaccccactgggcactaccatgcccaactagtttttagaaatttttagtaaagacagggtcttgctgtgttgcccaggctgatctcgaactcttagacttaagagatcctcctgccttggttccccaaaatgctgggattacgggcataagccaccatgctggccttttttttatgttctgatcaaacagctcagattgtaatgcctatacctttccacagtgctacactacataagagctttctcgtaccattcactctcctgcacgcatgtctttccatcacatccccgcaatcccatgtacacacaccccacgctgcctctcactcctgacgggcaggaccctgcctctcgcccacaggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggtactcagtgggaagggtgagggtgaagaggcaggactagctcagatgggagcttgcacctgcgaatccttagcctttccctaggtcctgccctcccccctggacaaggtggctctcctggcaccatcctgggtcctgggggtggttggagagggactgcaggccagcccaagtgaagggagcccttcagaagtgggactggtcacccccccatggcaagggcagcctttgagggcatcttcaacctgttcagcaacacccgctcactgcacccccagcccccgggaaaggtattcagcccccatcagagggatttgcccaaggtcccggggccagccagggcaaagcctgcacaaggcccaggtctgcgtcctgcagagtgacactgccaatgccagcaccctgccacattgtctcagtgtcccgcacacacagagccccagggcagcttgttaaaatgcagattctgctgctgtaggtctggggtgctcccaggggagaccgaggccactgaatcccaggggtgtcttcctcatcccccaggccctccccatgacacccctgcctctgtttctcttctaggcctttccaaggactcatcccaaagcctggtaagaggcactggctgtggagggggcactgggaatagggcccgatcgtggtgctggggactggagctaagcctgctgtggggcacaggttctggggtctgggaacagaagccaggcccctgcctttcttttttttttttctgaggcagagtccttctctgtcacccaggctggagtgcagtggcttcatctcggttcactgcaacctccacctcctggattcaagcaattctcctgcctcagactcctgagtagctgggattacaggcaattgtcaccatacctggctattttttgtatttttggtagagacggggtttcaccatgttggccagggctggtctcaaactcctgacctcaagtgatccacccacctcggcctcccaaagcgttgggattacaggcgtgagccactgcgcccggcctaggcctctgcccttctgtttagccaccttacctgggctcctgccccaggtagatggaggaagactaagcttgaatgtggccccagatcctgggacagagaaaggggtggtggcgtcagtgacttctaagttttacccagtctgggttcaggagggaggggccaggccgagtcagtgcacctgctcctcctgataaaggggctctggttgacctcagtgaataggcgaggttggaggtgagtgggttcctaaccgcagaaggaggggtgtctgcatggggaccacaagcatgttggtaagatgtgggtggcgcctaccctgccttaaacagtgcagtgcctctcctgaccctttttaaaaaaatattttatatatataataaaatatatacataataaaaaatatatataataaaaatattatatataattaaaaatatttatataattaaaatattatatataattaaaaatattatatatataataaaaaatattatatagagagagagagagacagagacagaccaagtctcactttgttgcccaggctggaatgcaatggcactatctctgctcactgcaaactccacctcccaggttcaagctattctgcctcagcctaccaagtagctgggattataggtgggcaccaccatgcccggctaatttttgtgtttttagtagagctgggtttcaccatattggctaggctggtctcaaactcctggcctcaagtgatcctcctgcctcagcctcccaaagtgctgggattacaggcatgagccaccacacccgacctcctgaccctttttaaggcacccatccacttctgtctccaccatggactgtgtcctggcctcccaaacccagatttgcaggggctgtccctgcagggtgatcccaaacccagatttgcaggggctgtccctgcggggcgacatgccacttggcaagcactaagggctggccagagcctccagggcgggccaggcacggtggctcacacctgtaatcccagcactttgggaagccaaggcaggaggatcacttgaggtcaggagttcgagatcagcctgaccaacatggtgaaaccccatgtctatttaaaatcccaaaattagccaggtgtggtggcgcacacctgtaatcccagctacttgggaggctgaggcaggagaatcacttgaacccgggaggcagaggttgcagtgagccgagatcgcgcgactgcactccaccttgggcgacgggactagattgtctcaaaaaaaaaaaaaaaaaaagaacttagggtacagtgatgtggcggctgctgacaggccacgggaacccccagaagggggatcaggagggtgaggggtagttggagagggtttcctggagtaaggatggccctgcttgggcctcaggggaagatgggactttgagaggcagagaggagggtgggtttggcggggtgaacggcaggggttggggggtcactggatgccagaagtgtgtttccggagctctcggaggggcagagtggtcagatgatgttggaaaggtggagagagtggaagctgcagcagcacagtgcagtgagtgtggctccagtggacacccggctgagaggtcactgggtttctggccctgcactggtgctttatgcgggtgcctttcacacatattttgggaggtcctgctgggacaaggtggtattctagaggaactagggttacagcagagtgcagacagaggaggcatctcatttagtcttcatagctaggaggttgacgctagagcccaccttacagagggggagactgaggctcggtgtgagtgatgtgttaatactctgtgtcccagggctagcaggtggtcgtggcctcagccctcagggatggacctgccagcccctttccaggcgttggcacccaagccaggtatccaccaggtatccacacttactcatgccactagtcatgctgggctgggaacacgtccaggctcctgggagtctctgagggttcaccagaggtcactgagtgctacttctgcaccagaatgggcttttctcaaactctccctcacacggttcccgaagcctggcctgggccagcaccggcagttccagggtgaatcggagtggaagctggggtctgctgggggaggcaggggaaatagcagaccccttcatctggaggcaggtgtcccagggcaggtggaggggtggcagatagttgcagagaggcgggtggctggggacagtgcccaggagtcagccttcagggtcttaggcagcatgtgggccatgggaaagtgccgcctcattcaagtccctgtacccgcctgactagccatgggaatctgagccttcacttccttaccgccaagatggacaagcacacctgcctcaccatgtgatctgaatatgggaaaagatgggcagtgctaggttagctgggaggactattttccgccaattgccctcttttttttttttttttttttttttttttttgagatggaatttagctcttgttgcccaggctagagtgcaatggtgtgatcctggttcactgtaacctccgcctcccaggttcaaatgattctcctgcctcagcctcctgagtagctgagattataggcgtgtgccacagcatccagctaaatttttgtatttgtaggcaccctaacacaatgaaagtccaggctggttgaccaggctggtctcgaactcctggccagcctcaagtgatccgcccatcttgacctcccaaagtgctgggattacaggcgtgagccaccgcattcagccgcctttctttttgtcctcgtttgcaaatacagaatggaccttagtctgcaaactcagaagtgcgagacatgtatttttatttttctaaaattgaactggactcctaccaaaagcccccaatgcagagtggcagaaactttatctgagtccattttggatcatcatttcccttgagcttgcactagggcctggaaccttctgtgaggcccactcagtagacacttccacaccgcagagagactgagcatgagaaggtccgtgcttgaaaaaggcctaacggtgggatctcggtgcaaagatgggagagtggaaaccgagtggtgaagagatgactgtggcacccagcagggaattcccaggagggtgaggcttcgggaactttccagggggacaaaccctgttaagaatggctctagggcctggtgctgtggctcacgcctgtaattccagcactttgggaggccgaagtaggcagatcacgaggtcaggagttcgagaccagcctggccaacatggtgaaaccccgtctctactaaaaataaaaaattagctgggcatggtggcgggtgcctctaatcccagctactcgggaggctgaggcaggagaatcgcttgaaacttgaaggcggaggttgcagtcagccaagatcacaccattgcactccagcctgggcaacaagagtgaaactccgtctcagaaaaaaaaaaaaagaatggctctaaaccaggaacagtggttcacccctgtaatcctagcactttgggaggccaaggtaggaggatcacttgaggccaagagtttgaggccagcctgggcaacataacaagaccccgtctctacaaaaaaattaaaaattagccaggcacggtggcacgcacctgtagtctcagctactcaggaggccgaagcaggaggatggcttgagcccaggaggtggaggttgcagtgagctgagattgtgcaactgcactccagcctgggtgacagagcatgacgccatctggaaaaaataaaaataaaaagaatggctctgagatttttttaggtcacttattgaaggttcccatggaagcctttcctaacagaaccaccccgagaaggtaaaaattctgaaagagattgtgcttttttgtttttgttttgttttgtttttttgttttaagatggagtttctcttcttgttgcccaggctggagtgcaatggcacaatcttggctcactgcaacctccacctcccgagttcaagcgattcgcctgcctcagcctcctgagtagctggaattacaggtgtgcaccatgacactcggctaatttttgtattttgagtagagacggggtttcaccatgttggccaggctgatctcaaacttctgacctcaggtgatcagcccgcctcagcctcccagagtgttgggattacaggcgtgagccaccgcacctggctgagattgtgcttttttgaagatgaatcagtcattaaattgcaagagccccactgcaccctagagctgtgagcctccccagtgtagggtgagagtacagccactcctggactggttttgttctgggtcaaaagagatgactcaggccagacgtggtggcttatacctataatcccagcattttgggaggccaagatgggaaaatcacttgagcccaggagtttgagaccagcctgggtaacatagcaagatcccatcctgcaaagacatttttttaaattagccagacatggtggggacgaacgactgtattcccagctactcgggaggctgaggcgggaggatccctcgagcctaggagttggaggctgcagggagccataattccagtgtgtgtgacagagcgaggtcttgtctctaaaaaagagagagagagagagataagcccagaatgtctttaatattttcccagctgaggacatcacgtttgccttcagtgcctcagtttccccactaaaatctagaggccctgcctgctctgacatgctgagtggcgggcaggcgtctagcttgagaggaaggcatacttggacttggaccaagcctcagagggcagtgggtgaatttcaggcctcaggtcaagggagctgtgggccaggggtttctgggggccaggggtactagaaagcaccagactgaactggaggggacctggtggggggcctcgggttgcagagggatgggggggactgggtcccccaactcataccagaaggaactccagccctgcccgcaaggggctgagacaacccacgctcgaccctgggggctgaacgccattggtagctggtagctctatactgcccaaccaggccacacccacctgcctgcagcggcactgaattaaattagggagactgccaggcgcggtggctcatgcctgtaatcccagcactttgggaggccaaggtgggtggatcacgtaaagtcaggagttcgagaccagcctgggcaacatggtgaaaccccaactctactaaaaatacaaaaattagccaggcatggtggtgcactcctgtaatcccagctacttaggaggctaaggcaggagaatcacttgaacctgggaggcagaggttgcagtgagccaagatcgcgccattgcactccagcttgggcaacagagcacaacccggtcacaaaaaaagaaagaaaaaagaaaacccaggacagctaacgggggctgttcaggatatgctgggaagaagcggtggtgactaaggcgggagaaaccctctacccaggtagctgctgtaatattccatccgaagaacattctagtaggtcataaaaacctaaagggggtcgggcatggtggctcatgcctataatcccagcgctttgggaggccagtgcaggaggattgcttgaagccaggagttggagatcagcctgggcagcatagtgagaacccatctctacaaaaaaaattttttttaattagctgggcatggtggtgggtggtggcgcttgcctgtagtcctagctacccaggaggctgaggcaggagggtcacttgagcccaggagtttgaggctgcagcgagctatgatcacaaagctcacatcacctcacttcaacctgagtgacagagtaagaccctctctctaaaagacacacaaacacacacacacacacacacacacacacacaccctaaagagaaatgcaaatatatgcccatggtagaaatttggaaaatacagaaatctaacaacccagatggctgttcatttttatgatgatacatttcttccagatttccccccaagcttattaattttacatctcactgttcttctttctataaatttacacatttaaccttaaaacataaacatgttcccatgtctttaaaaagctctgttccctcttcaggctgtatcatggttatgtaactaccctgtcccccagttatggacatttgagcagcccctcacaccacagacacctaacactcacgtcacacttttttttgagacggagtctcgctctgtcccccaggctggactgcagtcgtgtgatctcaactcaccgtaacctccgcctcccgagttcaagcaattttcctgcctcagcctcccaagtagctgggattacaggtgcccgccaccatgccaggctaattttcctattttagtagagacggggttttgccatgttggccaggctggtctcgaactcctgacctcaggcgatccacccgcctcggcttcccaaactgctgggattacaggtgtgagccaccatgcctgaccacgtcatacttacgatttgccggttacaaagcccactcacgttaccacgtcatctccccaagtagctggccttattggaggggactgaggctcagagagattaagcagctttctcaaggtcacacagtagtgtggtagagatttgaacctaagtctttaccattttattatacttcggaacccagggcaggctctaccactagcctagggcttgttgtgtgtccctgaagtgggttgcagccacgccctctttcccaccacccctctggtctcatccacacagggtggctctttgctgtcccctcctggctaccagcagctattacactggtcctgcctgtgtaaacctttaggcttgtagttaatcctttgagttcatttatttgtacaacaaaaatgtatggagggccaggcgcagtggctcacgcctgtaatcctagcactttgggaggctgaggcaggcggatcacaaggtcaggagatcaagaccatcctggccagcatggtgaaaccccgtctctactaaaaatacaaaaattcgctgggcatggtggcgcatgcctgtaatcccagctacttgggagcctgaggcaggagaatcgcttgaacccgggaggcagaggttgcagtgaactgagattgcaccacagcactccaacccggcgacacagcgagaccctgtctcaaaaataaaaaagaaaaaaaaaaggagagagaggtggaaagtccgcaggtgaagcccagggagaaacttactgaagggggtgattggttgcaccagcctctgctgggaggtcagtcctaatgcctgagagtagacggaggtgctaagcaacaggttgcagtgggatggttcagagcaattttgggggaagtggtggggaccagagtggaatagtgggctcaagagacaatgagaaaggcaagtgattgaatctgccaaggaccaagcaccaaagtgccagctcactgccaccctcagtaaagactaacttgccctttcccccaactcccctcccagaagtagcttgctctcctctgcctgccacacatcgggggggtcaggtctaaaaggatcaccttttagagggcaggagagaatgaacaagagttgagagtggaatggctgcagagagggctttcttttttttggtggagggaggggacagagtctcgctctattgcccaggctggagtgcagtggcgtgatctcggctcactgcaacccccgcctcccgggttcaagtgattctcctgcctcagcctcccgagtagctgggattacaggcgcgtgctatcacgcccgactattttttgtattttttagtagagatggggtttcaccatgttggccaagccggtgtcaaactcctgacctcaaatgatccacctgcctcagcctcccaaagtgctgggattacatatatgacccaccacacccagccaagagagggttttagaggtaggaacagcagctgcatgatcttcagcagattcagtagagagggaagtgagctgtgggagaggaaggaggatggggggaatggcaagaaaaggagcaccctgcttagaaagggaacggagctgggtgtggtggctcacgcctgtaatccagcactttgggaggccgaggcagtaggatcacttgagcccaggagtttgagaccagccacataacaagactgcatctctatttaaaaaaaaaaaaaaaaaagaaggagaaagggccgggcgtggtggctcacgcctataatcccagcactttgggaggcccaggcgggcagatcacaaggtcaggagatcaagaccatcctggctaacacagtgaaaccccgtctctactaaaaatacaaaaaattagctgggcgtgatggcgggcacctgtagtcccagctacttgggaggctgagtcaggagaatggcgtgaacccgggaggcggaacttgcagtgagccgagattgtgccactgcactccagcctgtgcgacagagcgagactctgtctcaaaaaaaaagaagaagaagaagaaagagaaagaaacaggatgggtggaagagggttgctgaatgctcatgcaagctcctgtctgcctgctccttctctcagggagggacaggggagggtgatgagtcagtggactaaatgtccccatggggatgaaggacagttggggtcaggtttctagagggagggctggaaggagggaaggagatggccagagaaggatgtgggacacagaggtgccgccatggatcaccaagaggttcaggactggccagagggaggagaagaggtcaaggtacgtgtggggcacttggatgacgcatctgtgcctgcacacagctgaaatccccaggaaataagacgggagcagggtgggtttctgcagccaaggtgagaccaaaatgccagctcactgccaccctcagtaaagactaacttgccctttcccccaactcccctcccagaagtagctcactctcctctgcctgccacacatcggggggtcagggaaagctccccctccctgaggagctggtgttccctaggccaggggccagtccctgcagagattaggagctgggaaatcccctcctcccatcccgcacgtccacgcgtgccagaccctgtgctgtgggcttttcacacacagcctcttagacgcttagcctgtgaggtgggtgctgttgtccttccttcccattttgtaactgagcaaacagcctgaaacagacaaaaatcaggtagttagcatgaggccaaagccactccctggtctatgctgttctgcggcctgagcctggggtggccaggtggggttgtgcagtgagggggggatggagaatagcccccaaaaatgctgccggaatggtaaagggcctagcctgcaaagctagtaacttgagctttattttgtggcactggcggtttttccagtcattgtaatgatacgatcagatttgcgctgtcttcaggttaccatggtaaccatatttccacccaccaagggtggattagagaaggcaaaactagggcagagaagccagggagtgttgagaaggtctgaacccaggcagtgggcagctgggccccacgatggatggggttaggatctagaggcagcagcagggtgtgaagagggcggaaggttccggaagggtgatggtggtgctcgtctctaaggctgggtctgtgggcttgtgagacacatccaggggcccatagtgaaacctgagtggtatttagtgcaggcagggtggcaggcaggctgggggcctctcagaagcgtggagctggcagagagagacctgcccggggcatcggaggaaagggcgactgtgcaggaacagagtagacgaggtgggggaacctttgggtaagaagagctgagtcaggagcattgaggcagcggttttcaaacctcagaagcaacagcagggccgggcgcggtggctcagcctgtaatcccaggactttgggaggctgaggcgggtagatcacctgaggtcgggagttcgaaaccagcctggccaacatggtgagaccctgtctccaccaaaaaatacaaaaattagccaggcatggtggcggacgcctgtaatcccagctactcgggagcttgaggcaggagaatcgcttgaacctgagacgcagaggttgcaatgagctgagatcacaccactgcactccagcctgggtgacagagcaagactctgtctcaaaaaaaaaaaaaaagccagacacagtggctcattgcctgtaatcccagcacttcgggaggccaaggcaggaggattgcttgaagccaggagaccagcctgggcaacatagtgagaccctgtctctacaaaaaatgaaaacattgagccagtgttgtggcacacatctgtagtctcaggtactcgggaggctgaggagggaggatcgcttgagcccaggaagtcaaagctgcagtaagctgtgatcacaccactgcactctagcctgcgagacagaatgagaccttgtctttcaaaaaaaaattctagaattgttcttgaatagcagtggttaacgttttttaaaagctttggaaggtagtgaactccccgtcactggaggcatttaagcagaggttgagctgccactcactagagaggccgcttcctatagggcttgctgcaggagaggagaaagggacaagagagccctgccggttttggaggggctgtggggaggactaaaaccaaggaggggcccctctacccaccaaatccacttctctttgctgccccgccaccagctccccacagctcctccctgcgtatgggcccagccacccttctccagttcccttttgggcaaacacgagggctctccccggacccaggccagcttccgctccttttagttctcctctcaccctgggggtacagcagtccctgccagcttgaggggactgtgggaaggcagcgccccacctctccttccccagagcaggggctccagaccccagggatgtggcagagctgccaacttcctgtgtgactccagcaagtcaggcttgcctacctgggcctcagtttccctacttgtaaaatgagaagaattgcccacgccacgtctgcctcccctggggccaccctggagtgcatgaccaggtgagaaggagggatgggctgtcatgagtgggaggtggtgaggcagagagactggccaggatggagcggggacagcctgggaggcctggctttgcagcatggacagggcccttcaggcctggccctggtaagctcttctgctgacgtccccatagcggaggaacccgtacagccccactggtcggggccaagctcttggcgggctccagttttatctaggacatccccacatcgtctcctctgtaaacgttccactttcatctcagtttaaggaactatgtcaaattacatgctgctagctgggcacagtggctcacgcctgtaatcccagcactttgggaggccaaggcaggagggtcacttgcatccaggagttcgaaaccagcctgggaaacataaagagatcctgtctcgacaaaaaataaaaaattagccaggcatggtggcgtgtgcctatagtcccagctactcaggaggctgaggtgggaggatcccttgaccctgggagttggaggctgtagtgggctatgattttgtcattgtactccagcctgggcaacagagtgagaccttgtctcaaaaaaaaaaaattacatgccaccgaggaagatcattccacttacactcacctctcacccccaccagaattgtttgaggcccattttgagaagctcagctgtgggtgaaatgcctgccaggcacagggctgtgatcccttttcagggggtacaagtggagaaaagccagaagcctcaaatacagtagcaccacttgtcattgtcctctttgatctcctgctaagcctctctcttctgtggggtctcctgtcacccagtgggtgctatggtgggatgggcttcctggagaggatgacctgagccaggcctggatgctagtgtaggactgacctctgcagagggtactggggtggacatggggagggactgaagagcggcaggcacaggaacaggtccctttttgccttctcaggaagaagtaccatcacttctgagctgtgtgatcttggataagttaacctactatctctgatcttggataagttaacttgctatctctgatcttggataagttaacttgctacctgtgatcttggataagttaacttaccatctctgatctagataagtcaacttactatctctgatcttggataagttaacttgcttgtctctgattttagataagttaacttactgtctttgatcttggatgagttaactgtctttgggtctccatttctttgacgtgatacagaacaaggacatcctccatgatcctcccttctgctgcccaagacttgagagtcatttccttgtcgccaatcacacacaggcacacaccctctggcccctgcctccctctctcagccttccccaccccctctctacccttccaactctgtcttgagctcttgaaagctcaaaataaagccaccctttctcaagtttctaaagatatcacaattccagcgccagccacatgtttctccactgaattatctctgcttgtctttgttaattagggttcagtaatgatctcccttctgccttcccagggagagctggcatctgcggggcggggcttggaggcctttgtgggcagacgagacgccctactgccgggcccagagttggcccgacgcctcctttcttctgaagtggcagagtgggccatgaaatgatggcatgttggggagaccctgcccttttctggctggtggggacttagctggggtcattgcaacaccattctgccccccaaccttccacacgtcggggaagggaactccaaggtttttagcctttattagatgggcttccaggctgggtgcggttgcttacacttgtcatcccagcactgtgggaagttgaggcaggcggattgcttgagcaatcctggagttcgagaccagcctgggcaacatggcaaaatcccatcttgacaaaaaatgagccaggcatgagggcacatgcctgtagtcccagctactcaggaggttaaggcaagaggctcacttgagcccaggaggttgaggctgtggtgagccgtgatcgtgccactgcccaccagcctgggcaacagagcaagaccttctctcaaaaaaaaaaaaaacgattaaaatttaaaatagacaggggctttccggacccgaaagggagcagggttgggggcgcctttagagtcttttgcaacatcccagaaagcctcccagaaaccctttccccagcgaagaccacccaagctgacaagagcaaccagcacctttatttgggctggaatgagatcagcaccgaggggtcgccaggcaccttgtgcagaacagaagctgatgcgtgtgtctgagccatagaagtagagcaggggcagggtggtaaccatggctcagcacatgtggtttactgggtgtacccgatccttccagccttgtggggaggggtgtggggacaaaagaggagggaggtggaggttgggggccatgcaggcctagccctctaagaaccttcgtgtcatggagagggctcagcaccacccacagcagacttcgtgtggccccaacagaggccttgggggcgcaggtgcagtcactcatttgtgcacaggcccaggtgtctcactggggccagcactgtgccagatactggtcttttattattatttcattattctttttgtttgtttctgttttgttttgtctttgagacagagttgcgctcttattgcccaggctggagtgcagcagtgcaatctcagctcactgcaacctccgcctcccgggttcaagcaattctcctgccttagcctcctgagcatctgggattacaggcatgcaccaccacaccaagctaatttttttttttttttttttttttgtatttttagtagagactggatttcaccatgttggccaggctggtctcgaactcctgacctcaggtgatccacctgcctcgacctcccaaagtgccgggattactggtgtgagccactgagcccggcctcattattcttatttaatatttttgtaggacagcatcttgcttcattgcccaggctggtctagaactcctggcttcaagggatctcaccgccttggtttcccaaagtgctgggattacaggcgtgagccactacaccgggcctagatactggaatttttttttttttttttttttaaggcagggtctctctctgtcactcaggctggagtgcagtagcacgatcacggctcactgcatcctcgacctccctaagctcaagtgatcctcctgcctcagcctcccaagtagctgggactggaggcgtgcaccaccgtgccaggctaatttttgtatttttttgtagagacggggttttgccatgtttcccaggctggtctggaactcctgggctcaagtaatccacacacctctaacttccaaagtactgggattacagatgtgagccaccgtgcccggcctatgctggacttttaatcaacactgattaaaaaaaaaaaaaaacccggctgagtgcagtggttcacgtctgtaatcccagcacttcgggaggctgaggtgggcggatcacctaaggtcaggagtttgagaccagcctggctaacatggtgaaactccgtttctactaaaaatacaaaaaattagcccagcatcatgacacacacctataatcccagctacttgggaggctgaggcaggagaatcgcttgaacccgggaggtggaagttgcagtgagccgagattgcgccattgcgctccagcttgggcaacaagagcgaaactccgtctcaaaatacaaaaaaacaaaaaaacccagcctcacggagcctacatggtggggcggggggataaacagaaaatctgcaaagcgtaaaccatgggagcaattgtatttatttttaggagattgcaacattatttaggtgatgaccagaaggaggccttagttttaaaggcctgaaggggcagcagggaacagcattgcaggcagagagaacagcagctgcaaagcccctgaggtcacctgccaaggtatcagaggaaggtcaggggaagtgagagatgagatggagatggacagggaagatggtacatggccagataaggattttgacttttgctcagagtgagcttagagtcggtgcagttctgagcagagggtaacaggatccagcttgttttaacagaatccctctggttgctggcttgaggacagacaagggtggagagacataaggaggttgtaataatccaggcgacgcctgtggcggcagtggggtggtgagtcacccactcttaggtgagttggctgaagccaacagaatgtgctgatataagctgtgagaaaatgaggagctgactttgacttcagaggttcaggctgaacttggggaaggacggaggtgctgtgggtggagacagggaagatgcaggagaagctggtggggcaggaggtggcggatcaggcgtgttcaatctggggtctcatccagtcgaagttggaagcaagttggggctcaggggagcagtccaggcttgagatatgatttggggaatcatgaatttataactggtatttcaagccttaaaacaggccgggtccagtggctcacgccagcactctggaaggctgagacagaagggtcacttgagcccaggagttcgagacaagcctgggcaacatagcaagaccccatctctaaaaaaaaaaaaatagctgcacgtagtgcacacctgtggtcccagctactagggaggctgaggtgggaggatgacttgagctcaggaggtcaggctgcagtgagccacgattgtgccactgaactccagcgtgggaaacagagtgagaccctgtctcaaaaaaataaataaattacctaaacgtagtggcttcaaacaacacaaatttattgccttacagttttggagatcagaagtctgaaatgagtcttccaaggctaatgtcaaggtgtcaggggccaggtgcagtggctcacgactgtaatcctagcacttcgggaggctgaggcgggcgaatcacttgagatcaggagttcgagaccagcctggccaacgtggtaaaaccccatctctactaaaaatacaaaaattagccaggtgtggtggtgcgcacttgtaatcccagctactcgggaggctgaggcaagagaatcccttgaacccaggaggcggagtttgcagtgagctgagatcgtgccattgcactccagcctgggctacaagaaaaaaaaaaaaaaaagatgtcagcagggctgatccttctggaggctctaggggaaaatctatttccttgtcttttttttttttttttttttttttttttttttgagacagagtcttcaggctggagtgcagtggcgcgatctcagctcactgcaacctccgccttccaggttcaagcaattctcctgcctcagcttcctgagtagctgggattacaggcatatgccaacatgcccggctaatttttgtatttgtagtagagacagggtttcaccatgttgcccaggctggtctcaaactcctgacctcaagtgatctgcccactttggccttccaaagtgctgggattacaggtgtgagccactgagcacggccccctgttttaaggattaaatgaatgaatccatgcaaagatcaaagagcagtgcctggcacagaagagctcagattctctgagttaccaagtgcccgtgatgggttgggcattttttttatttgtttgtttgttttgagatggagtcttgctctgtcgcccaggctggagtgcagtggcgcaatctcggctcactgcaagctctgcctcctgagttcaagcaattctcctgcctcagcctcctgagtagctgtgactacaagcgtgcaccacctatcccagctaattttttgtatttttagtagagacgggatttcgccatgttggccagactagtcttgaactcctggcctcaagcgatccacccgcctcagcctcccaaagtggtgggattacaggcgtgagccaccgcgcccagctgggttcagtaattcttagcatattgccaattttccctgctttctctctcacacacacgcgcacacacataatttctctttctttttctctatttgaagtaaggtgcaaacatcttgactcttcgtgcctaaatgtttcaatgcacatctcctaagaaaacactgttatcttacatactcacaatagcatcatcgtacttatacaacttaataattccctgtcatctaatacatggtctttattcaaatttccaaaactgtcttctatgcctgttctcctccatgatataatcatttttcactggttgatttcttttttaattttttttttttttaaagacagtctccctcttgcccaggcaggagtgcagtggcacagtcatagcttactgcagcctggaccttctaggctcaaaccatccttaccacctcagcccctcgagtggctaggactacaagcacacgtgctaccatgcccagctcatattttattttttacttttgtagagataggctggagtgcagtgacactatcacatagctcactgtaacctccaactcctgggctcaaacaatcctcccgcatcagcctcccaagtagctgggactatagctgggtgccactgtaccagctacttttaaattttttgtagacagagtctctctatgttacccaaggctggtctccaactcctgccctcaagtgatcctcctgtctcggcctcccaaagtgctgagattataggtgtgagccaccacgccaggctcacgggttaattttttaaaaattattttattgcatgtaatgtttgcctaaacaaaaattatttcattttgcttataattttactttcttttttttgagacggagtctcgcactgtcgcccaggctggagtgaagtagtgtgatcttggctcactgcaacctccacctcccaggttcaagtgattctcctgcctcactcagccttccgagtagctgggactataggtgcccgccaccacgcccagctaattttttgtagagacggggtttcactgtgttagccaggatggtctccatctcctgacctcacgatccacccgcctcagcctcccaaaatgctgggattacaggcatgagccaccgcgcccagcctataattttacttttatgacaaaggcgtgttattgaatagagtctgggacttgctgttttccacttagctttggttgacataatgctgaagtgtgtagctgtagcttcttagttctcatggctctataatcttccattgagtggaattttaccatgatgcaattcctctctctcccctccttggggattgggctgcttccattgttttgctgttactaagaatgcaattaacacttatagccgggcacgatggctcatgcctgtaaacccagcactgtggcaggccacgacgggaggatcccttgagctcaggagtttgagaccagcctgggcaacatggcaagaccccatctctactaaaaatacaaaaaaattagccaggcatggtggcatgcttgctattcaagaggctgaggcgggaggatcgcttcagcccaggaggcagaggttgcagtgagctgagatcatgccactgcactccagcctgggcaacagagcgagatcctgtctcaaaaaaaaaaaaaaagcagaggaggagaagcatagatccgttaaaaagtttaaggcccagcctggtgactcgcccctgtaatcccaacactttgggaggctgaggcggaagaattgcttgaagccaggagtttgagatcaacctgggcaacatagcaagatcctgtctctacaaaaatgttaaaattagccagacgtggtggtatgcacctgtaggcccatgtactcaggagactgcggcaggaggatgaggtcaaggctgcagtgagctaggatcgcactactgcatgggtgacaaaatgagactacatctctaaaaaaaaattttttttgaaaaggaagaggaagaaggccaggcgcagtggctcatgcctgtaatcccagcactttgggagaccgaggcaggcggatcacctgaggtcaggagttcaagaccagcctgaccaacatgatgaaaccccgtctctactaaaaatacaaaaattagccaagcgtggtggctcgtgccggtagtctcagctacttaggaggctaaggcaggagaattgctggaacctgggaggcggaggttgcagtgagcccagatcacgccaccgcactccaccctgagcgacagagcaagactccatcttaagaaaaaaaaaaaaaaactacagttccctttgtaaaatgggtttttggtagagacagtgtcttgctgtcattccggctagagtccagtagctgggactacaggtgtgggccaccatgcccagctaatttttccatttttatagagatgggatcttgctatgttgcccaggctacatttttttttaaatcatgagtttttgaaggaaattggatagggcaggctgtggtaggggatggattggacaagcccctgcttgaatgcctgcatacagtggggaaaagggggatcaaaatgggtcaagccttaagggtccctcctgcacgcagtgtccaggtgcaggtctgggatggcagaagaaccacaggctcatgagcactggcctgggcacaggtccacaggtctctgccccgctgcagcttggccctcctctctccaggcctcagttatctcatccatgaaatggagctgatggaattcctgctaaacctgtgcacaggccctacaaggggttaaaagctgaacctgaatgtagcttttttattttttcgagaccgggtctcactctgtcacccaggctggaatgcagtggtgcaatcgctgcagccgtgaactctgcccgggcctggcagggagttggggctctgtgaagtggttcaggaggggagagaaggaccattatcccacgcttctgctacagatcgcagtctctcccctctaaaccgcccttgcccttcgctggctgcgtctccctgctgtgaatggtcgtaattaccaacgtgaggtcgtcagtctgagctgaagtcctctaactaggcggggagagtcagggctggccagggctcttgcactttgccccgagagagagccgtggagccagcccaggcaccacccgagccagttggtttaaaattgtgtacatagcatggctgtgattcagtgagcttggttgtcttttttttttcccccttggcaaatttcagttactccttgggctaacagacagcagactggtaaagataagatgagagttgcccagccagcgttaaagagagagaggagaccgaagaacagaatgagcaggaggcgggcaggaaaaatgtcaagggaaggcctgtccaccaaaggtgtcactgtccaggggcagtgggcaggaggtcgctgctgcggggatgggttctttcagcaggactttctgcacagcactgggggcagaaacatgaaggtgaaaccctacacacactgagtcctaactatgacatttccaaacagagaacactctgaaatgtttgcaactgtgggtgtctttacagccagcctgggttcaggggagctcaggcaggtcctcccgagaataggtttgctgacttggtgttccggacggtaaactaaacccccttttctggggggggttggggggagacggagttttgctcttgttgcccaggctggagtgcagtggcgccatctcggctcactgcaacctccgcctcccgggttcaagtgattctcctgcctcagcctcccaagtagctgggattacaggcacccgccactatgcccggctaatttttttttattagtagtagagatgaggtttcaccatgttggccaggctggtcttgaactcctgacctcagctgatccacccacattggcctctcaaagtgttgggatgaaaggcatgagccaccgcatgcccggcccattgctgctttacagatgaggacatcgagtggttcagggacttgcccagggtcgcgagctgattgcagagctgggatttgaacccaggcaatcagtcttgggtagaccactgggcttgtgaccctggccttgaagggcccggtattgctcctgcccctgcagtgtcctcagcagctctctgaggcgattctctgatccgtgtttttcccgtgagcagattagactcaaaggtgaccgggcatgctggagctgccctgccccacctgaggccgaggccaccactgcccacagcagtccttggggaactccctggtggcgacctggtggtggtggcaggagcctggctctgttgggaaagaggactcatgaccccacctgcagctctccgagatgctcagctggtctgggcacgatggctcacgcctgtatctcagcactttggaaggccaaggtgggtggattgcttgagcttaggagttgaagaccagcctgggcaacatagtgagaccttgtctctacaaataacacaaaaattagacagacatagtggcacacacctgtagcaccagctactcaggaggctgaggatggaggatggcttcagctcaggaggcggaggttacagtgagctgagattgctccactgcgctccagcctgggcaacagagccagaccatctcaactcaaaaaaataaataaataaataaagcttggctgggccatctgggttagcaaggatcttagcattctccctcagggctaaccagggtgcgtgggcgagctgtctcggttgcagcgggggccacgattcctgtcgggcaagactggtgccagcctgcacacctcagagcccaacaggaatatctgttcagatcgagacgttgccctttcccctgcagggcacggctagagcacagacacaaacccagtgtcaggtccccagacacggcaggggacaggggagttggtcttcacctgtggttcaggttccctcccagacagtgagtcacttatgtgcccaaggagctgcctctggtgcactcacagttcccagaagatctgggatgggactacaggtgtgcaccaccatgcccagcattttttctttttttttggtagaaacagggtttccctctgttgcccagactggtcttgaactcctggcctcaagcaatcctcccacttcagccttccaaagtgctgggatgacaggcatgagccactgtgcccagcctgtagtgctttttgatatgtgagattagatccagcaggcccagagtcccagttgaggaatgtggaaacaggctcagagaggttgagtgactttccatacaccacacagcattagggattagaatcaagattgccttccagtctgatgagccagggactttccccatacctggccctggggatcccccttttccccactgtatgcaggcattcaagcaggggcttgtccaatccagctcccaccagagcctcccctactccatttccttcaaaaactcacgatttaaaaaaatgtagcctgggcaacatagcaagatcccatctctacaaaagatggaaaaattagctgggtgtggtagcccacacctgtagtcccagctactgcactccagcctgaatgacagcaagaccctgtctctaccaaaaaaaaaaaaccacgtaattctctttactctaaattaaataaaaagaaagaggtaggaaaatgcaagaacagctacagagaaaaatcagtgttcttcctgagcttgatgttgactgagctagagaatcccacagacaaggtatattgtgggccttgcacagtgtctgcacgtagtatgtgccaagcttgttttttattttttaatttttgtttggttgtttgtttgaaacaggatctagctcagtcacccaggctggagtgcagtggggcaatcatggcttactgcaacattgaccttccaggctcaagcaatcctcccacctcagcctcccaagtatctgggattacaggcacacaccaccatgcccagctaatttttctttttttttctttttttttttttttttttgtggagacagggtcttgccatgttgcccaggctggttgcaaactcgtggcctcagtctcccaaattgctgggattacaggcgtgagccactacatccggccagttcttggtgttattgacaaaggcatttagccccactccacccctcccacactccagaggtggtcaggacgcctccccaaactgccagccccctcagccagcccggccccactttcctgacatgcacactcccaccacttctggtccaccgcctgggacctgtgccccatatagaattgccatagtatcctatcgactgccccgtagtgtcactcctggttagctgcagcctggtttagggttgcacttcttcccagaccaggcaagacttggaaggaagaggggaagtttcctgattggctaaagcatgttgagcacctgaaatcacaggatactacaagtttccttgtgtcttactcaccgctcacaactgccttggaggtccgtgtgatgagccccagcgtgcagatgagcccacatccttggagctttgggccccgtgtggtggtcacctcctctgggaagtcctccctgactcccagctgggtcaggatccctgctatagacccccgtgggccatgtaaaccaaaagtgcctgaaacaggtctcaatcaatttaaagatttattttgccatgggggaggacacagccaggaaaaagagactcaagctgcaatagggtctgtggcctgtgcttttttccagagttttgaggactttggtatttaaaggggaaagagggcctgggtacggtggctcacagcactttgggaggccaagccaggtggatcacctgaggtcaggagttcgagactggcctgggcagcataacaaaaccccatctctactaaaaatacaaaaaattagccaggtgtggtggcgggtacctgtaatcccagctactctggaggctgaggcacgagaatcactcgaacccggtaggcggaggttgcagtgagccaaaatcatgccactgcactccagcctggaaaacagggagactctgtctcgaaaaataaaaaaataaagggggaagaggaatagttaatgatgtatttatcctgtgctcagtaaatctgccttttacataagataaagtaaatagagtagaggaagtcatataggcatttgtcttgggtagacagagcaatgatttctattcttatctttgtcccctgcctgtgaagataagctgtgaatttacatggccagggtgagggaggccaccaggggagctaggtggccttctatcttgcagccatctgtttaggaacaaaaggctattgcgtgactcagttcccaagcttaacatttccctttggcatagtaagtttggggtcccatgttttttgtttgtttgggttttttgtgtgttgttgttgttttgagatgaagtctcgctcttgtcccccaggctggagtacgatggcgcgatcttggctctctgtaacctccgcctcccaggtttaagcgattctcctgcctccgcccccggagtagctgggattacaggcacctgccaccacgcctggctaaattttgtacttttagttgagacggggtttcaccacgttggacaggctggtctcgaacttctgagctcaggtgatccacccacctcggcctcccaaagtgctgggattacagatgtgagccaccgcgcccagcctgtttggtgttttttttttttttttttttgagacggagtcttgctctgtcgcctaggctggagtgcagtggcgcaatctcagctcactgcaacctccacctcccagttcaagggattctcctgcttcagcctcctgagtaactgggattacaggcatgcaccaccacgcccagctaattttttgtatttttagtagagacggggtttcaccatgttggccaggctggtctggaactcctgacctcaagtgatccacctgcctcggcctctgagagtgctgggattataggcgtgagtcaccgtgcccggtctgggcctcgtctttgagaggcctgctaagcttctttctgtcctgcaggtttcgtagagctctgactttgagtctcgctctgtcccgacacaggagaagacagaggtgtggcattgtgggctgagagcaacagattagaggaaactatcttaaagattaagccttctttctacagctactgtaggggagcctgggcatggtggttcacgtctgtaatcccagcactttgggaggccgaggtgggcgaatcacctgaggccaggagttggagaccagcctgagtaacatggtgaaaccccatctctactaaaaatacaaaaatcagccaggtgtgatggtgggtgcctgtaatcccagatactcgagaggctgaggcaggagaatcacttgaacccagcaggcagaggttgcagtgagccaagatcgcaccactgcactccagtccagcctgggtgacagagcaagactcttccaaaaaaaaaaagaaaaagaaagaaactgtagaggaatctgagacctcaggaaacccagggctcatggtagagtggaaagaccagggctttggggttgacacagagtactcctggtgcttagaggctgtgtgaccttgggcaagtttctttacctctctgagcctctgtgtctttggctgcagtgtctaggaaagcatctgcacacagtgatgtgtgtgatccaggccatcctttctctgttctgtgcatgcatggccatgcctgctgagaatcctgccaccaaagattcctcagtggcatggggacagatggaatgtgctgttgcttccctgcaggctctaggagctggtccttgggcccaggactccatcactgttgtctgcatggatttggacaagggtggccttgattcttcccacatcctagtcctgaaaggaaggcccgtgttgggtcacaggagaagacgagggttctaggggatgtggagcgtggggtctttgtgtggctgaattagaggcattactccacgagatagggacacgggaggaggacgttgtctggaatggctgatgtttgcagtgtctctgggcacgcaggggggctggcgggccgtgcctgaagacagatcagcaactcagagatgtgcagagattgctgagtgtgggtgtggacggaccaggccagggacctgcagggtttgggaggacctgaggtggtgggtgttggagccctgggaaaaggaggaaccaggccaagcaggtgcccagcctctgtcctgtgggaagctccctgctctttggggcaacccccacatggggaacagggcctccattctggcagcttgcgcacgggaggccaagccacccagacggggtcagcagactctaagcagcacagagcaccacgccaggagatgcagttcccaaggcagcctcctaaacagaagtgagctcttcccagagttttcaagattaaaagagccagacacagtggctcacaactgtaatcccagcactttcggaggctgcggacaggaggatcgcttgagcttaggagttcgagaacagcctgtgcaacagagagagactctctctacaaaaaattttaaaaaaacttagtctggcatggtgattcatgcctggagccccagctacttgagaggctgagtggggaggattgcttgagccaaagagttcaaggctgcagtgagctatgatggcaccactgtactccaacctgggaaacagggtgagaccctgtctcaaaaaacaggagtcaggctgggcacagtggctcacgcctgtaatcccagcactttgggagaccgaggcaggcagatcacctgagctcaggagtttgagaccaccctggccaatatggcaaaaccccatctctactaaatatacaaaaattaaccggacgttgtggcaggcgcctgtagtcccagctctcaggaggctgacgcaggagaatggcttgaacctgggaggcagaggttgcagcgaaccgagaccgtgccactgcactccagcctgggcaacagagtgagactctgtcttggaaaaacaaaaagaaaaaaaaacaggagtcattttgctccaaagacccatcagtctgctctgccctgaatcatccggccctggctccctgcctgcgtctagctccaccccacaacatctcacccttaccgaacccgcctgccccaagaggcccagcccatgtgaccccacgcttctcagagaggagatttcctgttggacatgcaaaccacccttcctgcaatcccagccccgtcctcaaccctggcacaagcccacaggctgctgcagagctctgccccagaccccatctccagcccaacccccactcagccttacagcccagctcaggccccatctccagggctaactgactccagcagctcctctaggctacagggaggggagagcagagcacaccagggctcaagcagcagataggccgtgacggttacctgggcagtgagcagggagaatgcacggcccccacactcccagacacggtctgtttcccattcacagaccttggtcagcgagcggtcaggggatttccaacagcccagcacagtgacaccggcccctgtgcatggaccccactaggcccatcagtcatctcccctgtaccaccccaaagttcagccacttccaggacatgggatctttttctttttttcttttcttttcttttttttttttttttttgagacggagtttcgctcttgttgcccaggctggagtgcagtggcgcgatctcagctcactgcaacctccgcctcctgggttcaagcagttctcctgtctcaatctcttgagtagttgggattacaggtgcccgccaccacactcggctaatttttgtatttttagtagagacggggtttcgctatgttggccagggtggtctcaaactcctgacctctggtgatctgccaatctcagcctccctcagtgctggggttacaggcgtgagccaccgcacccagccaacacaagatctttcacgcttgagtgcctatgcatggctggtccttctgtcctggtggcttcccactgccactccgtccttcacaaactcctacctgcctttttggagcccattttttgtttgtttgtttgttttcatttttgtttgagacaggtctctgtctcccgggctggactgcagtgacgtgatctctgctcactgcaacctccaccttccaggctcaagtgattctcctacctcaccctcctgagtagctgggactacaggtgcccgccacatgcccagctaatctttttgtatttttagtacagacggggtttcaccatgttggccagaatggtctcgaactcctggcctcaagtaatctgcctgcctctgcctcccaaagtgctgggattataggcatgagccaccatgtcaggccttgagagcccattcaagcatccttctctcttgggggaggtctccccagacttgcccacagagggtgggcaccctcattcatgccccttgtctcctaagtgtgtcctgttgtactttagtgaccagatgacaccccctctggctgggagcccctcagggaagcagccctgcctcttctctttaggttgttttgtgcccaacacagggcctgtgctggggacactgataaaaaaatgtgggatgggctggccaccgtggctcacatctgtaattcctgaactttgggagggcaaagcaagaggatcacttgaggccagcaagaggatcacttcagcctgggaaacatagcgagactccatctgtacaaaaactttaaaaaattaggcatggtggcacacatctttattcccagctactcaggaggctgaggtgggaggatcacttgagcctgggagttggaggctgccgtgagctatctatgatccactgctgccttccagcctgggtgacagagcaagaccgtgtctcaaaaaaagaaaaatggatggagggacagaccaataactgatgctagaaaccagctgcagccaggcacagtggctcacacctgtaatcccagcactttgggaggctgaggcgggtggatcacctgagccaggagtttgagaccagcctgggcaacatggtgaaaccccatctctactaaaaatacaaaaattagctgggcatggtggcacgtgcctgtgatcccagctacttgggatggtgaggcaggagaattcgcttgaacccagaaggcagaggttgcagtgagctgagatcacgccactgcactccagcctgggcaacagagcgagactctgtctcaaaaggaaaaaaaaaaaaacagctatataggagtgggtcggccctgcagagaatgtaatgttttggcagatcagggacgcctggtgggagaagcagcaggtccagtggctaagctggtgccaactctcatgcccccttgtcttcctcttgtagatgaagatgacgccaacagactcggggagaaggtgatcctgcgggagcaggtgaaggaactcttcaacgagaaatacggtcagtgcctgtggtcagggtcagcacaccaagccctcctcccgggggtggtggggggcctccctctgcagccagcctggctttcaggagcccccagctggctgcctgctccctggtgacatggctgctctgcccatgacccacgttttgtgtatgttgattttttttttttaaacagggtctcactctgttgcccaagctggagtacagtggcgtatctccgctcactgcagccttcacctcctgggcttaggtgatcctcctgcctcagcctcccaagtagctgggactacaagcatgcgccaacactcccggctaatttttctatttttagtagagacaaggtttcactatgttgcccagactggtcttgatcttctgggttcaagcgatcctcctgccttggcctcccaaagtgccaggattacaggtgtgagccaccatgcccagcctgtaggtcttgatttttttttttttggagacagagtctcactctgtcgcccaggctggagtgcagtggcgggatctccactcactgcaagctccacctcctgggttcacgtcattctcctgcctcagcctcacgagtagctgggactacaggtgcccgccaccacgcccggctaatttttttgtatttttttagtagagacgaggttttaccgagttagccacgatggtctcgatctcctgacctcgtgatcctcctgcctcagcctcccaaagtgctgggattacaggcgtgagccactgcgccccaccagggtcttgatttttaaactctctgggtgtgatggctgctgggctagggcagcccagactccagccctttccctagagggctttgccattgacaggagacatctttcctcactgtgacttcctgtgccctctaggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccagtgagtgcccggcctctggaacggggaacagagagggcgaggccatggggagggtgaaagtcaaggtcacggtgggtcagctgggatccagacccaggtgtactgtaatagttcctgcctctttctcctgaaacatacaacttcaacagtcatggacatttacttatttttaaagatttttttttagatattacatttgttctctggggaaaaaacaaaacatgttttaattaaatttgactttttctgactatacaattctgatttttaacatttaaatataaatatgtttatttaaatatgaatatttattatatattttagaataattataattccatagtctcagtgattctcttttttttttttttttttttttgagacagagtcttgctctgtcacccagtctggagtgcagtggcacgatctcagctcactgcacgcttcacctcctgagttcaaccgattctcgtgcctcagcctcccaagtagctgggattacaggtgtgcaccatcacaccggctaatttttgtatttttttggtagagatggagtttcaccatgttggccaggctggtctcgaactcctgacctgaagtgatctgcccgcctcagcctcccaaagtgctgggattacaggcgtgagccactgcacccagcctgcattattactattataccgtatatccttacaatcttttgggttttggtttttgttttgagacagggtctcactctgttgcccaggcaggagtacagaggtatgatcatggcccagtgcagcctcaacagggtctcactgtattgcccaggctggtcttgaactcctaagctcaagtgatcctcccacctcggcctcccaaagtgctgaggttacaggtgtgagccaccacacccaaacctgggtggcccagttttttttttttaatacaatagattatttgattattttcagaataatacacacagcaacctggaaaatacaaaaagatagaagaaaagaagatagctgtaactctcctactgaaagtcaacactgtgatgcatttctttatatttttaaattattattttattaatatattattactttctttttgagatggactctcgttctgtcacacaggctggaatgcagtggtgtgatctcagctcactgcaacctccaccgcccaggttcaagcaattctcctgtctcagtctctcaagtagctggcactacaggcacacgctaccacacctggctaattttttttttgtatttttagtagagatggggtttcaccatattggtcaggctggtctcaaactcctgacctcaggtgatccacctacctcagcctcccaaagtgctgggattacaggcatgagtcaccacacccagccccccctttttttttgtattgcacaggctagtctcgaactcctgggctcaagccatcctcccatgtcggcctttcaaagtgctgggattatgggggtcagccaccacacctggcctgtggtgtatttctttctttcttttttttttttaagatggagttttgctcttgttactcaggctagagtgcaatggcacgatctcagctcactgcaacctccacctcccagattcaagcaattctcctgcctcaccctcccgagtagctgggattacaggcatgtgccaccaccccagctaattttgtatttttaatagagacagggtttctccacgttggtcaggctggtctcgaactcccgacctcaggtgatctgcccacctcagcctcctaaagtgctgggattacaagcttgagccaccgtacccggcccgccttcaatgttatattatgtgttttgtttcttcgtttttttgagatgaggtcttgctctgtcgccctggctggagtgcagtgccgtcatcttggctcactgtaacctctgcctcttggattcaagcaattcttgtgcctcagcctcccaaatagctgggatcacaggtgcccgccaccacacctggctaatttttgtatttttgtagagacaggttttcaccatgttggccaggctggtctggaactcctgaccttaagtgatccgcccaccttggcctcccaaagtactgggattacaaacatgagccactgtgcctggcctacatgtttttttaaaattacgataatatttgcgtgtgtcaaaaaaaaacaaattgttcaaaatcaaaaagtagaggtttcctttctcccacagacagttcaccccctgaagtaacaactagaaaatgcaggaaaacggccaggcgtggtggctcacgcctgtaatcccagcactttgggaggccgaggtgggtgaatcacctgaggtcaggagttcgagaccagcctgaccaatatggtgaaacctcatctctactaaaaaaaaaaaaaaaaaaaaaaagatacaaaaattgggccaggcacagtggctcacgcctgtaatcccagcactttgggaggccgaggctggcagatcacaaggtcaggagatcacaaccatcctggctaacatggtgaaaccccgtctccactaaaaatacaaaaaactagccgggcgtggcgcagggcacctgttgttccagctactcgagaggctgaggcaggagaatggcatgaacctgggaggcggagcttgcagtgagccaagatagtgtcactgcactccagcctggatgacagagcgagactccatctcaaaaaaaaaaaaaaaaaaaaaattagctaagtgtggtggcatgtgcctgtagtcccagctactcaggaggctaagacaggagaattgcttgaacccagaaggcagaggttgcagtgagccaagattgcaccactgcactccagcctgggcgacagagtaagattctgtctcaaaaaataaaaataggctgggcgtggtggctcgcgcttgtaatcccagcactttgggaggccaaggcgggcagttcacgaggtcaggagttcgagaccagcctggccaacatagtgaaatcccatctctactaaaaatacaaaaaattagccgggcatggtggtacacgcctgtaatcccagctactcgagagcctgaggcaggacaatcgcttgaacccaggaggtggaggttgcagtgagctgagaccatgccacagcacaccagcctggacaacagagcaagactccgtctcaaaaaaaaaaaattaattaataaaaataaaaattagccgggcatggtggtgtgcacctgccttcccagctactgggaaggctgaggcaggaggatcgattgagcccaggagttcgaggctgcagtgagctaggatggcaccaccgaactccagcctgggcaaaagagtgagactctgtctcaaaaataataattgataataatgctgtgatgaatatccacttgcataaatctgggcacacatttctgatcacttggtcagacaacatcctcgctttatagatgaggacagcagacccagaggaaagatttgccagcacaggcccatcatccagggcctatatgggggatgctctgttgggacgttgtgccccccatttttatttgggtcttaccaggctcccccagcagcagcagcagcatatctcagggagcaggtgagaaggaggggaaaacagccagacacctggattctccgggcgcgatggctcatgcctgtatcccagcactttgggaggtggaggcaggcagatcacctgaggtcaggagttcaagaccaacctggccaacatggtgaaaccccgtctctactaaaaatataaaacttagccgggcatggtggcgggcgcctgtagtcccagctactcgggaggctgagacaggagaatggcgtgaacccaggaggtggaggctgcagtgagctgaaattgcgccactgcacttcagcctgggcaaccgagtgagactccatctcaaaaaaataaaggaggggaaaacctcattttctaactgccacctcatttctttctttttcagaccctttgcagaaatctgcaatgatgccaaggtgccaggtgagtcagaggtgaagaagccacccttctgctccgtggggactagagactgttccatttgaaaaaaggtagacccgggcgcagtggctcatgcctgtaatcccagcactttgggaggccgaggcaggcagatcacttgaggtcaggagttcaagaccagcctgagcaacatggtgaaaccccgtctctactaaaaatgcaacaattagctgggcgtggtcgtgggcacctgtaatcccagctactcaggggactgaggcaggagaattgcgtgaacccgggaggcagaggttgcggtgaactgagatcgcgcccctgcactccagcctgggtgacagagcaagactccatctcgaaaaaaaaaaaaaaagaaagaaagaaaaaagcagagacaccaggagttggaggctgcaatgagttatgattgtaccactgcactccagcctgagcaacggagcgagaccctgtctctaaaaaaaaaaaatttcataaaaaaattttttaaaggcagaaatagatgtggtccaggtgggcatgcaatagatggctgaccaccttgagaaaaatatagcccctctccacgctggggcctccccagggagcctgaggtctccatgaacagagccaggtatccccaagaggcctccagaaacctgcaggtgccctgcagaggggaggccttgccatagcaccagtgagtgtatgaggtcagctggaaggacaagaggcaggctgggcctcagggaggatcatggagtcctcctgggtagcagaggggtagcacgtgaccaacagtggtgaggcaggcaggcattgcccgagactggccagaccccctctgttctgctggcatctgcagggtatacagaacctttcactaggcacctgggggccgcctggcatgatggttctgattaaggtgtatgatgggacttgggagaaagtactcccgggtgactatgatgtgcacctgattaagaaacactgattgggccaggcgcagaggctcacacctgtaatcccagcactttgggaggccgaggcaggcatatcacttgagatcaggagttcaagtccagactggccaacatggtgaaaccccatctcaactgaaaatagaaaaatcagggccgggcgcggtggctcacgcgtgtaatcccagcactttggaaggctgaggtgggtggatcacctgaggtcaagagttcgagaccagcctggtcaacatgctaaaccctgtctctactaaaaatacaaaaattagccaggcatggtggcacgtgcctgtaatcccagctacttgggggctgaggtaggaggatcgcttgaacctaggagacagaggttgcagtgagccaagattatgccactgcactccagcctgggcaacagagcaagactctgtctcaaaaaaaaaaaaaaaaagaaaaagaaaaaaaaaattagcctggcatggtggtgcacgcctgcagtcccagctacttgggagtctgaggtggaagaatcactttagtccaggaggcagaggttgcagtgagtcgagatcacaccactgcactccaggctgggtgacagagcaagactctgtctcgaaaagaaaaagaaaaagaaacactgattggccaggtgtggtggctcacgcctctaatcccagcaatttgggaggcctaagtgggaggactgcttgagtccaggagtttgaaaccaacctgggcaacgtagtgagatcttgtctctacaaaaagttttttctcccatccaagtactaaccaggcccgaccctgcttcagttctgagatcaggcaagatcgggtgcattcagggtggtatggctgtggaccaaaaaggtttttctaaaaattagccaggcatggtagtaggcacttgtagtcccaggaggctgaggctggaggatcacttgagcccaagagtttaaggctgcagtgagctatgattatgccatcctgcctggatgacagaatgagaccccatctcttttttttttttccgagacagcgtctcactctgtcgcccaggctggagtgcagtggtgtgatctcggctcactgcaacctccgactcccgggttcaagtgattctcctgcctcagtttcccaagtagctgggattacaggcgcctgccaccacgcccagctatttttttgtatttttagtagagacggggtttctccatattggccaggctggtctcgaactcctgacctcatgatctacctgcctcggccccccaaagtgctgggattacaggcgtaagccactgctaccggccttttttttttttttttttctttcaagacagagtctcactctgtcactcaggctggagtcaatcttgcgatcttggctcactgcaacctccgcctcctgagttcaagcaattctcatgccttagcctcccgagtagctgggacttcaggcatgcaccaccacacccagctaattttttgtatttttagtagaagtgaggtttcaccatgttggccgggctggtctcaaacacctgacctcaagtgatcttcccaccccagcatcccaaagtgctgggattacaggcgtgagctactgtgcctggccgagaccccgtctcctaagaaataaaaaagaagaagaaagaaaaaatactgatctaatcttaccccacctcattgtacagctgggaagctgaggcacagagatgcccagggacttgcccaggccacatagtgagtcagatgctgtgtagaccctgctctcaggaccacccatctgaaccatagaccaccgtgggccacacggcccagtatggctgctcaacagggacagtgataggattcagcaagtccacgccacaaccttacctgagacccaaggccctgactcctgtcaggaccaggttcacctggaactccacagcctggggtggcacagcccagctagaagccacctccttccatcaagagctagtcacaagcctgggccataaagtgagaccctccctccgtctctgcaaaaaaattaaaaattagccaggcgtggtggcgcgtacctgttgtcccagatagtcaagaggatgaggcaggaggagtgcttgaggccggaaggtggaggctgcagtgagctatgattgtgccactgcgctccagcctgggcgacagagtgagaccctgtttccaaaaaaaaaagagccagttaaaagggtcaggtctggcactgaacacacggatctggaggcgatttggtttactctcaggtcaaaggcagagaggaggccagtcgcggtggctcacgcctgtaatcccaacactttgggaggctgaggcagggaggcaggtggatcacctgaggtcaggagttcaagaccagcctggccaacatggtgaaaccttgtctctactaaaatccaaaaaaaaaaaaattagccgggggtggtggtgggcgcctgtaatcccagccgctcaggaggctgaggcaggagaattgcttgaacccaggaagcggcggttgcagtgagctgagatcacactactgtacttcagcctggggaacacagccaggctctgtctcaaaaaaaaacaaaacaaaacatggcagagacacagaaggccacatgaaagcctcaggaggatttgggacagatgcccagagggtggatactgtcacccacatccaccactccctccaatgtggccatctctcatggtgattcaaggatggccacagcccatggaccagtctgagacagagggtggggcagcctctgacttctttttcatgtggaatctcccacaaaaatccctctgactcatagcctgggctcctcctgcctccagggtcttctctttcgcagggtctctatgcctcaccacagacccccagtttctgacttctccaccagttgaagagacatttgccccatggacccagcctgcccttactctgtgtcattaagacccttccggtgggctgagtgcagtggctcacgcctgtaatcccagcactttgggaggctgaagcaggagaattctttgagcccaagagttcaagaccagactgggcaacatacagagaccccgtctctacaaaaaattagccaggcagggtggtgtgcacctgtagggaggctgaggcaggaggatcacttgagcttgggaggtggaggttgcagtgagccaagaccacaccactgcactccagcatgggtgacagagtgagaccttgtctcaaaaagacaataaaagcccttctttattgggctgggcgaggtttccatgcagtaatccatccaatcaggacgtgctgctcaaagtcttacatcttcacctcaagttaatccagcaaccacagaacacctgctgacccctcctccgtgctgaactaggtgctgggttcttttatgcatgcggtgttttttgagtctcacatcacactggtttccccatttgactcagagaggttcatcagttttcccagattcacacagtgataatagtaagtggccacagtgaaatttgaacttaggacttctgattctaaaccagagtttctttcactggggcactgcctgtctacttggacctgtgaactctccactcaggaccaccatacattagtgataaccatagcaatacaatttttttgtattttggtagagacagggtttcaaccttcaccatgttgcccaggctggtctcgaactcctgacctcagtcaatccacccaccttggtctcccaaagtgctgggattaccagtgtgagccactgcgcctggccccaggtcctctttataccctccctggacaacctagcctgcagttccagcctccccagaactcccagagcctctcctggggtcccacatcccctcacagccttaaagagcccaggaaagaatgtggcctccggagccacgcagacttggccttggagaaagtcctttaacagccctgccccttcgggtgctcgtgagtgaaatgtgaataggatcttggagggttgctgggaggatcccagcagacaatgtgcaaagcatttagcacagtgcccagcacccagaaaatactcagaaactgagaatgcgattaatattgttgccatgagccaggcacggtggctcatgcctgtaatctcagcatttagggaagctgaggcaggaggattgcttgaggttgggaattggagaccagcctgggcaacataatgatgcagaaatacaaaaagttagccaggcatggtggcgcgcacgtatagtcccagctactcgggaacctgaggtgggaggattgcttgagcccaggacttggaagctgcagtgagctacgattgcaccatggcactccagcctgggcaacagagtgagaccctaaaaaacaatataggccaggttcgatggctcatgcctataatcccagcactttgggaggccgaggtggatggatcacttgaggtcaggagttcaagagctgcctgcccaacacggtgaaaccccatctctactcaaaatacaaaaaaattagctggacgtggtggcagacacctataaccccagctacttgggaggctcaggcactagaatcgcttgaacccagaaggcaaaggttgcagtgagccaagatcgcgccactggactccaggctgggtgacagagcgagactccatctcaaaaaaccagaaagagagaggacctagggcctaaggggtgagcttgctggggaggaggagggacacatggggatgaggatacggtgttagcaaaggcaggcaggccagcaagagcaggaggccggggagagtgggccctcgggcttgctttgggaaggaggctggacatgtgggctctggacaggtgggccctgacccccaggggatcaggagcctgaaatcctgaaagggggactcgaaaccttaagacagagcacttttccagggagctcaggaggctgagacagaaaagcctcagcttccagtgtcaacagccttttcccctccttccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagactccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactccatctcaaaaaaataaaaaatataaataaatagcctctgagaaagctcttccaaaagcagaactaagcattttgggtttgttccgcatcacctggagtcctaatccagtccctttgtccctctctctagcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaaaaaaaaaagagtgttgcctttacttttacggtcactgtttcatgttctcttttggatcgtggccgcagctgtcactggggacagggtcaggaaacgcagctcaggtggcctgccaaggccctccttcttcatcacagcagaggtagtgtccaggaagaccccagagctctctgtgctcctgggagcacgtgacctcaagaagaaaagccacggaaggaaaatgtgccacggggccgggcgtggtggctcatgcctggaatcccagcactttgggatgtcgaggtgggtggattgcttgaggtcaggagttcgacctcattggcctgtaataccgatgctttgggaggccaaggtgggaggattgcttgagaccaggagtttgagatgagcctaggcaacatagtagaaccctttctctagaaaatgttaaatgtggcttacacctgtaatcccagcactctgggaggctgaggcgggtgaatcacctgaggtcaggagtttgagactagcctgggcaacataaggagaccccgtctgtacgaaaatgcaaaaatgaggccgggcatgatggctcatgcctgtaatcccagcactttgggaggccgaggcgggtggatcacctgaggtcaggagttcgagaccagcctggccaacatggtgaaaccccatctctactaaaaatgcaaaaattagccaggtgtggtggcgggaacctgtaatcccagctactcaggaggctgaggtaggagaatcacttgaacctgggaggcagaggttgcagtgagctgagaccacgccattgcactgcagctggggcaagaagaacaaaagtccgtctcaaaaaaacaaaacaaaagcacaaaaattagccaggcgtggtggtgcacacacctggagtccagctactcaggaggctgaggcaggaggaggattgcttgagtaaagatggttgaggctgtagtgagtcatgattacaccactgcactccagcctgggcgacaaagcaagaccctgtctcaaaaaaaaaaaaaagtgttaaatatggtaaatgtcagagagggaggggcccatcccagtgaagcactgtggctggatgggaggcttcttcaaaaaggggtttggagaccaggtgcggtggctcacgcctgtaatcccagcacattgagaggccaaggtgtgcagatcgcctgaagtcaggagttcgagaccagcccagccaacatgatgaaaccctatctctactaaaaatacaaaaaaattagccaggtgtggtggcgcgcaactgtaattccagctacttggaaggcagaggcaggagaattgcttggacccaggaggcagaggttgcagtgagccgagactgtaccattgcactccagcctgggcaacaagaatgaaactccatctcaaaaaaaaaggggggtggggtgggggcaggacaagttttcttttttcagaggcaagttctttctgtgtccccaggctggaatgcagtggcacgatcatatcttcctgcagcctcaaactcctgggctcaagtaatcctcctgcctcagcctccagagtagctgggactacaggtgtgagccaccacacccagctaattttttgatttttttgtagagatggggtcttgggttatgttgcccaggctggctgcaaattcctgggctcaagccatcctcctgccccagcctcccagagtgctgggattagaggcgtgagccaccatgcccagcctgggatgattttggatagagctctggatacctgacaagcagagtgatggggtcccagctgtgtctcagaaagaccactttaggggcaggtgggaagttgaaggaagggacaagactgaaggcagaaagacaagtcacaagagcgtggcaggcgtccaaggcctggcacccagtccctgcttattgggtgacacatatttactgagccctgcccttctggctggggaggccaagcagctgagtgtcctaattggggaggcagctgccaggga

SEQ ID NO: 17519 - DNA, 152822 bp, Human; identical to SEQ ID NO: 17518

SEQ ID NO: 17520 - DNA, 26709 bp, Human
agccatgtgctaaggtcaaaactaggtgaccttgggcaagtctctttctctctgggtggttccacagctgttaaacaggtttggaaattattatctacaggtaaagcacccataatggtgccagacaccttggtaggtccccaatatatattgtgtgccaggaattttacatatttactaatttgaatctttacaacactgaagaggtaggtgacattattatatagatgagaaaacaggcatgttaaagcggttaagcaacgtcctcgaggtcactcagccagtaagacgttaactgagcctaggttcaatctaggtctatcaggcagcaaagtgttttattacttgggaagaaaaaggcacagaaaaatgaataagtgagttcaacactattaactcatgaattgataatgctctgtccatcttaacactgctatgaaggagaagatactcaaatataaaagttggcagggcacagtggctcatgcttgtaattccagcactttaggaggcagaggcaggaggactacttaaaagccagtagatcgagacaaacctgggcaacatagtgagactctgtctctacaaataaatgttttacaaagcaaattagagccaggcacggtggctcatgcctgtaatcccagcactttgggaggccaaggcgggtggatctcagttcaagaccagcctgggcaacatggtgaaacgctgtctctactaaaaatacaaaaattaactgggtgtggtggtgcacgtctgtcaccccagttactcgggagacagaggcaggagaattgcttgaaccgaggaggtggaggttgcagtgagatgagattgcgccactgcactccaacctgattctccatctcaaaaaaaaaaaaaaaaaaatgcaaattaggcgaggtactgcccgcctatagtcctagctactccagaggctaaggcggcaggatggcatgagcccaagaggtcaaggctgccgtgagctaccactgttccaccgcagtccagcctgggcgacagagcgagaccctgtctcaacaacgaaccaataaatacataataaaaagtaatggttaagcggaagatacctaggtacacatcacaacaaaattctatgaggttctttcaaagtgtgcttagataattaaggtttgtcaacatcgtggcatccacaattactaccatctcaatcacaaacctggaaatttacccgtgtaattaattcccactgcataaccatgttttgttattgctagatgatggaatccacaacagtatccaattctttttccaaggcaacgacttctgcaaaaaaccgagatgtgcagtctctcttgctaagtcaccgatcacctatactctctcctctcaaaaccccccaatacccaggcagcgagtaagccctggaaggcaggattcgtgtctgcatcccaccgcctcgcacccccttccggggcatcctcatcgtgtggccagctcctgcctggagaaggaggtggcctttacttgggtgtcacccggggaccacttgggggtccaagcgggacaggcctccgaggtccccgccatgtatggaggccgaaaggcagcgtcccaggcgaactggagagggagttccccccagctctccaggtcacctcccgccgacggacggaaaggccggcgcgcacgggcgtggtgcggcggggataggaggcagccacgggcgcaccccagggccagcacataatgggccgcgtaggccgggcaggcgtccagctgggacgccgccgcaccacgtgggctgcagagcgcacggggcaggcagctgccggtgggcccagggccgggcgctgcgcggccagcgtccgtgcgtgcgtgcgcgcgcgcgcgtgcgcgtgcctgcgtccaagggatttgcgatcaggcggcgcggcggacagccccggcggcggggcggggggagttatattgcggggtccttcctcgctcaccctggttcctctcggagcggagacggcaaatggcggacttcgacacctacgacgatcgggcctacagcagcttcggcggcggcagagggtgaggcgggcgtgcgcgggccccgtcgggggctgcgggaccggcggagtcggggccgtcagggtggcggccgtcctgcgctcagccggggcggcgggaggcgggggcccgcggaggcctaggagcggcgcctggagggccggggcctggaaatggcgcgctcggagacggggcggcggcggctgggctcccggggtcttgcttgcggggcggatcccttccactgcctcccgccaacgacaacgtgttggtttttgccctgccttggccgcggcggcgccgatgcccggagacgagcgcccgcttccagccccatcccccctacggtaggaccagtgcggggctgagctgtggcgctggggtacgggccacacggcctgccccgctccggtcccggcctctttcgcggccctctgttgcctgcccgccttgcaggcccctggccccttcgccacgaggccggccgactggggaaggtcggcagccaagaggggcgattcccttccccttacgtgtgaggcagggatttggcggctctggcccggggatggtacgactccttgcgggcggggggagaccaaggagacaaatccatcgtagcttctttgtattaatctttcttgggtcacagtgccttgacaggtgctacgtgctctttggcacaatttcatttctccttggtttctcgctctgatctggagaaggaaccgcatttagcgtcgtcctgattgttgtcaaatgcagacaactatgtataattgaaacactttgcttaaaagaaacatctttgaatagagagctcatggtgtttaattccaggactctgcacttttttttattttattttttaaatacaagttgcctcgttagaatataggctatgaacatcttgctgtttgtcaaggacacacttgggctttgtgttttcttgcagaaaggattactttcccaggataacaccacaataatacacactgaggtgttcagtctcctgggttgcagtccaaaagtatctttgtttggtaaagaatgatcacttttaataccttggtttgggaacggctcagacaaaagcttgtttcggggcaggagtgtagctaatgttcatgatactgtaacgtggaagtgtgccggtgtaggtggagctattgtcattccaaagaacattttatttgctaataaaaaaagaagtaaatgttggatgacatgaaattatcgcctttgggttaggtttctaaacatcaaatttgttctcaagtcatttcgaaatttaataactagggtttttttttttttcctagttccaaaaaacgttcacagaagtacccagaaaaattcttcttaaacagcgtggtcaatttaagttttagttgcattgggactacaataaggtgaccttattaaactgagtgtggggatttaaaaaaatttccttcagacacatttgccagctcttctggtgtcaaattttgacatttgggggtgccaggaacaatcagaagtaaaattctattaagatgctattaatttcaaatctccacagcagatgaaaatattagccatttgccccaggtgtactccaaaaactgataggagagtttcctaggtagcactgtgcatcacttgaacttcctaatagaaagtctctttactgttaagcatcttctatgtctcacttacttggaattttctatttggcttcatattaatgtgaaactacataaagtattgctactttcagaagtagttttaaaaacttgttggtgaatttacatattcatttatacatgtgtattctttttttttttttttgagatggagtttcactcttgttgcccaagctggagtgcaatggtgtgatctcggctcactgcaacctccacctcccgggtttaagcgattctcctgcctcagcctcccaaagtgctgggattacaggcattagccaccgcgcccggcctcaattattttaattatgtccacatgaacaaatgtcactgctttacaatgcttaagcatcatagaagattgccacctatggaaagcagttttaacactgcattgtttggtacttgtgtaggcaccttctcccttgtctaaaatgcctcagacaggctcgtacatctcacctctaaattacttgggtcacaggtgaaagaaatggtaggcctaaaatgaacagttatcatcataaaacatagtttggtagttatacatcttcctaagtttatttcgtagttgtgtttaataaccagtgcagttgtcaggaaacagtattgaaccactgcttttttcccccgagcctgtaagggcatgtccccagcagccagggagagaaccagggactgcattgttcagcaagcaaatcaaaacaaaattccaaatgatcaagagttgattgtaccagatcttgaatggactttgttttgcagtttgctaaattatctttttgaggttccagtttctcatctaccattggcagtaaagtgcagagtaatactgattttatatttctaattgcaacaaagctatgagtgcttagtggaaaaccaccgatcctgagaattagggtggaaattggaggtggcaagaattgaggtggctgaaatggtgccatctaaaaactggcaaaactccaaatttattctttatcaggattcagttagggagtttagaattcttttttaaatagagatgggtttcactatgttgcccaggctggtcttgaactcttggactcaagtgatcctcccgcctcagcctcccaaagtgttgggattacaggcatgagctaccacgcccagcctaggagtttagaattctaacctttgaatctttaaacttagcatgtctgtctaaatttctgagcatatttttatccaaaatttttatggtggtaaaatatacataacataaaatgtgccactttacccatttttcagtatacatttcagggatattgagtgtattcgtaatgtataaccatcaccactatccagctccttaactcttacagcttgtaaaactaaaaccctgtcccctttgaatagtaattccctattgccctccttcccccaggtccctggcaaccaccattctacttcctgtctctgagcatattttaagatttgtatgtaataggaaggaaagcagtgtataaaaactacagctagttttcactgatgctagggcctgtaaagctattgaaaagcttattttaaaatgctgtttacatgtcaaatgtcaagtcgtttaggtttgttatccttcttcactccaagtgttccattgcttagttccaaaccattatcctctatgaaaagtgttaccagaaatatttggatttgctaagaggtctctgcatgacggttcatgtaaaagccctggctttggaataaggcagaccagagtttcatcagttcagccatgtgttagttgtgtgatctgaagtaagtttcttcacctctctgagcctcgttttccccacatatgagttagaaacatgtatttatttatgaaataggctctccttctgtcacccaggctggagtgcagtggcaggatcatagctcagtgcagcctcgacttcccaggctcaagccatcctcccacctcagcctcccaagtagctgggattacagggtgcgccaccatgcccagctaatttttgtatttttttgtagagacagagtgtctctatgttgcccaggctagtctcaaacccctgggctcaagggatcttcctgcctcagcctcccaaggctcattgtgtgagccacagtacccagccttcaatttatgtttctattagaaattaagcttcgtggctgggtgcagtggttcatgcctgttatcccagcactttggaaggccgaagcaggcggatcacttgtggccagaagtttgagaccaccctggccaacgtggcaaaaccccatgtctactaaaaatacaaaacgggtgtggcggcacatacctgtaatcctagctacttgggaggctgaggcaggagaattgcttgaaccagggaggcggaggttgcattgagctgagatcatgccactgcactcctccagcctgggcgacagagagagactgtctccaaaaaaaaaaaaagaaaaattaagcttagtgttctggaaagacttcacaattttaaggagtctccctggaagcttagaacgtacaaagcagactctgaatgtctttccaggatcacactctggcttccagcttcccctggaaggttcaggagagtatttgtcgcctggttgcttttacatcatgctgattagacctgcacacccgggcatgaaatgagtgtgattgcatcattttcatagaacctaatggcagctgtatgtacgtctaagacttcttttgtgtaagtcgaatgttcttcgaagtttccccacgtcatgatttatgtgattttccgtcttgatcaggaccttctgaaggagctcaagtatgtggctgctccacggttgatgagtctctggttaagcatggccttccagttcagggctaggggggccgtcacctccctttgttctgcacattcttctcctgtctttcatgtatactcacatttttggagccttctgtgtactcacatttttggagccttctaaatgtctggcttaatagaacacagctggattctcatacctgcatctgtctccactcttggaatgtgttgctttggttgacttttatggagcagctcaatccttgcacagataaatagttggaaatgggaggagtaatcaaataattctggatattcatatttgattctataccaaaactcaataagcagtagtttctatgaaggttagttgcaatgtgaaacctaaaaccttatcaataaactcttcatacttttacattagagttcatcatttggctgggcacggtggctcactcctgtaaccccaggactttgggaggccaaggcgggcggattacctgaggtcagtagtctgagaccagcctggctaacatggcaaagccccatctctactaaaaacacaaaaactagctgggcatggtggtgggcccctgtagtcccagctacttgggaggctgaagccatagaatcacttgaacctgggaggtggagtttgcagtgagcccagattgcgccactgcactcccgcctgggcgacagggtgagactctgtatcaaaaaaaaaaaaaaaaaaaagtcactttatcttgtactccgactggatcctttaccagtgcatacatttgtaaggtgttggtgatttggaaaggacctgttcactgagccaggcagagccatgcagatgttccagatgttggtacattttgttatacagtatcaaagtcacattcaccatagctgttagaaaagtctctgagtattgaaagactgtcaggcttatgttgatggatacaggttttccgaaactcttttttgcttgaaagcttaaattttaccattggcaacaaatactgttattttggccaggtgctgtggctcatgtctgtaatcccaacactttgggaggccatggcaggaggatcactctagcccagtctggacaatatgtccagacctggtcttttcaaaaataaaattagctggtgtggtggtatatgcctatagtcccacctacttgggaggctgaggctagaggatcacttgagtcctggagattgaggctgcagtgagcagtgattgcaccacagcactcaaatctgggcaacagagcaagaccctgtctcaaaacaaaaaacccaaatactgttcttttacttcaaggaacagacttaacttcatttttaaaaaacttagtacccatgtctgaattaaccatagtttgttctatagaaagaacagctagttcagcttgtagctcaagtgcttttcctgcagcagccatcatgcttgtgtatgcagcagaagtgctttgcgtgtttcataacatagggtactaaaaagtgggtcacgattcatttttactgctttaccaaggatattcctaattgaagctgtgatttttcttcctattttaaatacttcaagtgcatggtgggaaagcatgagtaatgtagtttgatgcccctgccttcgtttgtattaacacaaagacctgttgtgagatcagtataggtctttgctttataaatgtggaatattgtgaaccattctgggaaccatattttaaggcatcagcacactggagcctatgaagaagaaggtgatagtggggatggccaggctctgaaacttcatcttaggaggaagggctgagcagcttcagtgaggaccttcgaaagaagcctcagcagcagtgatacagcagctcttaagtctctgggactgctgagtggaagaaaggtgtggccctccaggccagaataggaccaaaggattacatcttggccttcttcagagactgcacaaatgtaaagaactgctgcttgagctaaataattgtttttttaatagagacagggtctccctttgttgcctaagctggtcttgaactagcctcaagggatactcctgccttgacctcctaaagtgctgggattgcaagcatgagccaccacgcccagcctcaaccatttttaagtgtacaatttagtggcatggagtaccttcatagtgttgtgtaaccattgccactatctagttccagaaccttttcataatccaaacagaaactctatacccactaaacaactccattcctttcccagttttaacctcataaacattttggctatttctgttacatctatcttccctacttttgggtggaggtgtgggctaggataatttaaggctaatcctagtcacctatccttctaaaatagttcttatttttttaaattttaatcctcatctttgtgttggtaaatattacatactttagagcaatttttgtttcaatttttatggctaccgtagtagatgtatcttatatattctttctttgttttttttgttttttgttttgttttgttttctgaggcagagttttactcttgttgcccaggctggaatgcagtggcactatctcggctcaccacaacctccgcctcctgggttcaagcgattctcctgcctcagcctcccgagtagctgggattacaggcatgtgccaccacacctggcaaattttgtatttttagcagagatagagcagaaacagagggtttctacatgttggtcaggctggtctcgaactcccgacctcaggtaatctgcctgcctcggcctcccaaagtgctgggattacaggtgtgagccaccgagcccggcctttttttttgagatggagtctcactctgcctcccaggctagagctcagtggcgcgatctcagctcactgcagcctccgccaccacccctcagcctcccgagtagctgggattacaggcacctgccactgtgcccagctgatttttgtactgttagtagagatggggtttcaccatgttggccaggttggtcttgaactcctgaccttgtgattcatccgcttcagcctcccaaagtgctgggattataggtgtgagccaccacacccggcctcttacatacttttcatacttgagtatgtttctaacagataagggcttcttttttttctttaaccaacagtttttccagtacccagtgttcagtttttcccagtttttgcaaagatgactttgtatagttggattgtttgaatatgcaaaacattacagaaaaatgtagaaaatttagaacacgaaccaaagcataatatagtgacctgtatacccattacctactctttaagtgaccactcttctctatactactatggtttataataggtagtataaatggtatttatcaaaggcttgacctttgaaagcttaaccatttttgatgattgtcaaaaacccaaatgttacctgtttgtagatatggggttttgccgtgttccccacgctggtctcaaactcctgagctcaagtgatctccccaccttggcctcccgaagtgccgggattgcaggtgtgagccatggcgtccggccagtcattttctttggtttacactactttacccttctgggccctactttccccaaatgagagctagaaactcctctgttgggaggtttaaatgagatgtgtctcataatttggaggcatagtcttgccctgttgcccaggctggagtgcagttgcacaatcacagtcccaaagtgctgggactacaggccggagccacatgcccatgcccagccttgagcactcaactttctgttgcatctacttactggatacatccctaccctcataacatctactctgtacattggcttctttttatagttaccctctctcagtctcctttgacacctacagatcttttctggctcaccctaagggttcagtattggccccatctgccatctggaagtggagtcccacttctgttgctctctgctgtgctgcatatcctggctcccaactgctccaccctggtgaaactgttctcattgctatcttccagattttctgcagtcctttgcttgtgacgtgatttctcctttccaaattatcagctccttgagggcagaaaccgagtcttaggtttgtgccttctctacattctctccacccttcatagacatgcagatacgtggttgatttgagtaaggaaaagtgatttgcctgtcaaggattttagtcacacttggagccgaaagtagggtttcctaaattactgaggctgtaattgactactttaatctttcataatcaatagactgtccctaatgggcagtagaaaggacactgctcagtagtggcagggagtttgcagcacagaccttgacttcaggtgtcctgaattggcacgctctgctgatctgttcctgttctacacgcactcctgccagcccagtgtagcctcaggcctgttgggtctacccaggagcatggcagaattatatagcacttggtacttaggaaatgtttttatggtcagttttaaacttataaaatcaagattgaaatataacagacaagaaaacataggtacagaggtaatttggcagaggtcctacatcaagctagctaaggtgtcaagtgaacctgttctcccatgtgttgttattgatctgtgtaggaatgtactgaatttcacgaaacacagcttatttatttaggtagtagtcccccaaacttgaatctagtgaaaggtggcagacattttagctcagagttttctgacatttgattttgtaaatgaatcggtgggtaacagatctgtgtcatcctatgtgatgtgatgtgatgtcatcctatgtgatgtgtactctggggtactcacatcctatgtgatgtgtctcaagtgactgtcacacagtggacactttaccagtgctagcttgaatgaggtctacctccatggcccagccctgctgccccctagtgatttcattgaatgggatgaaaaggtaaaaagtgcttaagacctgtagaagggactacatcaggtagggtatgggaatatttaggactactttggtaattattgaaaagtctagagtattaagccactggtggttttgtgaggcacgagtgagttgaacagtttggtgggctttggtgtatctttgctccagaattatatcaccagttagctgttaggtgctgccatttggtaacgtgccaacttttcaaaaatggtttgccccaaactagatttttctatcttctccaaagccagagccaccttcctgtcctagtgcatttttagcagtgccccgtcatcttactggcattcacctgggcttcctgtgctcaatcaggggtcaagtctggcctgatctcagttccacagttcctctactctgtaagttcgagcacaattagcaagccttcgcacctccattttccttacttagcaactacatcaaacacccgagagtttatcatctctcttcatcctcaccctcctttttagtttttatgtatatgttacacattcatacacacaaacatacctgcatatatacatgtgttttatacgtcccacacaactgtgagctgcttacatacaagacagtcttttaacatcattacgcatcactagatgtttaatgttgagtaatgaatttaaactgtttttaacattgaccctccatttttatggttttccacatgtttatactgtatcttgttttttgtttgtttggttttgttgttgttttttgtgcttttttgtttgttttttgtgtttttttgtttttgtttttttgagatggagtctcgctctgtagcccaggctgaagcgcagtgacacagtctcagctcactgcaagctccacctcagcctctgaagtagctgggattacaagtgtgtgctaccacacctggctagtttttgtatttttagtagagacggagttttaccatgttggccaggctggtcttgaacttctggcctcaagtgatccacccaccttgacctcccgaagtgctgggattacaggtatgagccactgtgccccgcctttttgttgttgttgttgtttcttcagttggagacagtctccttctgtcacccaggctggagtgcagtggtgccatcacagttcactgcagcaacaacctcctgggctcaggtgatcctcccacctcagcctcccaggtagcttgggactacaagtgtggaccatcactcccggctaattttttgtattttttatagagatggggtcttactgtgttgcccaggctggtcttgaactcctggctttaagtgatcctcccgcctcagcctcccaaactgttgggattacaggcatgagccactgggcccggctttatactgtaactcatatatttattatcccgtcctaaatagtatcttactgaaaatattttaggatttatgatttcggagatatcagcgatagagtactattggcaaaggttattgaaatgcaaagtaagtcacatttactaggcccgaaaagatgggagaagtgggcaggtaggatgcaattcacttgtaaacctattttctggtggtcttagaacagaacgtggaacttcctattggaaagtaccggaattgtgaattatgaaacttaaaagcttttttttttttaaccatcgaagaatcatcacagcttggttgacccttctactttagaaaaatgctttaatgaataatatttgtctgcaagacacctggaatttatcttcaggaagaagtggaatttccattgtgtttctggcagtatgtagatgaaagaccaggttgctctctaagatggatattaatatttcccctgcaaagagggtgactttgggcaggtcttgggttgttgtgaaggatctcatttatttgaacgcatttcccgtttagaaaaaaaaactgcagttggctgccagcacggtattcttggagcaaacaggaaatgggttaaatgtctgtttcaaaaaaaaatcacccccttaatttttttttcctcctgagttttccaaacgttttattttggaaattttcaaatctacaataaggttgaaataatggtacagttggatgacgctagtggatgcagaagtgactattctgccttgtttgctgaatccttgctgtataccggcacacatgccctttatgctgacctgcttgaaaacaaatgttggccatcttggcacttcacttctaacgactttaagtcgttcctggggcattcttatggcaaatatcgtttaatataataatctatttatactatattctgatgtcttttttttttttttgagatggactctcgctctgtcgcccaggctggagtgcaatgggctcactacaacctccacctcctgggttcaagcgattctcctgcctcagcctgcccagcagctgggattacaggcatgcaccaccacaccaagctaattttgtatttttagtagagacagggttttaccacattggtcaggctgatcttgaactcctgacctcaagtgatccacccacctcggcctcccaaaatgctgtattaggattaactcagttttacaaataaaataaagcttagagaagttgaataacttctcaaggtcatatgctagtaagtgacagaggctagatttaaaccaatacctatgcagagtaaacgacgcttgatacagctgaggagatgacatcgaggttgaaatggattggtaatgcacgccatacgcatgtatttgaggaccctgtgaagtattgcacgagagtgttaggtacgtcagtacttgctgtgtgacatctaaaatttttattaggacattcttatgcccataatcaggcaacaaggagaaaatttttttttttttttttttttttttttttttttttgagacggagtctctgtcgcgtgagctgaagtgcagtggtgcgatcttggctcactgcagcctccgcttcccaggttcaagcggtaggagaaataattctattatgtatgaatgtgttaaacgtaaacaacttcagtaatccttcttctgaatacaacattacttctagactgtccatttctgtatttcttagaaccacggtgtgtgaaggagggtacttgcttaggttttaggatgtaaatactgcagatacagattctgagtgaataggagagaagcagttgtcttaggaaggtgtgttacgtttgggctgggcatggtggctcacacctgtaatcccagcactttgggagggtgaggcaggcagaccacctgaggtcagaagttggagaccagcctggccaacatggtgaaaccctgtttctactaaaaatgcacaaattagccaggtgtggtggcacatgcctgtaatctcagcatccttaggaggctgagacaggagaatctcttgaacccgggaagcagaggttccagtgagccaagattgtgccactgcactccagcctgggtgacagagtgacagtctgtctcaaaaaatttttcttttcctttttttttgtttctccagccattctctgtaacagtcttgtggtacatcgagcagagtgcctcacctggggcgctggcggcgtagctcagcggaagaccgctttacttgttttgcttattccactctgggcacacttgaatcctgtttgtctcccctcctaggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggtgagtttgggggattcttattgtatattactgtaaagtgtaggggaggatgggaaggggttctaaataaaaatagatttgtgaaccagaggctgtaatcaagaaagtgttttaaacatttgcctggtctaagtggccgaaagaaacataactcttcaactcataggtcttcagttcacttaggggaaaatgttttgtacacagtgtagttcatagaaatacatggcatatgcccaggtttgtgagcctgacctctacagcagtcctgtctgccagtaaaggagttccccaggagagagaggaatagagccgaggactcttaggcacattcctcctggaatgactcgtagattttccttggtagttaatccagtaatcatatggtactgtcatccagtaatcataaaacccagaagagaagcagccagtgctgtcagtatgcatttgtaaatttggagagtgtgcttgggagggctggctgagatttcagatatggtgtctataggtcgtgtgtctgcagggtgcgggagcaaagagcaggaagaagaagggatccgagcagcattctcctgcctgcagggcttcctgaaggaagtgtgcctgctgtgtaagtgcacgatgctaggacccaggatgtttggcccgcataatccacccaaaagcacatctgtgacaagtatggggtaacttggggcggggagctgtgccagcagtcgagaaggccttgctgacctgggtggttttgtgtgtcggtggcactcttactctttttgacttcagaatctgaagccacatgtagtgtgtaatcaaacagtgaaaacaaatatatcagttacacttgtgaagtaagctccaggaagcattaggaactaaactttgggttggagtgtgtgggtgagcctagcctttgggctgggtcagtcgctgcaggctttggagtttggctcatgaaggaccatcttcatttgagcagctctagaagatgagattgggtgtctgttgcttctgtgaagttgggggtagttttctccattattctcaacattgaatccacttagggaggaaacctggggggacatccctccagccaaggcagtatgttcttaacacacagttggtaaacagggaaagtttggactcaggcctttagagcacttgcggtctagtgggcttcaaagatgaagtgtgattattaagttattatacacagggcaaggacgctgggggagaggggatgcagggtgtagtgccagcatctggggagtaatgaactagatttagactccagacagcaaggaaggggcaatgtcagacccctggcatcagggacacaggttgtcagtaacaggtacttggacccaggctgcctgtcttttaattaacattcagagaagaatgccctgattgccgaggatatattttcagctttgtgaagcaaattttatgtcagttacctgagtagtaagttaaatcggcactttaagcctctttcttcagagcattttaggtaccaagtttgaaatctacgaaatctaatcctcacttagattaaatagtcattcagaagtcagaagagctctgcagatggcctgagaaaggtttgaatattatggttaaaacattcaagaagaaagctttctagaaacgcagctgctatttcagtgcatgttcagttagcattttctgactgataaaatagaattgagagggaggaatgccagtcagggttctatctattgaaaggctctcctagtctgccatcatctagacaacagaatggtagttgtgacgtggagaagtagtatgaataggatcttcccacatctttaacccagaattacttgaggaaatcggggtcttcttttcttttccaggattctgctatgtagaattcgatgaagtggattcccttaaggaagccttgacatacgatggtgcagtaagtatcctcgggttttctctgtcatagcagttgagattgttttctttgccaatacttacactattttccctttatcattagctgttgggcgatcggtcacttcgtgtggacattgcagaaggcagaaaacaagataaaggtggctttggattcagaaaaggtggaccagatgacagaggtgattggttcttctaaagctgaacatcataaagatttgcagtatgcctaccaattccaactcgtgaacgttcctagtagaactcgattatctcataggtgtgataggttctcgtgagctcttaaaagtttgcgtaaaatcctagaaagaatggctgatgcttctgcaagcctggcgttttttgttttctgttggaagcaaaagctcttaaaatgatttcattgaaccttccatcacttgagttgtatgtcttccaaatgaatttttccatgtttgcgcagcaaggtaatgacacgacctcaactttatcttttttgtgtatcctcaggaatgggtagctctcgagaatctagaggtggatgggattcccgggatgacttcaattctggtatcagtatttaaagtatcaccacttaatttttcctaggagccttgctgctgttctctgtttcttacgagtagcccgcctggccggactacttatttagttcctttaacaaatacaactctcctgcagggtgcccaggcatgcaagtaagcctctgttagagcctgtgggggcaggacttgagccccatgcaccttgtgtggtcacctttgttagcctgcagctccttggatgtgtacgggcctgggtccttgagctcgctcagcagtctttctcagactctagcccagggaaactcctctgtggttttgtgtatggcaccaagagaagtactgttccttctggaaaacataggatagaggtttgggttcttacatggtgaaaggtagtcctgatggcccttttttttcttggaggattgtggggaggtccagtcccttgatggtggacctgatgcacttcgccgttctctttcttagccaacccaggcagagcagctggtggtatagcacaaagcatcagtccacacgccaggcctctgccctgcagggtgattttaagcatttttatcatctttactttctgtttttaaattacaaaagtataattttttatatatgcacatgataaaaacttcagttgtaacccagaaaggtaggaagagaaaaacaaatttgttttctttcccgcaaacttgggatgtgctgtcaatgctgtgctgtatagaacgtcagcaccctccccccatcaaaacaaaaccggtgtaaagtagtgggtgagtatgggagggactggtgcacgctgtcttgtgagtctgagatttttaaaaactcagctttggctgaacaggtgacgactacctgttgaataatatagttcttaaaagtcctgtagccagtcagaaatgagcttattcataaaagtgcagtatggtgaagtcaatctgtaattttatgtataagctagtctctgattgaaacatgcagcagctgtcttcttagagccaaccagcagctcagggaacggcctttcccctgccagtttggtattcgcaggtgttatagaagttgcccacatactaacgtctttctacccttggcttagcttggccactggcgctcaagcagagacacagtgaacacggccatggcctggccgccaccagttctggtgggaactgcagtgttttggtgacatctcaaaccctatgtgggctcactcgatggagtaatggctaatttgatactttatacgttatttgcgagagtagatcttttttactttttaataggatggtgctattttttttaatgatacctgctcatgtaaaaaacaaaatagagcaacagaaaagtaccaagaaagcaaaaacatttcatcatcagaaatagccagtgttaaactaagctttgtaaagaaaactctgaagattctcatgaatagtttgcttcctagaaacccaccaacagattttttgttgttgttttttttgagacggagtcttgctctgttgcccaggctggagtgcagtggtgcgatctcggctcactgcaggctctgcctcctgggttcatgccattctcctgcctcagcctcccaagtagctgggactacaggcacccaccaccacgcccggctaattttttgtatttttagcagagacggggtttcatcatgttagccaggatggtctcgatctcctgacctcgtgatccacctgcctcggcctcccaaagtgctgggattacaggcatgagccaccgcgcccggcccccaccaacagatttgatgagagatccttgttcatctgcttcaccagcgtggtgtgagctatttgtttcacgctagacattggtggtcgaaatcatttaatctcatagtaaagggtgtaaatttactttgtactcacgtggaaaggtacacttcacagtttagtttgggggaaacgtgaagttaaatgttttaatactaactaggcttgttcactgaactgtgtaatgtgggtaaaatactttgtaaaggaccttatactcgactgtatgcctcccagtgtatttcccctaaagcagtgctcttattggtctaaatctgttcagacttgctttcattacttggtttgttaaaatttattatttaactcagtctctgaactgggtgtgagatcccttggtttccaaaacccttgccacctttaaagaatagaaatcggcccccaccacaggtgatgcagtcagcgcttatcattggaggtggttctgtggagttgctagaacactgaatgagcccgtgcggtgctgctcctgtgtgctacagatcacaacattttcgtcagctgatcatacctaacattgctttatgtgacttttttttttttttttttttttttgagacagaggctcactctgttgcccaggctggagtgcagtggcatgatttcggttcactgcaatctccgcctccagggttcaagcgattctcctgcctcagcctcccaagtagctgggattacaggcgcacaccaccacacccagctaatttttatatttttagtagagacggggtctctccgtgttggtcaggctggtctcgaactcccagcctcaggtgatctgcccacctctgcctcccagagtgctgggattacaggcgtgagccaccacacccagcctatgtgaccttgattttaaagacgcctcatttaatgttagtgttgattcatttaatagtgttaacattgaactcagggccagctgtagtaagtagtctgtggtgccatcatttcagcctgttagaaagctcatcccacaccggttttgtctgtaagacacctgacagccagcctgcacttaagaacagcagacagcacttcacactgcacctggggccacttcagacagcgatgtcaccagaaaaagcccaaagggcaaaacacccgacactcatcgtgaaaagacttgacagctaataactgaaacaggcagagcattatcgttttctgcctcagctgggatcgtcgcatctgtgcaggtccaggactgactggagaaatgctgctggtatctagcttgggattacacatgaattttagcgactgggtggatttgcaaatatgggatctgtggataatgaggatgactgtatagtgcatactgcgggctctgggggttcttctcaaagacaagctccctgaaagcttggagccttggcaccactctcgcagagagtagcagtggcaccccctgagtgcgcaaccaacagcagcaagctcatttgtttaattatggtttaacttcttttcgccagttttttttttttttccttgagacagagtctcacttcatcacccaggctgaagtgtaatggcacgatcttggctcactgcaccctctaccttccaggttcgagcgattatcctgcctcagcctcatgagtagctggaaccccaggcgtgcgccaccatgcccagctaatttttgtgttttttgtagagagtgagtctcactgtgttgcccagtctggtcctgaactcctatactcacctcccacctcagcctcccaaagtgctgggattacaggcgtgaaccagtctttttaccaaattttaacatcagtaggttatacagttaaagtttagctttcactgaagtacaagcctgaaggccccttaagaccattgagaaaatactctttcctcctacacaccagtgggaattcagcatttctaaatgagatgcagtttacttctgccaagagcccacttagcaggcacacaaatgaatggggaaagaacgctttgcccccacaggaggcgccggtgggggtgaggcgctgtgctctctgctcatgcccctctgtgtagggcatggccaatttcggataactgctttgtttaccacacaggtgctttgcttgtagaatggcccacacctaaaacgcagccaaaacaggaaaattgggactttgtgtttttattttgtcttcatatagcgttttcttgtgatttttgtgttctgagttgtaaatacttctaaatttcaggtttatcttttaaaatagctgtatagatttctattagaaaatagagttcaacctgctttgaggctttcttgttttgcttaagccgtattaaaatacagtttcgtggtattaatatttttctacttttcatgcaagctgagcatgtaaacagctcgtttgtttgctctcctaagatcttgattcctttttctttgggaagtctgttagcgctgtcattactccacacattggcatttggacccacttttaacacactttattttggagagacttcagatagtggacaaactaaagaatttaaaatgaaactcaaacaattcccagaacattattctataagcagcttggagacgatagtttgaaaagtaattcagtgtcctgtttcttcctcaggcttcagggatgacttcttagggggcaggggaggtagtcgcccaggcgaccggcgaacaggcccccccatgggcagccgcttcagagatggccctcccctccgtggatccaacatggatttcagagaacccacagaaggtacgggctcatgtgtcagtggagggcatcttgtcctgatgggatgatcatggccggttcacaccccgtggggacttggcgttctacggcacacagagttgtcggcatagatccccacgttctctggaatagcaagttcaccttggtcattagagcatctgctgttggggtagcaggccaggtgaattttagaaagtgggctggtttgctgacagcaacatcagcatggtcgttttgctggatatggaatgggatccacactctgacaaactctgctttttctcccccagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttgggctgcggtgctgcgtcatttttcctttgctttctctttactttagacactggcccaactccaggcgtttcctttcattccctcagtgcttctcttctgacctgcatgttgagttctgtattgctggggcttccaacaaaaaccagagtcactgacagagggaacagcagagaccttgttggtattcagctgtgatggatatagagaatcagaggcaccttgttttcacaactaggataaaaatatctgcagggtcctttccattcctatttagagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatgcatctaaactgctgggcaatccagttgacttttaaatgtaagaatggaattccaaacacttaacacattcagctatatgacagaaagtaaatctatggatatggtattttgtgaatgatcttttaaataaaagaaaaccttacgtaatatttaatgcttgcctttatttttgagttctttttagctgctcatggaatgtaacaattttaaatttgggaagcaccattgaaatggaagagtcttcctgtcattttaattctgggatgagtgaagttattttaaaagctggtgatgattagaaataggatgccaattttttcccctcacttgctaaaaatgtccttttcccaaccaggcagaaaccttgaaagtctggctgtttttggttaggtaaaggaacatttttttcccaagatggaagaaatcaagcatttacacaacatgtggcttcttttaacaactgcttgtaaacgaaattctaggtgcccctcatggctgggagggctgctgcttcctgacagcagatcctgactctggggaggtgctgctataggttggtattggatagtgttaaaattgacttaggcagacaaagaagagctgagtgggcaaggtgcggggcatgaatgcgtgtttggcaaagtcctggctgactttggaagggcctggccaaggcagaccttgcctaccttgaggtaggagcattgtctggtgatggaggaccccggaccacgactaaattttagtaaggcaggcaagggctgttcaggtgggagcctagagtaactcttttgcttcaactactttctacccaagagtaggtggtagagaggaccggtgtttcagagacagggtctccctctgtcacccagacaggagtgcagtggcgtgatctcggctcactgcagcctccgcctcacgggttcaaatgatcctcttgtcagcctcccaagtatcagggactacaggcacccaccaccatgcctagctaatttttgtatagtagagatggggtttcaccatgttgactaggctggtctcaaactcctgacctcaagtgatccacccacctcagtctcccaaattgctgggattataggcacaagccaccatgcctggccctgacatctatttttagttggtgatttctagggaatagcctggttttctcaatgaaggacattacttaacagagattaagtctagaacaagaagagctgattaacctagaacacgggttgaccttgcctttagggtggtgaaacggcctaaaacctgaaggaagacttcccagggagctggtcactggggccaggctcactgggcttctctgaagtcagaccctggccacatctggatgttttgtttttttggtttttgttttttttttttttttttttttttttggtgagatggagatttactcttgttgcccaggctggaatgcaatggcacgatctcggcttactgtatcctccacctcccaggttcaagcgattctcctgcctcagcctcctgagtagctgtgattataggcatgggccaccacgcgcggctaattttgcatttttagtagagacaggttttcaccgtgttgcccaggctgatctcgaactcctgacctcaggtaatccacctgcctctgcctcccaaagtgctgggattacaggcatgagccactgcgcctggctggatgttttaagattttattttattttgtatttatttttctttgagacagagtcatgctctgccacccagggtggagtgcaatggtgtaatctcagctcactgcaacctccgcctcttgggttccagcgatcctcccacctcagcctccctagtagcagggattataggcacatgccaccacgcccagctaatttttgtgtttttagtagagatggggtttcaccatgttgggcaggctggtctcaaactcctgacctcaggtggatccacccaccttggcctccaaagggctgggattacaggcgtgagccactgcacctggcctatttcaatttttgtagaggtttcaccatgttgcccagactcttctcaaactcctaagctcaagagatcttcccaccttggcctccgaaagtgctaggattacaagcatgagctaccacgccaggccaatgctgaga

SEQ ID NO: 17521 - DNA, 87734 bp, Human
tgttttttctttttttcttttctttcttttttctttttttttgagatggagcctcactctgttgcccaggctggagtgcagtggtgcgatctcggctcactgcagcctcctcctcctgggttcaagtgattctcctgcctcagcctcctgagtagctgggattacaggtgcccgccaacatgcccagctaatttttgtatttttagcagagttggggtttccgccacgttggccaggctggtctcaaactcctgacctcaggtgatccgcccacctcagcctctcaaggtgttgggattacaggcgtgagccacctctcccagccctttttttttttttttttaattttaaattctgggatacatgtgcaggatgtgcaggtttgttacataggtaaacgtgtgccatggtggtttgctgcacctatcaacccatcacctaggtattaagcccagcatgcatcagctatttttcctgatgctctccctccccccgcccccacaacaggccccattgtgttgttcccctccctgtgtccatgtgttctcattgtccagctccgacttacaagtgagaacatgtggtgtttggttttcttttcctgtgttagtttgctgaggataatggcttccaactccatccatgtccctgcaaaggacatcatcttgttctattttacgactgcatttttttgtttttgtttttgtttttgttttgagacagagtcttgctctgtcacccaggctggagtgcagtggtgccgtcatagctcactgcagccttggcctctcaggctcaaaaaatcctcccacctttgccccacaagtagctgggactacaggcatgcgccaccacgcctggctaattttttattttttattttctgtagcgacaaagtcttgctacgctaccaaggctggttttgaactcctggcctcaagcaatcctcccaccttggcctcccaaagtgttaggattacaggtgtgagccactgcccccagcccttttagggctttttttttttttcttttgagacaagagtctcactctgttgtccaggctggagtgcagcagcgtgacctcggcttactgcaaccaccgcctcctgggttcaagtgattcttgtgcctcaacctcccgagtagctgggactacaggcatgtgctactaagcctggctaatttttgtatttttagtagacacagggtttcaccatgttggccagcctggtcttgaactcctgacctcaagtgatccactcgcctcagcctcccaaagtgctgggattacaggcatcagccactgcacctggccccttttagggcttttaatgaccatagtcagcatgcagctcacgctttgaaaaggttttactctgtcacccaggctggagtgccctggagctcactgcagcctcaaactcctgggctcaagcgatccaccagcctcagcctcccagagtgctgggatgacaggccactgtacccagtctaaaagtggtctttgttgcaaacagtttgatggatgctcttgggatagaagatgaaacatctttcaattgtaataaatttctgcaaccaaataaataaagacacaaagctttaatggtgggaaggcaggcagaggtcatggctagatgacggcctggtgtggagttgaggcaggtaactgcacaccaggatataagagggtaaggcaatagcctctctgtgtgtttgtcctgcccatgcagtagagggggtgcgtgctgggatggtgagtctgagagcgggaatctggcctgtgcggcaacgggagcagtgagctgataggttaaatcgggtgttgcctcgtccagcccacctcaggagggatgtgtgttgcttgatggcccttgagggtctgggggccattgggaagtgatgatgtgatctctcctgtctctgcccgcaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggtacgtggcacaccaaggatggggggtgaggggactggctacatgggatgagtgttcttctggaagagccccaggagcacaggccactctgtgaccaatctgatgggggacgctgagtgtcatgagctcctgtaatggggcctgatcaacactgggaggttggcagaggtttccccagggaggggacatgggcgctgaggtctggagggtgaataggtgattcactagctgaagaggaaaaggttcaggtacggtggctcacgcctgtaatcccagcactttgggaggctgaggcggctggatcactggaggtcaagagttcgagaccgaaaccagcctggccaacttggtgaaaccccatctctactaaaaatacaaaaattagccaggcgtggtggcaggtgcctgtaatcccagctactcgagaggctgagagaggagaatcgcctgggcaacagagtgagactctgtctcaaaaataaaaaaaaaaagagggaagagtattccaagtagagggaacagcacatgcaaatgctcagaggcagaaaggagcgtcatgcgtacagaagagggagagagcgtgggtgtggctggggcagtctgctgcaatgcaggtggacctgggtgacttggaggtgtgcggggagtttcattttcatcctaataatgagagctacgggagggtttaaaccaagatgagtatgatggaaggaactagcagcaatttcttacctattctctgcagtttaaaaaactgtaattgagctgggcatggaggctcatgcctgtaatctcagcactttgggaggccgaggtggaaggatcacttgaggtcaggagttcaagaccagcctgggcaacatgggaaaaccctgtctctgctaaaaatacaaaaattagtcgggcatggtggcgggcgcctatagtcccggctacttgggaggctaaggcaggaaaatcgtttgaactcaagaggaggaggttgcagtgagccgagatcacaccactgcactccagcctgggctacaagagtgaaactccatttaaaaaaaaaatgacgatcgtttgttacttatcactttgataaatgatgctgtgatgaacatctttgtgcacaaagcctggctttgatgatactccagccagcaggataggtcactgcccatcttatctgattggtacaaagtttggagagacaaacacagctggggccagactggacaacctgggtcctggggaagggggtcaaggaaagtttgagccaaaatcatgggcagttggcaggacagggtccctggcagagccaaatgggcagcgtgaaagggcgaggaagctgcagggtgaggcccgtcggcagaagcccatgggaaaggcctgcccagtgcagccttgtgaaggcccaggctctgctctagggtggcaaatcctctccagcagtgagaagccagacaagagaaaattcgggggatgaggtggggtggggaagaggtgttccacgtggagggaatgggtgatgcaaaggccctgaggctggaatgaatttgatttgttaagaaagaaaaaggccggggacggtggctcatgcctgtaatcccagcactatgggaggccaacactggaggatcacctaggtcaggagttcgagaccagcctggccaacatggtgaaaccccgtctctactaaaaatacaaaaattagcgggatgtggtggcacctgtaatcctagctacatgggaggccgaggcatgagaatcggttggacttaggaggcggaggctacagtgagccgagctcatgccactgtactccagcctgggcaacagaacaagactctgtcaaaaaataaaataaaataaagaaagaaagagaagccagcatggtggctcacgcctgtaatccagcactttgggaggctgaggccagaggatcacttgagcctaggagttccagaccagcctggggaacatagtgagaccccagctctacaaaaaaaatttttttaattagccaggcatggtagtgtgtgcctgtagtcccaagtactcaggagggtgaggcaggaggattgcttgagcccaggggttggaggctgcagtgagccatgatcacaccgctgcactccagcctgagtgacagagtgagaccctaaaaaaaaaagagagagaaagaagaaaagtctggatggagaggagtgtgaaaagaggttagggagggcagccaggacagatctgaaggacacagggtttgggtttgttttaagagtggtgggggctgggcacagtgactcaagtttgtaatcccagctctttgggaggctgaggcgggaggatcacttgaggttaggagaccagcctggccaacatgatgaaaccctgtctctactaaaaatacaaaaattagctgtaatcccagctactcgagaggctgaggcaggagaattgcttgaacccgggaggcggagtttgcagtgaactgagattgcgccactgcactccagcctgggcaatagagtgagattccatctcaaaaaaaaaaaaaaaagaaagaaagaaaaaggaaaaagagcagtgggggccgggcacagtgactcaagcctgtaatcccagcactttgggaggctgaggcaggaggatcgcttgagcagtagagtttgagtccagcctgagcaacacagcaagacctctcatctctacttaaaaaaaaaattaggcacggtggtgtatacctgtggttccagttacttggcagcctgaagtaggagatccgcttgagcccaggaggtcgaggctgcggtgagttttgatcacaccactgcactccaacctgggtgacccagcgagaccctgactcaaaaacaaaacaaaaaaaggatggtgggagcggctggaggataccaatggaagagtgatgggaccttgttcacatcccttgggccactgtgcagagaacggattgtagggttaagagccaggtggggataccagtgaggaggctgtggttatccgggggagggaagggctcattaccatgcgtgggcaatcagggaagacttcctggaagaagcgtgaatgagctcagccttgataatgggggcagggcagtgggtggagtttgaaaatgagaagaggaggaggaggaaggatctgcagacagtgggggaaggtcgtgagtcaaggcacccagtgggctgagcttggtccagtgaggagtgaggctgtgtaacctaatggctagagaagggcacccgcccagcccaaccctggggctggggcatggcgtgcagcgagagtcttattgaaccttctgggtactttcccctttgttcctccccgatctagagaggcccaaattctggctgtgatccagctctcatgcccctcctagccctgctcctgctgtgtgaccctgggagagtgacctaacctctctgagccacaaatgggataatagcatctccctaatgggatcaagcgagttaatgaacatggagtgcctgcaggtagaaaactcattaaagattaatttctttccctttcacccatccatcatctcattacaggaaaatttgaaagtgataaaagaaaaaaacgttcattatcctttaaccttctcccttcccccttaccacttaacctcatcactgcacagcctaaccaggattccgtgaaggatggaccatgtttatcgtggtcccacaggattctaacagagctgagcatttcctattgccgacattggcagttcctgagttttagccattgtcatgttgcagcgcaattactttattttatttattattattattattttttttgagatacagtctcgctctgtcacccaggctggagtgcagtggtgcgatctcggctcactgcaacctccacctcccgggttcaagtgattctctgtctcagcctcccaagtagctgggattacaggcgcccgccaccacgccaggctaattttttgtatttttagtagagacagggtttcatcatcttggccaggctggtcttgaactcctggccttgtgatccccccgccttggccccccaaagtgctgggattataggtgtgagccaccgcgcctggcctttattttatttttattttttaataaaaaataagcgtgcagtgtttataaagtctgcagtagtgtacagtcatcagtcatgtcctagaccttcacattcactcactcactcacccagagccgcttccagacgtgcaaactccattcgtgttaagtgccccagacaggtgtaccctattttcttttcttttttatttttattattttattttatttttccttttttttttttttttgagacagagtcttgctctgtcgaccaggctggagtgtagtggcacgatctcacgatctcagctgattgcaacctctgcctcctgggttcaagcgattcttctgcctcagcctcctgagtagctgggactacaggcatgtgcaacaacaccggccaatttttgtattttttggagagacggcgtttcaccatgttggccaggctggtctcgaactcctgacctcaagtgatccactggcctcgacctgctaaagtgctgggagtacaggcgtgagccactgtgaccggcctccattttttaatcttttttttttaagagacaggatcttggccaggtgctcatgcctgtaatcccagccctttgggaggccaaggcaggcagatcacctgaggtcaggagttcgagaccagcctgggcaacatggcgaaaccccatctctactaaaaatacaaaaaaattagcctggcatggtggtggatgcctgtaatcccagctacccaagaggcagaggtttcagtgagccgagaccacaccactgcactccagcctgggcaacagagtgagactccgtctcaaaaaacaaacagacaggagacaggatctcattatattgaccaggatgcacctcctggcctcaagcaatccatcctcacaccttgacctcccaaaattctggaattacaggcgtgagccactacacctgtcccattgtttatctttgttttttgctgttgttgtttgtttttttgagatggagtctcgctctgtcaccaggctcaagtgcagtggcgcgatcttggctcactgcaaccttcgactccctggttcaggcgattctcctgcttcagcctcccaagtagctgggattacaggcacacaccaccatgcccagctgatttttgtatttttaatagagatggggtttcaccatgttggccaggctggtcttgatcttctgaccttgtgatccacctgcttcggccttccaaagcgctgggattacaggtatgagccaccgcgcctggcccgtttatcttttaaaacttatttttactgtaccttttctatgtttagctatgttttatttatttatttatttatttatttatttatttatttatttgagatagggtctcgttctgttgcccaggctggagtgcagtggcgtaatcatagctcactgcagcctcgacctcctgggctcatgcgatcctcttgccttggcctcctaagtagctgggaccataggcaggtgccaccatgcctggctaacttgtaaattttttgtagaaacggagtcttgcatttgttgtcctcattggtcatgaactcttgggctcaagcgatcctcccacctcagcctaccaaagggcgtgagccaccatggctggcctagatatctttttttttccttttcttttctttttttttttcttttttgagatagagttttactccatcgcccaggctgtagtgcagtggcatgatcttggctcactgcaacctccacctcctgggttcaagcaattctcctgcctcagcctcctgagtagctgggattacaggcacccatcaccatacctggctaattttgtatttttagtagagatggggtttcaccatgttggccaggctggtctccaactcctgactcaggtaatctgcctgcctcggcctcccaaagtgctgggatcacaggcatgagccagtgcgcctggccctggcctagatatcttatgttcagatgtacaaacacttcccctcgtgttacagttgccttcagcattgagtactgtaacatgctaaataggtttgtagcctaggagcagtggactagaccatataggtttgtgtaagtacactctgtgatgttcacaggacaacaaaatcgcctaatgatgcatttctcagatggtatccccgtcgttaagtgatgcatgactgtatttccttccagtcttttttcctattacacaagttgtggttttatttattatttatttttattttttgagatggaatctcgctctttcgcccaggctggagtgcagtggcacgatctctgcaacttctgccccctgggttcaagcgattcttctgcctcagcctcccaagtagctgggattacaggtggccgtcaccatgcccggctaattttgtatttttagtagagacagagtttcgccatgttggtcaggctggtctcaaactcctgacctcaggtgatcctcccgcctcggcctcccaaagtgccgggattccaggtgtgagcccccgttcctggccacaagttgttttaaacagctagattgtgcattctactttttctcatcttattgcatcctatgggaagcacctccctgtgctactgtgatatcacctgctgtcatctgaatggttccctggagggaacggactgtagtgtggtgtgtggcgtgccacctgcttcctagtcacattgcccggtggtctggggatggggacaaggactgggtggtcggactgccttgggcctccaccctcaaagctgtcccagagagagaaagtgtccctccgagaatccccaattgacaggggagccacaccttgtgcctgaccttggagatggtggcagcagaggctgtggctgggcttggtggtgtcctctcccttcactgcaccccggctgctgcctttgcagggcagaactagactcccaggctggggaaggaggtggccagcctggagcaaaaccgagttggctgagacagccaaactccaggagagagaaagggagaattctgctgcttttgttcctgttccaagatcttgagaaaaaaaaaaaaaaaaaaaagcctctgggaagagtgacaggtggaagagccagggaaggacggtccccccagtcctgttggcccttcgggctccctcacccacccatgcaactgtccatctgttctccgaggggctggaggcggccacatccatcagaggctgggaccctgggcagtgggcagctcgagatgtgtgtggcagaggccggggcctggcagtggtttgtggggaggggagcacgctggagtctgctctgggaacggggttgtggctgcctcccaaaacatgagctcagcctccggcagaggatctggccaagggacagggcctggactggtgcccttgctgcccacccagtggagaggggagggcctgtatcctcagagctgtgccacacagggagcagcatttgagggggacctttgagagggtctctcacactaggaggtggtgcagggctacaagggagaggtggtcagagcaggtgggcaggagggcggtttgggatccacctgggggcaaagtcctgggtggagcagcgtggcgagggacagcctggccgggtgtgaccgagcacacctggaggctggtgcagacagggtggtcagggacggcctggctccagtggtgacattggagcaaggattcaagtgatgagcaggagtcgccccagctgccgttcagggaaaaacatccaggcagagggaacagaggctgcaaaggccctgagggcctggcatggtggctcacgcctgtaatcccagcactttgagaggccgacgcaggtggatcacttgaagtcaggagtttgagaccagcctggccaacatggtgaatcctcgtctctactaaaaatacaaaaattagctgggcgtggtggcacacatctgtaatcccaggtacttgggaggctgaggcaggagaatcgcttgaacccgggaggttgaggttgcagtgagcttagatcacgccattgcacttcagcctgggcaacagaacgagactccatctcaaaacaacaaaaaaaagttggggggctgggctgcagtgacctggatcctgggtgaggactgatgggactgatgagcacaggggccaaccgtgtgccattgttttcattttaaagatgagaccattggctgggtatggtggctcatgcctgtaatcccagctctttgggaggccgaggagggcagatcacttgaggtcaggagttcgagaccagcctggccaacatggtgaaacctcgtctctactaaaaataacaaaaattagccgggcgcgacggcacatgcctgtaatcccagctactcaggaggctgaggcaggagaatggcttgaacctggaaggcagaggttgtagtgagccaagtttacaccattgcactccagcctgggcaacaaaggaagactctgtctcataaaaataaagatgagaccaccgaggcttggagtctcagctgcgttgcccagggttacagggccagagctgagactcatgccagactgagcgcctgctgcctccccaggggtggggtgcctgggggaccaagtccagtatcagccccacacatttggctcatgccccagacaggtggatgggaggaggacatacctgttcccattaggttggtcacaactgtcccctaacattcctgtggccttgcctcatgctggggatccaggagattgaggacaagtatgtgtgggagtgttacccacccttagacggggagttgggctatgtgaggcaaggcccacctcctatatgctatcctcagctgctctctagtacacacacagggctgggcccagagcattttttttttttttttgagacggaatctctctctttcaccccggctggagtacagtggcgcaatctcgactcactgcaacctccacctcctgggttccagcgattctcctgcctcagcctcccaagtagctgggattacaggcatgtgccaccacgcctggctaatttttgtatttttgagtacagacggggtttcaccatattggccaggctggtcttgaactcctgacctcgtgatccgcctgcctcggcctcccaaagtgctaggattacaggcctgggtcaccgtgcctggcctgtttttgtttttgagatggagtctcactctgacacccaggctggagtgcagcggcacgatctcagctcactgcaacctccacctcccgggttcaagaaactctcatatattgctggtgggaatgtaaaatggtacagctgcttcaggaaagtttggcagttcttcaaagtttgttttgttttttgagagagagtctcgctctgttgctcaggctggagtgcagtggtgcaatcttggctcaccgcaacctccacctcccaagttcaagcaattcttctgcctcagcctcccaagtagctgggattacaggcatgtgccaccacactcagctaatttttgtatttttagtagagttggggtttcaccatcttggccaggctggtctcgaactcctgatctcaagtgatccacctgcctcggcctcccaaactgctgggattacaggcgtgagccacttcactcggtcagcattgtggttctagttcactgagctcaatgtccctgtaccccgtgagtgttccagaccttggcaccaacctgaagtgcccgaggtggggcccccacccccaccgaggatggtgcctttctctttcctttccatacatttctaggagccttcccagccccaggagagcaggtaggattgtccccattttaagtgacttgtctgagatgttgggcaaattcgtcccttcaagggcaacttctcggctctccactgaccacatcctaaactttttaatggcatcaggacggggaagccaagcccgctcttctgtggctggtgggggtgggggcagggctgcctcctaatgtccctgacgtggtccaggatcgatctgacggggcgggggtccggctgccagcacctgtctgcctgcctggtggcctggccacgggcttctccatggggagctggctctgttctttccagggtaagccatccgggccgctcttgccctgggttccccggccgcctctgctgagcagagactctgttctcctggtttgggaggagggggcacagaagtggggtttggagttccatttggttcaggaagaatgcccagcagagcctgggattcaggacggtgtgggctgctggagggaggaacccttctttagggctggatgctgcagaggctgggcctggggtggccacaggagagaggtgagtttcagacggacccctccctggtcggggtgggctgggggatgtagactcggtcctccctggagcaggcatggactgaggggtggaaacaggttggggtggacccaatgcggggactgccggagggaaagtggcctcttcaaggaatgctgtggagaccccattccttccttcgtaacctctgcctttgagcaccttcgggagagaaaaggaggctcaggagagaaagccatttgagatttttggggcactgatgcatgttcctttggggccaccaggaagcgggagtcaggtgtgtggcccgtctgcatttcagcccagggggtccaggggatgagaggggagttggtgtgagtccacctcctggggctcatgttctgggggtgtgcagacatgcaccccagttagcctgggagtcaggttgtgcaaaccaagggggaacagagccccatggggttgggagggagagagacacagtgggccccttgagatggctgcagatgaggggatgtggagttgctatggacgggcatgaggacttccttaggtgatcctaagggtaaagtgctgtactcaaggcagaaggatggagctttgcctgaaacagcctgcttgatgcctgtggtattggtaaaatgcctttttttcttttcttttatttcttttgagagggtctcactctgtcacccaggctggactgcagtggtgcgatcatggctcactgcagcctccaactcctctctcagcctcccaagtagctggtgcgcaccaccatgccctgctaatttttgtattattatttatatatatatatatttttgagacagagtctcattctgtcgcccaggctggagtgcagtggtgcgatctcagctcactgcaagctccgcctcccgggttcaggccattctcctgcctcagcctcccaagtaaccgttaggcacccgccatcatgcctggctaatttttttttttggttttttttttttttttttttagtagagacgaggtttcactgtgttagccaggattgtctcgatctcctgacctcgtgatccgccctcctcggccttccaaagtgctgggattacaggcgtgagccaccgcacccggccatttttctattattttatagagacaaagtctcgctatgttgcctcctgagctcaagtgatcctcccgcctcggcctcccagagtgctgggataacagacatgagccaccacacccggccagcatgatgctatattaagagcacctctcattcccagaagcacccgggtttgaatgttaaatcatgtggtcgccttatttatagcccctcctttgtggtcaccgtgctcattggtacatcaaaggctctgaaaagtcctgcagacaagtacccttcactttgttgaagttgctgtttctcaagcttctttgaacttggaggttaaattgtttgtttgtttgtttgtttgtttgttttcataatacctaggaacagcctgtggagctatgttctgtggaacatttaagaaggaaccagatcctagcagaggacacttttttatctgcccccaaaccactggggcagagggctgagttcatcacacatctcacttcatcacatgtcaacattgtgggtccctgcaaggtccctcttggttattttatttatctatttatttatttatttatttattatttgagacagagtcttgctctgtggcccaggctggagtgcaatggcacgatctcagctcactgcaacctctgcctcctgggttcaagcaattctcctgcctcagcctcccgagtagctgggattacaagcgcgcgccaccacactgactaatttttgtagttttagtagagacggggtttcgccatgttggtcaggctggtctcgaactcctggcctcaagccatccgcctgccttggcctcccaaagtgctgcaattacagatgtgagccactgcatccggctattttttattttctattatttttacttttttgtagagatgagatctctctatgttgcccgggctcatcttgaactcctggcctcaagcgatcctcctgcctcagcctcctcagtagctgggactacaggcttgagccactgtgcctagcttcctcttggtgtttcttttctttttttttttttttttctttcttttttgagatggagtctcgctcccgtcacccaggctgaagtgcagtggcgcaatctcggctcactgcaatctccacctcctaagttcaagcgattctccttcctcagccttccgagtagctgggattacaggtatgcgccaccatgccttgctaatttttgtatttttagtagagatggggtttcgccatgttggccaggctggtctcgagcttctgacctcaggtgatccgcctgccttggtctcccaaagtgctgggattacaggtgtgagccaccacacccagccggtgtttcttaattgattcattttttgttgttccctattcctcttcccctacccccaggccaccatgccctgtgctggatgtggggatgctcctgaactctgctgtgtcaccaagaatcacatcataaacactgtcctacataacctggacaaataatgttttaaaggttgcttaataatctgaataatgtgaccataatttatgtaactgctccttggtttggaggctcttagattcagttttttatttttgtgaaggtcaaaatagtgagtcagtttttccttttctaaattatttccttgggaaatagactaaagagtgcattccttattttattttttcttttaaaacatattaagatttctggctgggcaccatggctcacacctgtaatcctagcactttgggaggctgaggtgggtggatcacctgaggtcaggaattcgagatgagcctggccaaaatggcaaaaccccgtctctaccaaaaatacaaaaaattagccaagcatggtggtacacgcctgtaatcccagctactcgggaggctgaggcaggagaatcacttgaacccaggaggtagaggttgcagtgagccgagatcatgccactgcactccagcctgagcgacagagtgagactccatctcaaaaaaaaaaaaaaaaaaaaaaaaaaaaaattcaggcgagcctctgagccctgagaaggaggcataaatgaattaggagtgatttcttccgtggaattgctagactgggggaaggatgagccagtagagcaatggcggtttgcaacctgagtgcatgggtggttgcagggcctcctgagatgtggaggatggtggaggagctttggcaagagctgaggaaggaggtcatgtgggttcaggatgttgggtgtaaggtcctggaggaggcaggtcttgatcctgactgaggtgagcaagaggggatcaatttgtttctttctttcttttcttttcgttttctttttctttctttctttctttctttttttttttttttttttgagacagagtctcactctgtctcgcccagactggagtgagtgcagtggcgtgatctcggctcactgcagcctctgcctcctgggtccaagtgattctcctgcctcagcctcctgagtagctgggactttagatgcctgccaccacacccagctaattttgtgttttttaagtagagacggggtttcaccatgttggccagactggtcttgaactcctgaactcaggtaatccacccgcctcagcctcaaagtgctgggattacaggtgtgatccaccacgcccagccgggatcagtttcattctacatcttcctgtgtcatttgaatcatttacaaggagagtgtatttgtgtcttaaagaaaaaaatgtggtcacatgtaggcagtagctaaagctgtagcagttggtagattattgtggtgggtggggggcaccatgtagatcggggtcccctgctactgatcagagaagaaggtttgttgttgttggggttttttgttttttggagatggagttttgctcttttgcccaggctggagtgaagtgatgcgatctcggctcactgcaacctccgccccccaggttcaagtgattctcctgcctcagcctctcgagtagctgggattacaggtgcccgccaccatgccaggccaatttttgtatttttagtagagacgaggtttcaccatgttgaccaggctgttcttgaactcctgacatcaggtgatctgctcacctcagcctcccaaagtgctgggattccaggcatgagccactgtgccccgtgtaatttttttctcagaggcagtgtctccctattgcccaggctggattgcagtggtgggatcatgcctcactgcagcctagaattctcttttttttttttttttttttagagatggggtcttgctatgttgtccaggctggtcttcaactcctgacctcaagtgatcctcctgccctggcctcccaaagagctgggattacaggcacaaaccaccatgcccaaccagggtgatgagttttagataaagcagtcaggaaaggcttctctgaggaggtgagggagccagctctgtaactttcctggggcaagaggtcgtgggaaatacccacacccacatcattcgaggtggagccctccctcccgctcccccgggtaccacattttgggttccttcctcagttacgcacgtggcgtggcaagctgaattgtagttgctggcatccccactccacccccttgccgggccccgtttggccatgcctcttgtccagtgtctgacacagagtctggcacctagtaggtcctcaggaattggggtccctcctgatgagattgagcaggaaaagccagtccccacctccacaggcagggcaggacccgcgtcctcgcaggcggaggggagaatgcgtcatctgggcgccctttttatccccaccggctgcaggaccacgccaccagctgcagccaccctgcaccgtgtccttaggcccttgtcatgctttgaacttgaaacttgcagtaaattcctttgtggctcttgtctgggtgggaatcactgtctggggaataaatcaactgcatgtaggaggtttattttaatttttttttgagacagagtcttgctctgtcgcccaggctggaatgcagtgatgcgatttcagctcactgaaacctccgtctcctgggcttaagcgattctcctgcctcagcctcccaagtagcttggatcacaggcacctgccaccacgcccagctaattatggtatttttagtagagatggggtttcaccatgttggccaggctggtctcaaactcctgacctcaggtgatccacccacctcggcctcccaaagtgctgggattacaggcatgagccaccttgcccagcctattttaattcttttggagatgaggtctcgctctgtcgcccaggctggagtgcagtgatgagatcatggctcactgcagcctccactccctgggctcaagcaatcctcctgcctcagcctcccgagtagctgggactacaggagcgagccaccatgtctggctaatttttgtatttttttgtagagacagggtctcactgtgttacccaggctggtctcaaactcctggcctcaagcaatcctcctgtctcagcctcccaaagtgctgggattacaggcatgagccatggtgcccagcctcatgtgaggtttaagtctgtgttgctgggcccagctggaagtcagtagtggctctttgccttcgcgggggtttgctggggaactcagagggcagtgaggcccaggctgtgcccacagggagctcccaaacagcttgcctttggcctgcgaggatatggaccgaggaagctcctgttaaccaggtttcaaaaactccatcgtatatacattggctcccctgggaggagacgtaggacatggagaatgtcagcgctggaaaggaccttagctatttctgacctagtcctttgttatgtcatggagaaactgaggcacacatctgggaaggccagacttggctcaccctggccaagccagtatgtcactgatgactccctggagggatagggaatttcccatggtttctcaactgcaggaagctgaaaatgtctcagcgtgcatggaatttgatgagcgttttgtccctgtgatgcgggggcagccgagagtcccactactcagaggaagaatgaagcgaagtatcacgtgcagttgccatgggctcgtggcttggatttttgcagctgttgaaacaactggtccctgggcctgtgacccctgggaggggagggagtcggggagagattacctgagggtccgcctgggcccggacagctggggacaaggacagctgagcaggcagcttctcaccaagaatagccatgctgggtcaccttcgacctggggacccttctctgggctctaagcacagagggcaggtagaaacagaccttagctgggctacagtggttctgttcagttagcagaggtcacagagctctctctgcataggaaagtgccctagaaatggatatggggtaggagctggcacctgccaggcacccactgtgcgtgtggtcaagagggagggttctggctgggcgtggtagcttgcacctataatcccagcactttgggaggccaaggcaggagggtcacttgaggccagaagtttgagaccagccttaccacatggcaaaaccccgtctctaataaaatacaaaaaaaaaaaaaaaaatagcctggtgtgctggcacgcacctataatcctggctacactggaggccgaggcatgagaattgcttaaacctgggaggcgaagattgcagtgagcagagattgcaccattgcactccagcctggggactccagcctgggcaacagagtgagactctgtctcaaaaaaacaaaagagggagggttctgaagccagactagctgggtgtcctactcggcctgagtgaccttaccctctgtttccaaatctgcaaggtaaaaatatgatgtattcttataatgaatagcccagcgtggtggtgcatgcctgtaatcccagctactcgggaggctgaggcaggagaatcacttgaactcaggaggtggaggttggagtgagccgagattgcacaagtgtactccagcctgggtaacagagcgagactccatctcaaaaaaaaaaaaaaaaaaaagtgccctgtccattgaggagcatgcagttggcacttcataaatgcagctgctatcttaattattttgttatatttattttttgtagagacagggtcttgctatgttgcccacactggtcttgacctcctgggctcaagtcatcctcctgtttcagcttcccgagtagctgggattacaggctgcataactgcacctggcttatttattcatttatttatttatttatttataagagatgggggtcttgctatgttgtgcaggctgttcttgaactcctgggctcaagtgatccacttgcctcaacttcccaaagtgctgggattacaggtgtgagccactgtgcctggcttattttccttccttccttccttccttccttccttccttccttccttcctttctctttttttctttctttttttcttccttccttcctttctttcttttctttctttcttttctttttttttttgatggagtctcactctgtcgcccaggctagagtgcagtgacacgatctcggctcactgcaacctccgacttccgggttcatgccattctcctgcctcagcctcctgagtagctgcgactacaggcgcccaccaccacgcctgactaattttttatatttttagtagagacagggtttcaccatgttagccaggttggtctcaatctcctgacctcgtgatccgcccgcctcggcctcccaaagtgctgggattacaggcgtaagccactgcgcctggcctctcttcttttctcttttttcttttctattcttttcttttctttcagatagagtcttgctctgtcacctaggctggagtgcaatggtgccatcttggctcactgcaacctccgcctcctgggttcaagcaattctcctgcctcagcctcccaagtagctgggactacaggcatatgccaccacgcctggctaatttttgtattttcagtagagatggggtttccccatgttggccaggctggtctcgaactcctgacctcaagtgatccgcccaccttggccccgcaaagtgctgggattataggtgtgagccaccatgctcagcatgagactgggtaatttataaaggaaaagaagtttaatggactcacagttccatgtggctggggaggcctcacaatcatggtagaaggcaaaaggcacgtcttacatggtggcagacaagagagaatgagagccaagcagaaggggaaacctcttataaaatcttcagatctcgtgagacttattcactaccaccacaacagtatgggggaaaccacccctgtgattcattaagctcccagtgggtacctcccaaaacgtggaaattatgggagctacaattcaagatgagatttgggtggggacacagccaaaccaaatcagtcctgctgcctattgtctgggagctcaggtgaagcacctgatatctctgagcctcagttttctcatctgtgaaatgggggcagttggggatcagatgagctatcgtatgttaagctcttagcacagagtctcatgcaagcctgtgattactatggttgttttttttgtttgttttgttttgtttgttttttttttttgagacagaatctcactctgtcacccaggctggagtgcagtggtgctgtctcggctcactgtaacctctgcctcctgggttcaagcaattctcctgtctcagcctcctgggtagctgggattacaggcacccactaccacatccggctaatttttttgtatttttagtagagacggggtttcaccatgtgggccaggctggtcttgaactcctgacttcaggtgatccgcccacctcagcctcccaaagtgctgggattataggcatgagccaccaaacctagccacccttccactttccggggtctgtggaccctgaggccttaggctgggctgcagcttggggaggggagaaagggggaggcccaggagagagttaggagggttttctttcctgtcccaagagagacagaaggggacatctttatgcaagaagtctgtggctgtgtccctctattaggaaataggctggtagccttttgtgggccctgtaaccgtctgagggcgaggatgggggtctcggagaccacttgcacaacacctaggtcccacataggggccacagggggtctcgggtcaacagctgagggcctgagcccacctggtgggggggtggcttgtaatccttgagaacgggttcctccctggcccaggacttacagtttccttgagaagtggaaagccattgcttctttttttttttttgtctttttaaaaatgaagtctttctctttcccctaggctggagtgcagtgatgtgatttcaactcactgcaatctccacctctcgagttcaagtgatcctcccaccttagcctcctcactagctgggattacaggcacctgccaccacacctggctaattattttatttttagtagagatggggtttcaccatattggtcaggctggtcttgaactcctgatcttaggtgatccgcctgcctcggcctcccaaagtgctgggattacaggcatgagccaccgtgcccggcctggaaacattgcttctgagggcgtactttcctggggacgctctggagggctggaagagtagggggagacctgaggaggacctgcccaagaccacacagccaaccattcctgcctcggtttccatggcaagaccatgtctctacaaaaaaatacaaaaattagcccagtgtagtggcaggtgtctgtggtttcagctactcgggaggctgaggtagaggattgctggagcccaggaagtcaagactgcagtgagccaccatatcgccaatgcactctagtctgggtgacagagcaagaccctgtctcaaaaagtaaataaacaggggttgggtgtggtgcctcacgcctgtaatcccagcaatttgggaagccaaggcgggcggatttcttgaggtcaggagttcgagaccagcctggccgagatggtgaaaccccatctctacccaaaaatacaaatcagccacctcccaaccctagactctgtgctcctggggccacccaggggccagccctaacagccacctctttccctttccctctccttctctgcaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagaccggcaacgagtcgggatccaacctctcagacagcggctctgtgaagcggggcgaaaaggacctgcgcctgggggaccgcgtgctggtgagtgcgggcagtactgggctctgggcccagcttcccttccctcccctgctccgccccacttggcgaagctggacccccctgggctgggcagggtggggactcgaagggggctcggacagggtccagcctgggacacccattccttatcaggaccatacagagtgacaagagagacaggtaatgtgggctctggagactgttgctgtgtgaccttgggcaagtgtcctaaactttctgggcctcgctctttctatcggtaaaatgggatatttatttatttacttattttacttatttatttatttatttatttatttttgagatggagttttgttcttgtcgtccaggctggagtgcagtggcgtgatttcagctcactgtaacctccacctcccaggttcaagcaattctcctgtctcaccctccctagtagctgggattacaggcatgtgccaccatgcccggctaatttttgtattttcagtagagacggggtttcaccatgttgaccagactggtcttgaactcccgacctcaggtgatccacccgccttggcctcccaaagtgcttggattacaggtgtgagccccagcgccctaccaaaatgggaattttaatcgtacttcagtcatagttggagatgcattaaaacgtatcactcatttagacagtgcctaatactaagtacccatacattttggctattattgatattatctattgatccagctcatccacatgcatgtgccaggcatgtactggaaaaggctgggaactggagttctcaagacccctggtcctggccaggcacagtggttcgtgcttgtaatctcagcactttgggaggctgagatgggaggatcacttgagcccaggagttcaagaccagcctgggcaacatagtgagaccccatctctacaaaaaaaaatacaaaaaaaattagccaggcatggtggcatgaccctgtactcccagatactcaggaggctgtggtgggaggatggcttgatcctgggaggcagaggttgcagtgagccaagatagtgccactgcactccagcttgggtgacagagccagaccctgtttcaataataataataataataaggccaagcacggtggctcacacctgtaatcccagcactttgggaggccaagtcgggcaaatcatctgaggtcaggagtttgagaccagccttgccaacatggcgaaacaccatctctaccaaaaatacaaaaattagctggctgtgatggcatgtgcctataatcccagctacttgggaagctgaggcaggagaatcacttgaacccaggaggcagaggtttcagtgagccgagatcatgccactgcactccagcctgggtgacagagtgagactctgtctcaaaaaagcaataataataacagtagtaatggttataaccccttgcccagggccaggaggtgcagacaccttatcagctacaactcgagtgatcagtgttattgaagttgagagaattgggtcactggagctgacagcttcctgccaggggcccctcttctccactagtcccagctgttggggccaggttggaaaggggacagtgacccccaagtcttctagagtctgaatacagcagtgacctgggttggtggtagtcaggtggatgggacagggctgtgtcttgctgtccagccaggctgtggtggccttgggctaaccctgcacctgggaccacagtgttgggaagagactcatagggtacagggaaggctctgacatggacttctgggcctggggtgtgaggagctgtcagtggggcaggggtccctgtgtcctgtctgcaaggcttcctgggggaaggtggttggtcattccaacccgaggtggggagcacaggcttggagctccaaagccgagtggagaagggcaggggctctggggacccagagcagggatccccaaagcatattgctgcctgggatcctcccttcctgctctgagaacctggcaaaggtttctcctggaggtttctgggaggagcctttggggttgtgggtaggggagcgagaggaaatgtttacacccatggccccgttgaatcttcaagcctgtgctgtgatgctgcgatgtgattttatcatcctcactttatggatggggaaactgaggctcagggaagtttttgtttgtttgttttttgttttgttttgtttttctagtctcactctgttgccaggctggagcgcagtggtgcgttctcggctcactgcaacctccacctcccaggttcaagcaatcctcctgcctcagcctcccgagtagctggggctacaggcacgcaccatcacgccctgctaattttttgtatttttagtagagatagggtttcaccatgttggccaggatggtcttgatctcttgacctacccacctcggcctcccagagtggtgggattacagacgtgagccaccgtgcccagcctcaggaaagtttaataacttgtctgaagtgacatgtgacaagtgcctgcccactgttcactgagttgtatttcctgtctgccctgccctggccatggtgagggctctgcttttcttttcttttttttttttttgaaacagagtcttgttctgttgcccaggatgaagtgcagtggtgcagtcatagctcactgcagcctcaaacttggactcaagcaatcctcctgcctcagcctcccaagaagctgggactacaggcccatgccaccatacctggcaccacgcctttgctagcctggttcctctggacagaacttcccctgggtgacctggtggtgagcgtggccagatgtagtccctgccctccagccatctccagcttacaggagagagaccacgaggccagtgatcgcagacatcagtgtctccctacagagtctgccaagtgtgctgtggtgctctcagagcctggcctggtggggaggctgccccgaggaatggttcccccgagggcagaacttagggaatggcctggcattggcctagtgatgtggggccagagcatcgtgccaggcagagacccatggcctgagagactagagaaactgtgagaagaggcctggcatggtggttcacacctgtaatcccagcactttgggaggctgaggcaggtggatcacctgaggtcaggagttcgagaccagcctcaccaatatgttgaaaccctgtctctactaaaaatacaaaaattagccggatgtggtggcacgtgcctgtagtccgagctactcgggaggttgaggcaggagaatcgcttgaacctgggaggtggagattgcagagagccgagatcacgccattgcactccagcctgggtggcagagcgagactctgtctcaaaaaaaaaacaaaaaaaagaaactgaaaagagcagggaggctgagtgggcagtgggggaagccagggaaagatcacaccccagaggctgacctgggtgaccccacagggccagggacctgggatggagccagggctttgctctaagagctgaggtagccatggaagctgcagctgtgtgacaggttcatgggttaaggacatcacacctgctgcttggtggggatgggatcggaggaggcaagagtggagcaggggccgtgtgcggtggctcacacctgtaatcccagcattttgggaggccgaggtaggcggatcacttgaggtcaggagttcgagaccagcctgggcaacatggtgaaacctcacctctactgaaaaatacatggtggccgggcgcggtggctcacgcctataatcccggcactttgagaggctgaggcaggcggatcacgacgtcaggagatcgagaccatggtgaaaccccgtctctactaaaaatacaaaaaattagccgggtgcagtggcgggagcctgtagtcccagctactcgggaggctgaggcaggagaatggcgtgaacctgggaggcggagcttgcagtgagccaagatggtgccactgcactccagcctggatgacacagccagactctgtctcaaaaaaaaaaaaaaatggtgacgggcgcctgtaatcccagctactcaggaggttgaggcaggagaattgcttgaactcaggaggcggaggttgcagtgagctgagatggtgcggctccactccagcctgggcaacagagcaagactccgtctcaaaaaaaaaaacaagaaaaaaacccagagtggagcaggaacggcagggcccaggaaggaggctggactcctggacccctgcaccatcctgtccaaggaacttgttttgggaccgtcactctgctcttcctcctgtggctcccaggaaagccaaccccatccaacaggacctgggcaaacagcttagtctccctgacctgtccttcaggatctccggggtctgtgggcacctactgggggtgggtacagcagggaaatcaggcccaggtctgtgatattgggcaagtcacttacagagcctcatcttcattcattcattcattcattcattcattctccatgtgtctgttcagcaaaatggccatggcccagcactcttgttttgctttatgcttttatggagagcattaagagagctgatggcagccgggcacggtggctcgtgcctgtaatctcagcactttgggaggccaaggcaggcggatcactcaaggtcaggatttggaaaccagcctgggcaacatagcaagaccccgtctctactaaaaatacaaaaaaaaaaaaaatagccgggcatggcggtgcatgcctatgctcccagctactggggagactgaggtgggaggatcacttgaactcagggggtcaaggctgcagtgagccacgatgggaccactgcactccagccagggtgacagagtgagacgctgtcttaaaaaaaaaagagagagagagagaactggtggatgtgaggatgagtcatagtctgcaaggagctatggctgtgcacagtctgactaatgtcgtgggagtgccctgggcatgggcctgtgaccctgttggggtgggaagtggaggctctgggggttactgaccagcccagattgctccctggattggggagcagtaggtttaaccctagtttgatcccgcctggcattccctctgcacctgctctccctgcagggagtagatgcttctgaccatctctgggtgtggtgtgcaagagaagggcatgaggtgggcactgccactgccctagaagtgtctgctaagccctggcctgtctgcagggttggcagcagcaagggggctgggctatcttgaccttagcttctcaatctttaagtagattgcatcctatggttgaaacactgctttctgggagggcatacctcacactgggcactgtgcctagcatggttttttttgagacaaggtcttgctctgtcactcaggatggagtgcggtggtgtagtcatagctcactgcagcctcaaactcttaggctcaagcgatcctcctgcctcaacttctcgagaatctgggactacagatgtgcaccaccatgcctgcctaatttttttaatttttattatttatttattttttttgcagagatgggggtctcgctacattcctcaggctggcctcaaattcctggcctcaagcgatcctcctgcatcagcctcccaaagtgctgggattacaggcatgagccactgagcccagcctaatcgaggatttaggctagggaagagaaaggacattcgaggttggaattacagagcagcaggatccaagactgattgtgtagacagagtggcagagacctggtgccagagaggaggggctgagaaagcagtcccacctgaaggccagagaccagagagaacaacccagtctcacagacgggcctccatggcagagacaccagggccctacccaaggaggagacagaggagggtgggatctggtctggaatcaagcccagctgggattgagaaggccacagagtgtagtaagaagaggtccacctgtctctttcactccctggctactctgaacttcagtctcttcttccatgaatgtggtaacagtacccgcctcatggaaatgtcagatttggaattcttgtctttcatgtgccaggcacatgtagttggccctaggagatggtgggacaggagctagttttaattggggagctggatttacttaggcacaatgaggcatacttggggtgtcaagagaaattaacattttatttctttaatttttttttagacagagtcttgctctgtcgcccagagtggagtatagtggcgcgatctcgactaactgaaaactctacctcccaggttcaagcgattctcgtgcctcagccttccaagtagctaggattacaggcatgcgccacccacctggctaatttttgtattttttagtgagacagggtttctccatgttgccaggatggtcttgaactcctggcctcaagtgatccacccacctcagcctcttgaagtgctggtattacagtgagtccagaagtaaaatgaaattaacattttagaaagtcataggccaggcatggtggctcatgcctgtaatcccagcattttgggaggctgagggtgggtggatcacctgaggtcaggagttcgagaccaacctggccaacatggggaaacatggggaaaccccgtctctgctaaaggtacaaaaattagccgggcatggtggcaggtgcctataattccagctactcaggaggctgaggcaggagaatcgcttgaacccgggaggtggaggttgcaatgagttgagatcctgccattgcactccagcctgggcaacaagaatgagactctgtctcaagaaagcaagagagagagagagaaagaggaagaaagaaatatttaggttcagataaacatggtaaataaacatacacatttattttcaatctctcctgaatttgcactagaacaacactgaagagatgtttgggttttttctttttttgagatggcttcttgctgtgttgtccaggctggagtgcagtggcatgatcctagctcactgcaccctcaaactcctgggttcaagcgatcctcccaactcatcctcctgagtagttgggactacaggtgtgtgccaccacacccagctaatttcttaatttttttttgtagagaggggtcttgctatgttgcccaggctggtcttgaactcctgggctcaagcaattctcctttctcagtctcccaaagtgttgggattacaggtgtgagccaccacatgcagctatgaagataaatttttttaaaagagctagtggtaggggaagaggagaagcaatcagtgtccatccggaaaccctagatgttcagtaactggccgcatgttggcctctagaaatgaggctgccactggggccaggaacagaattggtttaaaagtctttgcatctgggcacagtggctcacgcctataatcctggcattttgagaggccaaggtgggtgaatcacttgaggccaggagttcaagaccagcctggccaacatgacgaaaccccgtctctactaaaaatacaaaagttagctgggtgtggtggcgcacgcctgtaatccaagctcctcaggtggctgagtcaggacaatcacttgaacctgggaggcagaggttgcagtgagctgagatcacgctgctgcactccagcctgggagacagagtaagattctcaaaaaaaaaaaaaaaaaaaaaaaaaaaacactggccatgcacagtggctcacacttgtaatccaagcactttgggaagctgaggtgggaggattgcttgagcccagcagttccagaccagcctgggcaacagagtgagaccctgtctctacaaaaaaataaaaaataaaattattcaagtgtggtgtcgcatgcctccagtcccaactactcaggaggctgaggagggaggactgtttgagcccagaagttcgaggctacagtgagccatgaatgcaccactgcactccagcctgggtgacagagggagaccctacctctaaaaacaaaacaaaacaaaaagaaaaacaccttagatcccttgccccgtccccgttcctgccttgcctgatgactactcgttgcctggtgactgttccccttgcctggtgactgttcctctagctgatgtctggtatggacacttggtctcctgagaggatgacagagaattattggatagaggggtcccaggcaggagggactgaaaaaggtagatgaagtgaacatgtgtattctttttctttttaagatggagtctcactctgtcgcctaggctggagtgcagtggtgcgacctcagctcactgcaagctccgcctcccgggttcacgccattctcctgcctcagcctcccgggtagctgggactacaggtgcccgccaccacgcctggctaattttttgtatttttagtagagatggggtttcactgtgttggccaggctggtctcgatctcctgacctcgtgatctgcccgcctcggcctcccaaagtgctgggattacaggcgtgagccaccgcgtccggccaaacgcgctgtactctaagtcccccttacccccacgcggctccctgagccctggcggccacgcctactccctctacaatggagattacaggaaacttctctggagaaaacagctggtcctctgagaaataagagaaggtgatacaggcattaaatatgaacaaaaacgccactgaatatgtgactatgaatattcatgagcatgaatattcatgttgtataaatattcagctctgggaaatgaaaaatatcacagaaataagaaactgcacagaagtgttagaagataaagataagaaaatatttcaggaactagaacagaaaggaaacagcccaggggcgggggctcacacctgtaatcccagcactttgggaggccaagacgggcggatcacttgaggtcaggagttccagaccagcctggccaacatggtgaaaccccatctctactaaaaatacaaaaactagctgggcgtggtggcaggtgcctgtagtctcagctactcgggagaatgaggccgtagaattgggaggcagaggttacagtgagccgagatcatgccactgcactccagcctggggaacagagtgactccatttcaaaaaaaaacaaaaacaggagccaaaagagaagaacattagagaacctatttacagaaaagaggaatggagaaaaaggaggggagaaaatcaaataattaattcaagaaaattccccagattgataagggtgtttcttgattgaaagggcccctaggagcccaggacagtggatggaaaaaggctcacatcaaagcacctcattgtggctgggtgacgtggctcatacctgtaaccccagtgcgttgggaggctgagatgggaggatcccttgagcctaggaatttgggatcagcctgggcaacatactgagaccctgtctcttaaaaaaagaatgagagggccgggtgcggtggctcacgcctgtaatcccagcactttgggaggccgaggcaggtgaatcacaaggtcaggagatcgagaccatcctggctaacacggtgaaaccccgtctctactaaaaatacaaaaaaattagccaggcatggtggcgggcgcctgtagtcccagctacttgggaggctgaggcaggagaatggcatgaacccaggaggcggaggttgcagtgagccgagattgcaccactgcactccagcctgggcaacagagcgagactctgtctcaaaaaaaaaaaaaaaaaaagaatgagggtagcaagagaattcaaaacagatgttcacacaaaaacttgtacaagtaggtcaggcgtgatggctcatgcctgtaatcccagtactttgggaggccaaggcgggcagatcacttaagctcaggagtttgagaccagcctgggcaacatggtgaaacctcgcctatacaagaaaaaatttaaaaaaatcttgtacaagaatattcatagcaacattattcataatagccaaaaagtggaagcaacccagttgtccatcaacagataaatggacaagcacaatgcattctgcccatgccatgggatactatttggccacaaaacgaatgaagtactggtcgggcatggtagcttacgcctgtaatcccagcactttgggaggccaaggcgggcggatcacaaggtcaagagaccgagaccatcttggccaacatggaaaaaccccgtctctactaaaaatacaaaaattagctgggcgtggtggcacgtgcctgtaatcccagctactagggaggctgaggcaggagaatcacttgaacccaggaggcagaggttgcggtcagctgagatcgtgccactgcactccagcctggcaacaaagcgagactctgtctcaaaaaaaaaaaaaaaaaagtatgtatgtgtgtgtgtgtgtgtatatatatatatatatatatatatatatatatgtaaataaaaattaaaaatcagtggggtagtgatacctgctgcaatatgattggaccttgaaaacatgatgctaagtgaaagaagccagacacaaatggccacatattgtgtgattccatttccttttgagataaagtctcactcttgtcacccaggctggagtgcaatggcacaatctcggctcactgcaacctctgcctcacaggttctcctgtcttagcctccggagtacctggcattacaggcgtgcaccaccacgccccgctaatttttcgtatttttagtaaaaatagggttgcaccatgttggccaggctggtctttagctcctgacctcaagtgatccacctgcgtcggcctcccaaagtgctgtgattacaggcatgagccactgcacccagccgtgtgattccatttctatgaagtgtccagaagagacaaatctgtagcgataggatagaaatagactaagggttgtcaggggctgtcaggaagatggaacaggcagtgatttctcctgggtatggggcttctctttgggatgatggttattattttttgaaatggagtctcactctgtcacccaggctagagtgcagtggcgcaatctcagctcactgcaacctccgcctcctgggttcaagcgattctcatctcagcctcctgagtagctgggattataggcgcccaccaccacgcccagctaatttttatatttttagtagagatggggtttcaccatgttgcccaggctggtctcaaacttctgagctcagctgatccacccaccttggcctcccaaagtgctgggattacaggtttgagccactgttcctggcctgtatgtttattttttattgttgtattttattttttgtagagatgagggtctcactatattgctcaggctggtctcaaagtcctggcttcaagtgatcctcctgcctcagcttcccaaaacactaggattacaggcatgagccaccatctttgggccctatatgttttaaaatggttaaaatggtaaattttacattatgtgaatttttacctccattaaaaaaaagagtgagccaggcacagtggctcacgcctgtaattccagcactctgggaggctgaggaaggaagattgtttgaggccaagggttcaagaccaggctgggcaacatagtgagctctcatctctactagaaaatgttcaaaaattagctaggtatcgtggtgtgttctgtaatctcagctacttgggaggccaaggcaggaggatcacttgaactcaggagttcaggctgcagtgagccatgatcgcaccactgcactccagtatgggtgacaaagtgagagcctgttgaaagaaagaaagagagagagagaaagaaggaaggaagaaaggaaggaaagggaaggtaaggaagggaaggaaaggaaggaagggaaagaaaggaaggaagggaaggaaaggaaggaagggaaggaagagaagaaggagagaaagaaagagaaagaaggaaggaaagggaagagaagggaaggaagggaaggaagagaagaaagaaagagaaagaaagaaagaaaaagaagggaagggaaggaagggaagaaagagagagagaaagaaagagagagagagagagagagaaagaaagagaataaaatattttggccaggcacggtggctcacgcctataatctgaggcaagcactttgggaggctgaggcaaatggattgcttgagcccggaagtttgagaccagcctgggcaatgtgacgaaaccccatctctacaaaaaatagccaggcgtggtgccctgtgcctgtagtcccagctacttgggaggctgaagtgggaggatcgcttgtccaggaggccaaggttgtggtgagccgagatcacgccactgcattccagtgtcaaaaaaaaaaaaaaaaaaaaaagaataaaacattttcagatatagaaagctcgaaaatttacctcctcgtgcatcttttcttagaaagctgtgggaagatgtgctctactaaaataagtagtaaaccagccagacgtggtggctcacacctgtaatcccatcactttgggaggctgaggagggcagatcacctgaggtcagaagtgcgagaccagcctggccaacatggcgaaaccccgtctctactaaaaatacaaaaattagccgggcatggtgacaaacgcctataatcccagctactccggaggctgatgctggagaatcgcttgaacctgggaggcggaggtttcagtgagcggagatcgcgtcattgcactccagcctgggcgacagagtgagactccgtctcaaaataaataaataaaataaaataaaatacaataacataacctaaaataagtagtaaaccaagaaagaagagtcaggggatccagaaaacaggagcaagcccaggacagaggcgaaatggttgacaggagactccaggccaatggccgcactccagagaggccagcagccagcccagctgggagtgggtcccgggagagacatcttcagaaagaacttgataaaattcccaatgcctctgagcatcttggcaggagatttagactattgaaagagttggggttgaattagtattgagactattaaaactaggcagacaggccaggtgcagtggctcacacctgtatcccagcactttgggaggccaaggcaggtgaatcacttgaggtcaggagttcgagaccagcctggccaacatggtgaaaccccatctttactaaaaatacaaaaaaattagccgggcatggtggtgcatgcctgtagtctcagctaatcaggaggctgaggcaggagaatcacttgaactcgggaggtggaggttgcagtgagctgaggtcgtgccactgcactccagcctgggcgacagagtgagactctgtcttaaaacaaaaacaaaaacaaaaaaaacactaggcagacaatcatcaaagatagttatttataggaaaaaaaaatttctggaaaggaaaagtaactacaatacatcatcctcatctatgagtactatctacttagtcatagtactgcaatcctggagtcagatcaaaatttagatatggaatacaaaaattagctgggcgtggtggcgcgcacctgtagtcccagctactcaggaggctgaggtaggagaatcaacactgtctcaaaaaaaaaaaaaaaattttagatatggaccaggtgtggtgattcacacctataaatcccagccctttgggaggctgagacaggaggattgcttgaagcccggagttccagaccagctcaggcaacatatcaagaccctgtgtctacaaaaaatttttaaaaacttagctgggtgtggtggcacatacctattgccccatctactcaggaggctgaggcaggaggattgcttgagaccaggaatttgagaccagcctgggcaacatagcaagatcctgtgtctacaaaaaattttttaaaaacttagctgggtatggtggcacacacctatagtcccagctactcaggaggctgaggtgggaggattgcttaagcccaagagtttgaggctacagtgagctatgattataccattgcactccagcctaggcaacagagcaggaccctatctcaaaaaaaaaagaaaaagaaaaactgcttttagggttaccatttattgaagctctagtatatactagacaccgtatatacagtacttaattctcacgaaaaccctttttttttttttttgactcagagtctcgccctgttgcccaggctggagtgcactggcgcaatctcggctcactgcaagctccacctcctgggttcatgccattcttctgcctcagcctcccgagtaactgggattataggtgcccaccaccaggcccggctaatttttgtatttatagtagagacggagtttcaccatgttgggcaggctggtcttgaactcctgacctcaggtgatctgcccaccttggcctcccaaagtgctgggattacaggcatgagccaccatgcccagccccgaaaacccttttacagatgaagatgctgaggctcagagaggttagataacttgcctaggcacacacagcttctaagtgacagagtttgaatgcaggtctgtgtgtctgtcttcaaagcctgtgcccttgcctgtgtcagccctgggaggcactggttaacctgtctccatctcaatcatcctcaggtgtctctccctccccactcctggctcccgtgtcctctgcatgctggaagggatggatgggataagcctgggctgggtgcccctgccatctctgcctgtgccactgcatcctctagacctgagtctccctgtgtgccgacaggttggcgggacgaagactggcgtggtgcggtacgtgggggagacagactttgccaagggcgagtggtgtggcgtggagctggacgagccccttgggaagaatgatggggcggtggcgggcaccaggtatggtgggcttcttctggggagtatgggagggggctcctctccccagggtgggcgcaggggatggagatgggacattggaggaagcgagtgtccagcatgtagtgtcagacaccataagtcctttcccattccctccttcccaacagcccactaagctgggtagtgggattatcatcccattttacagatgagagtatggaggccaggaggtcattgttcaaggtcgcacagtcacaggcaagcgccaagagaatctgtccccgtgttctcttctttgtgtcactcatgtctaagtggggtgggagccctcaaaaaggagagggaggctgcgtgcagtggctcatgcctgtaatcccagccttttgggaggctgaggcaggtggatcacttgagatcaggtgttcgagaccagcctggccaacatggtgaaaccccgtctctactaaaaatacaaaaaattaactgggcatggtgacacacgcctgtaatcccagctacttaggtagctgaggcacgagaatcacttgaactggggaggcatcggttgcagtgagccaagatcgcaccactgcactccagcctgggtgacagagtgagactctgtctcaaaaaaattagccaggcatggtggcatgcacctgtagtcccagctacttgggaggctgagacatgagaattgctggaacccgggaggcgaaggttgcagtgagctgagatcacgccattgcattccagcctgggcaatagagcaagactgtctcaaaaaaaataataaaaaataaataaataaataaataaaaggtgaggcagcagtccctgtcatctggcattggggtcccctgaatgacacatgaaataatcagacaatgcccagcgctatatggccagaggcaggcctcacagatgggttccaggtctcacagcatctctgatgaaaaggaattgactgctggcgttgctgggttaggagggtctaaggctgtgtctgggcttatggtaggtgggggagtgatgtggtaagtggaccatgtctgtcacggatgtggactaaggtgaggccacctgagtccctgtgcagtccctgtactggagtctgtggttgagacgaggctgtgactgctctgagcaggagtggtcaccatggcacaggggaagagctaggcttggaccaggcctcgaaagaaggtagggtttccttttggaagaggcttgagagaggctgtgctaggcaggggctgagagcacagtatgaacaaagacctggaggtgggaaaaggcagaatggggcagcggtttcaagtgaatcagaagctggatgggggccaggcatggtgactcatgtttgtaatcccagcactttgggaggctgaggctggaggatcacttgaagccagcagttaaagactagtctggacaatatagcaaaacctcatctctacaaaagatacaaaaattagctgggcgtagtagcacacacctgtggtttcagctacctgggaggctgaggtgggaggattgcatgagcccaggaggttgaggctgcagtgagctatgatcgcaccgctgcactccagcctgggtaacagagccagaccctgtctcgaaagaaagaaaaaaactggatgggcccagttctcgtggtccagtgtggaatccgtgaccagagaggtcttgacagaagacgagaatccagggtttccataacaatgctttgccttcctgtttgcaagatgaatgtttcttttgactcacttttgctttcagaattcaggggtgggttggacagcagtccccatcccaccccaaggtttctctttcaagcttttgcttctctatgcagggattctgtgggcagagagctgatgggaatccttcattctggggatggtctgagggtagcctgaaagtggggctgcagctgtggctggggtctctgaacagtctgtgggagccaagcttagcgggtgttggagcccagcacactggaggaccagtctcagctttgctgcgtaaccagctgtgtgactgtgggcaagttatttaacctctctgagcctaaattttctcatttgtgaatgtagataactttgggggatggaaatgagcattcatttaaagagactggcacaaagtgggtcccagtaattatttcctacttccaagagtattctcattggctgttcacagctgcagagactctcagaccctactcacctatatcctttttttgagagtcctatctctccacctggaagatttccaccttggagtgtctttccacatgggccccaaggaggtgtctttctctctttctgccaggctctgaagaggcagaggaggcaggggaggctctccaggctttggggccgtgacagcagcttgggtctctcctgcttccacaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctggtgagggtggggctgcagaaggggattctctggtgtgcgtttgggaggggtgaggatgtaagagatccaggtgttctggtctgcccctgacttactctagttccagtttgggatttttgaacaaagaagaaagtgcatatcttttaatagggaaaattgagccatttacctttattgctgtttttatataactgatttattggaaccctaagcctttctctggaagttaaggagggttatacagatgcagggcagggagttcagaaaggttggcatcaaaccctggatgaagggaaaagaggaggctgcttggtggctatgggcagagggcattctgtccaaacccaatctaggattggaggttcctcctttcccaggaaaaagtggccaaagtgagggagtcagaggctctggctatcaggagctgactctcctgagatggggagtttcctgaatctcaaacatcaagattccccgctgggtgagtcagcaggggccaggatgtcagagtactggcaggggaagagcaggaccctgggagtcaaggcacttgggctcccacctgctatgttgctgtagattaggctggacagagccagtctgccctgcagtgcttcagatccctgagacccgcctgcatccacaccttcctgcagctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcaggtgagtggcaggtggggctgggggcagagcttctccagccagcctcatagagtctcacccactcagagcggagaccctggagggggtgggtgcagagaaatatgaagataacacaagcagtacctgtcccccgctttccagagataagcctcagtgacctggtgaatttccttccagtcttttctgcctatgtataaggatacatacacctactttcagaatctggttacaagcttgtatatcctgctttttaattatttatttatttattatttttctttctttctttttttttttttgacggaatctcattctgtcacccaggctggggtgtagtggtgcaatctcggctcactgcaacctccacctcctcggttcaagcgattctcctgcctcagcctcttgagtaactgggattacaggcatgtgccaccatgcccagctaatttttgtacttttagtagagacggggtttcaccatgttggtcaggctggtctcgaactcctgacctcgtgatccgcccgccttggcctcccaaagtgctgggattacaggtgtgagccactgcaagggttttttttttttttttatgagacagagtctcactctgttccccaggctggagggcagtggtgcaatctcagctcactgcaacctccacctcccaggttcaagcgattctcctgcctcagcctctcaagtagttgggattacagcacctgctaccaaaccaggctaatttttgtattttaagtagagatggggtttcaccctgttggtcaggctggcctggaattcctgacctcaagtgatctgcctgccttggcctcccaaagtgctgggattacaggtgtgagccaccatgcccagccctgcttttttatttttttaaaatatttttaatatagggatggggtcatgctgtgttggtcaggctggtctcgaactcctggcctcaggcaatccttggccttccaaagtgctaggattacaggtgtgagccactgcacttggcctaatctgcttttcttccccggctacttattatactgcaagcattttctaggtcctggcaaattcctcatcattcttttttttttttattttatttttttcttttagagatagggccttgctttgttgcccaggttggagtgcagtgacgccatcatagctccactcctgggttcaagtgatcctcccacctcagcctcctgagtggctgggactataggtgcacgctaccacatccagctaaattttgtatttttttgtggagacggagtcttgctatgttgcccaggctggtctgaaactcctggcctcaagtgaccctcccaccttggtctctcaaagcaccgcgattataggcataagccatcgtgccccacctcttccccatcttgatgtctgcattgctgtctatcacaggctttgtccttactgacatctgacgtgactagtcccctgttgtttagattatttcccatttttcactttttttgagacagagtctcgctctgtcacccaggctggagtgcagtaacacgatcttggctcactgcaccctctgcctctggattcaagcaattctcctgcctcagcgtccttagtagctgggactacaggtgtgtgccaccacgcccagctaatctaatttttgtatttttagtagagaaggggtttcaccatgttggacaggctggtcttgaactcctggcctcaagtgatcagcccgcctcggcctcccagtgtactgggattacatgtgtgagccaccgtgcccggccaatttttcactctttctacatatcactgcagtaaactttttttttttttttttaatgtatgactgtctacatttcaggtttcttttttttttttttcttttttgaggcagagtctcgctctgtcgcccaggctggagtgcagtagtgtgatcttggctcactgcaagctccgccccccaggttcacgccattctcctgcctcagcctcccaagtagctgggactacaggagcccaccaccacgcccagctaatgttttttgtatttttagtagagatggggtttcaccatgttagccaggatggtctcaatctcctgaccttgtgatccgcccgccttggcctcccaaagtgctgagattacaggcaggagccactgcacccggcccatttcagattatttttttgagcagattctagggttgaatttcaggaaagtgactccttgccccaagccttggggctgctgctatctcgtgtctggttttttctctgatgtttgtctcccgtgggagagttcccttctgggcctctgtccccatctggggtctggcttgcccctccttggatgccaggatcaataggccaagttcatggctgtgctttgatggagcacagacaagacagcaggtttgcaagataacaggtcttaggctcttgtgggttgaggcgggaggcaggtactgagggcaggtgggcctaagggtcctgcctctgcctctcttgttcctactgggtcccctccttcacacctaggcccactgtgcatgcccggcaggtgccagcagggaagttggggtgactggggttccaggccctgctccttgcctgtctcccaccacaccaccaacctggaccccataccccggagcatgctgaccctgtcctggccttccttgggggcccagtatgttgcagaagccgaggagaagctgcagcgagcccggctgctcgtggagagcgtgcggaaagagaaggtggacctgtccaaccagctggaggaggagaggaggtacgtgctggcccaccctcgccctggccctgagtccccttaaggaggatgaggaagagggcaggcttgggaatagcggacccaggttccagtcctgcccctgtcactgcctctggctgtgtcaccctggactggtgacattaactcttgggcctcagtcttcctatctgtaaagtgaggtgttggtcctgtcttctgcaggcagttgggagaactcttcatataactggagtaaagcacccagcacggtgccgggcacagagggacaccacatttttaaaaatttttttgaaacagggtctcactctgtcacccaggctggagtacagagccacaatcacagctcactgcagccttgacctccagggttcaagtgctcctcccacctcaggctcctgggtagctgggaccacaggcgtcccccaccacgcctggttaatttttgtattttttgtagagatggggttttggcacattggccaggctagtctcgaactcctgacctcaggctattcacccgcctcggcctcccaaagtgcaggcatgaaccgttgtgcctggccttggaacaccgcatttgttcattgcatagagttcactgttcctgcactctccagcagaatattgagaagaggaataggctgggggtggtggaagggaggctggttatcacaccaggtgtccctggggagccgtgcaccaggaagaaggctgaatgccccacccctccaccatgagccagttcacactcacagtgcgcccctccccaaccctggactgagacctgtgagtggagctcacagctcctgtcctgggaatccatttccccttttttccctccctccctccctccattcattccttccttccttcttccctcccttccctccctcccttctttccttccttccttccttccttccttccttccttccttccttccttccttccttccctccctccctccctttttctttctttttttcagagtcttgctcttgttgcccaggctggagtacaatggtgcgatctcggctcactgcaatctccacctcccaggttcaagcaattctcctccctcagcctcccgagtagctgggattacaggcatggccaccaagccctgctaatttttgtatttttagtagagatggggttttaccatgttggccaggctgatctcaaactcctgatctcaggtgatccacctgcctcagcctcccaaagtgctgggattacaggcgtgagccaccgcgcccagcctcctttatttttcttttttgagacagggtctcactgtgtcacccaggctggagtgcagtggtttggccatggctcactgcagcctcaaccttctgggctcatgcgatcctcccacctcagccttccaggtaactgggactacaggcacacgccatcatgcccagctaattttttgtatccattctcattttacacatcaggaaactgaagttaagagaaacagcagccaagggactcctgaaatgccctgtgtccaggtgtcagccctgtgctgtgtgcttcgctggtgtcatcgctttcaaggccagatgcagtggttcatgcctgtaatctcagcactttgggaggccgaggcaggcggatcacctgaggtcaggagtttgagaccagcctggccaacgtggtgaaaccctgtctctactaaaaatacaaaaattagctgggcatggtggcaggtgcctgtaatcccagctactcgggaggctgaggcaggagaatcgcttgaacccaggaggtggaggttgcagtgaaccgagatcacgccactacagtacagctgggtaacagagcgaggctccgcctcaaaaaaaaaaaaaaaaagtcacaagtgggacccatctcccctgcagccctccaaccaaagacaccaggcggtggggactctggccgacttggtcctgggtcacctccttgtaggacacaaagctgacagtggacagaggtttgccttggcctgggatcctctctacctcctagatgatgcccagatacctacatctccctcccctgtccccaggcagcagccagcccccatccccaacacccccacttgggtctgttctgtgggctttcagctggcacctgcgctccataagctgttgttactgtcggattcagggagatgagggtgtatttatatttgcctgagacagccatagtggcctacacatctggttcccatggcgatgtgcctgacgccaacaaacacagatctttttttctttttcttttctttttttttttttttttttgtttctttagacagagtctcgctctgtcacccaggctggagtacagtggtgtgatctcggctcactgcaacctccacctccaggttcaagcaattctcctgcctcagcctcccaagtagctgggactacaggtgcgcatcaccatgcctggctaatttttatatttttagtagagacagggttacaccatgttggccaggttggtcttgaactcctggactcaagtgatccacccgcctcggcctcccaaagtgctgggattataggcaggagccactgtgctcagccacaaacacaaggcatcatggagttttgttcagaaggggcctgggtgcaagtctctgcattgtcctgtgcttgctgtgtggccttcggcaggtcgcctgccctctctgggcctcattcctcattgctatgccgagagctgttaggaggccctaggaagagcagctttgagcttttttttttttcccccaagatggagtttcgctcttgttgcccaggctggagtgcaatggcacgatctcagctcaccgcaacctctgccttttgggttcaagccattctcctgcctcagcctcctgagtagctgagattacagggatgcgccaccacgccccgctaattttgtatttttagtagagacagtttctccatgttggtcaggctggtctcaaactcccgacctcaggtgatccgcccaccttggcctcccaaagtgttgggattacgggcgtgagccactgcaactggcccagccttgagttcctatgtgtggctgtaaggtggggtgggcctgtgtctctcccctgcgctgtcttgacaggtgtgtgacagagtgtgtctccctgagggtagccctgatgcctgggcattccacatccaggggcagccctgggagtggggattgggtctctgacccccagttttgaggcctgtgatgagaacaagatcaacagcaaaggaagcccactttccttctctcctttccttcctccccacaggttgttccttgtggtagtgtctgttccccgcagtgatgaaaacagtgttgtcagctgggcgcggaggctcacgcctgtaatcccagcactttgggaggctgaggtgggcagatcacttgaggccaggagttcgagaccagcctggccaacatgttaaaaccctgtctctactaaaactacaaaaattttttattgaggttgcatgcccagtgatgtatgcctgtaatcccagctactcaggaagctgaggcaggagaattgcttgaaccgtggaggcagaggcctcagtgagccgagatcacaccaatgcactccagcctgggcaacagagcgagactctgtctcaaaaaaaaaaaaaaaagggagggaggaaggaaggaaggaaggaaagaaagaaggaaagaaaacagtgttgtcactcacatccccgggccaccctgccctttattttatttcccaccaccctggggaggaagggtgttgccttaaacactgccattctggagttattggtggttcttcctagagtgcaggtcagcaggttgggaggtctagagctttccaggactgtgggacattttgatggcctcgcctctggattctgggccattctcatggccttgcctctctctgctgttgctcattcggtgaatcccgttgctctgggcaaagccaggtcagccacctctttccctcccctgcaggaaggtggaggatctgcagttccgcgtggaggaggagtccatcaccaagggagacctggaggtaacagtcagaggccccttccctgggcacacttagcaccggtgcctggcccttgctagggcagatggttgtgaggtccagcagcacctctaggcccccccggggaaggggctgggggggaaaatggggaaggatcaaaggtctgatgtctgaggtgttagtggctcagccccaggagccccccagggaagctgtgctccccgtgtcagcagctggatggggtgggcaggacgaacccagggcagggcagatggggggctgggccccaggatagagtggctgaggtcccctgtcccttcttcttaggcaatagccctaaaggtgccccttcgttcatcttggattccaggtaaaattttggctgaaagtagcttgctgagtcacagaatttataggtaggaaaactgaggctcagagaccaagggagctgggtatggtggctcacacctataatcccagcacttcaggaagccaaggcagaggatcacttgagcccagaagttcaagaccagcctgggcaacgtagcaagatcccatctctacaaaaaatttaaaaagttagccaagcatggtcatgtgcacctgtggtcccagctactcagggaggctgaggctagaggatcgcttgaatctgggagatggaggctgcagtgagctatgattgcgcctgttttttgttgtgtgtgtgtgtgtgtgtgtgtgtgtgtgtgtgtgtgtgtgtgtgtgtgtgtgtgactgtctcaaaaaaaagaatggatgttggggcacaacccagcgtcagagcctcagcccagctcagcatgttctaattaagtttccctcttggccaaggggcaggccatgtggttgctcctggctgacttttccattggcagttgctctcctgcaggggttggatggacttctgggaaaagcacctgtatttgccaggaacagagacccccctgtgccagctgcagtcaccatgggggcttactgaagggctgtaggaaaggtcacagcctccaagggcaggcatttcaggggactggagccagaaacagcatcgggagctaagcccatccatgtgccccttactcagggtctccttccgatctgtgtctgaggtcaggctcctcctgtctgtttcccactgtgtttctcggctctgctcttctcccagccccgcccactacctaccagctgtcattgagagaggctctgattggtcccagggatagccaatgggctggctggctctggataggggtccaccccggatccagccggccctggctgggagaggcagggggcgggacagacagtgacagctaagtcagtccaaagggctgcagaattccccatgcaacgttttattgtagcaaactgaattgtgatcatattcatggcaaccagaaggcaaaatgaccaaagtcccactcatcccctcatccccacccttttttttcttttttggagacaggatctcactctgttgcccaggctggagtacagtggcaccatctgggctcactgaagcctccacttcctgggctcaagtgatgctttgcctcagcctcccaagtagctaggactacaggcgtgtgccaccacacccagctaatttttgtatttttttttgtagaggctgggtctcactatgttgcccaggcagggtctcgctatgttgcccaagtgggtctcaaactcctaggttcaagcaatcctgcctcagcctcccaaagggctgggattacatgcatgagccatcacatctggcccccacccatcttaaaagtcagaaataaaagccagagcccctccttgacctcctggccccctccgctttatcaccccacctctctgcctgtctttattgcaaaacccccagaaggttatcaggctcatggtcttccctcctgtccacactgccccaactacacaatgagatgcccccattccaactccccagcctcctctgctggcgtctcctccttcctaatctctgaacattgtcccatccaagggctcagtcccaggtccgttcaccccttgtccacactcaccctgagagcttccagtctgtggcctccatgccctggaatgagcccctgtaagatccacagtcttccccaagctccctgtaccatgcccatttgacatctccacccaattgaggaagaagcaagcacctgtatcaatttcctggggctgcaataatgcacagccacaaatgtgtggcttaaaacagcacaaacatatgctttcgcagttctggaagccagaagtctaaaataaaggctgggcgtggtggctcacgcctgtaatcccaacactttgggaggccaaagcggcggatcacttgaggtcaggagtttgagaccagcctggccaacgtggtgaaacaccgtctctactgaaaatacaaaattagctgggcatggtgacgggcgcctctaatcccagctactccggaggctgaggcaggagaatcacttgaaattgggaggcggcagttacagtgagccgcgattgcgccactgcgcttcagcctgggcagcagagtgagactccttctcaaaaaaaaaaaaaaaaaaaaaaaaggcctgaaatcaaggtgttggagaatctattccaatctagcttccaggaggattgccggcagcccctgatgctccttggcctgtataactgcatcaggccagtccctgcctcctgtcactttgctgccttgcctgtgtggcactttacttgaacatcttatgaagacagcagtcactggatttagggcccactctaatccagtcctaatccagtatgacctcattttaactaactacatgtgcaagaccctattccaaagaaggtcacatttgttctttattttgtttaaaaaaaatttttttttttttgagatggagtctcgctctgtcacccaggctggagtgcagtggcgcaatctctgctcactgcaagctccccttcccgggttcacgccattctcctgcctcagcctcccaagttgctgggactacaggcatccaccaccatgcccggctaattttttgtatttttagtagagacgaggtttcaccgtgttagccaggatggtctcaatctcctgacctcatgattcgcccgcctcagactcccagactgctgggataacaggcgtgagccaccatgcctggcctattttgtttaatttttatacagatgggttctcactatattgcccaggctggtctcaaacttctgagctcaagcgatcctcccaccctagcctctcaaagttctgggattataggtgggagccaccatgcctggctaaggtcacattctgaggttctgagtgggcatgaaatttaagaagtcactattcaacccaggaccacagcccaaattgaacatgtcctaaccacatctatccaggcctcccctaacaccaccccccttacggttcccatctcagatattggcccccaaatccacacagttggctgggcatggtggctcacacctgtaatcccagtgctttgggagcctgagacaggaaggttgcttgagcccaggagtttgagaccagcctgggcaacatagcaagaccgtgtttctacaaaaatattttttaaaaatgcgggcatggtggcacatgcttgtaatccaagcactttgggaagccaaggcgggaggattgattaagcccagaagttcgagaccagcttgggcaacatagggagaccttgtctctacccaaaatggaaaaattatccaggtatggtaatgcatgcctatggtcccagctacgcgggaggttgaggtgggaggatcgcttgagtccgggcagttgaggctgcagtgagctgtgatcacaccactgtactccagcctgggcaacaaagcaagagcaagaccttgtctcaaaaaataaaaaataaaggccgggcgcggtggctcacgcctgtaatcccagcactttgggaggccgaggtgggcggatcatgaggtcaggactttgagaccagcctgaccaacatagtgaaaccccgtctctagtaaaaatacaaaaacttagccgggcctggtggtgggcgcctgtaatcccagctatacaggaggctgaggtaggagaatcgcttgaacctgggaggcggaggttgcagtgagccgagatcgcgtcattgcactccagcctaggcgacagtgcgagactccatctcaaaataaataaataaataaataaataaaaataaataaaataaataaaaaataaaaaacaaaaaaagtccttttgaccttacctccaaaatcatgcacatccgcacagctgcttccctggaccaggccctagcaccatgccatggatagccctctccttcgtcttctgttcctccaaagtccattctccacactgaatctagtcttttttaaaaatatcgttttcatttttaatgttggaaatttttaagcctatacaaaaatagagaagacagtataatgaactttcatttacccatcactcagcttcaacagtcatcaactcaccgccagtcttatttcagccatgccctgacccagggccccctcccacatcccagacgtcatatggccaaatatttttaaaatgtaaatcaggccgggtgcagtggctcacacctgcaatcccaatacttgggagggagaggtgggagggtggtcacttgaggccaggagttagagaccagtctgggcagcatagtgagaccccatctctacaaaaattaaagtattctggctggatgtggtggctcacgcctataatcccagcactttgggaggccaaggcaggtggatcacttgaggtcaggagattcagaccagcctggccaacatggtgaaaccctgtctctactaaaaatacaaaaattagctgggcatggtggtgggcaccagtaatcccagctactcaggaggctgaggcaggagaagcgcttgagccagggaggcggaggttgcagtgaaacaagatcacaccactgcactccagcctgggcaacagagtgagactctgtctcaaaaataaagtagaaacaaagaaacaaaataaataaaataaaaaatccaccaggcatggtagcacgcctgtagtcccagctacttggggggctgaggcaggaggatcctttgagtccaggaggttgaggctacagtgagctatgatggcgccactgcactccagcctgggtgacagagcaagaccccatctctaaaaataaataaataaaaatttttaaaatatggctgggtgcggtggctcacacctgtaatcccagcactttgggaagccaaggccagcggatcattcgaggtcaggagctccaaaccagcctggctaacatggtgaaaccccatctctactaaaaatacaaaaattagctgggcatagtggtgcttgcctgtaattccagctactcggaaggctgaggcaggagaatcgcttgaacccaggaggcagaggttgctgagccaggctccctccactgcactccagcctgagtaacagagcgagactctgcctcaaaaaaaaaaaaaaaaaaaatccaggcacggtggctcatgcctgtaatcccagcactttgggaggccgaggtgggcggatcacgaggtcaggggatcgaaaccatcctggctaccatggtgaaaccctgtctctactaaaaatacaaaaaattagccgggcgtggtggcgggcgcctgcagtcccagctactcgggaggctgaggcaggagaatggtgtgaaccaaggaagcagaggttgcagtgagccaagatcgcgccactgcactccagcctgggcaacagagcgagactccgtctcaaaaaaaaaaaaaaaactaatttaaaaataaaaatgtaaatcagatcctgcccctttcctgctcacacatctagcactgagacactagatatcatctaggctctgtagagtgggccagagaagacccccagggcccaaccctcccccccaccaccacccccctgccttgtcccagccctgtctcacacccctgcccctaagttatcatacaccaggcttttctctttctggaacaccacaagctgtgtcctgcctctgagcttttgtacacgctagttccccggcctgaaacacttgcgcctcttcctcttgtgcctgccttgtacaaggagtccttcttatccttcagaactcactgtaaattacatgtttcctctatttcacgttcattccagttactctctccccagtgctctgttcatagtgcaaatcacagtctggaatgatcttcactattcttttatggtttgcatctgcctccccaccccccagaatataaacccgttgaggggccaggcgtggtggctcacacatgtaatcccagcactttgggaggctgaggtgggcagatcacctgaggtcagaggttcaagaccagcaaacatggtgaaaccccgtctctactcaaaaatacaaaagttagctgggcatgatggtaggcacctgtaatcccagttactcgggaggctgaggctggagaattgcttgaacctgggaggtggaggttgcagtgagccgagatcgcgccactgcgctccagcctgggtgaaagagggaaactatgcctcaaaaaaaaaaaaaaaaaaaaaaaggttgaggggaggagtcctttggagtgggaccgaatgaagttgcccttgaaattgcgaagctggaggctttttcttgcctgtgcgggctaccagttcagtgtgtaggatcatgcaccatctatgagggttccagacagggctgttgtgcccaccgacggggataggggtggctgggatggagcttgtgattttctggaagagacatgctgacttcttgttggcactggaacacactgccaggagggaggcgggggagggagggagaggagagaaagagagagggagggacacaaagaggggagacaggaagggagagaggggaaaagagaaggagagaaggagggagggagggaaacagggaggggaatggagagagagagggagggagagagggaaaaagaaaggagggagagagacgggggggagaaagaagagagagaaagtgggaaggagaggggagagagaaagggaaggacaaagagggagagggaggagaaggagagaggaggggagagagagaactttttttgttgttccttaaggaaaattcaagaaataaaataggccaaaggacataatcatctcaatgtctcttaatgaattgcaggagtatttctaatcaggtgatgtccgtttacaccttcaccaatagacaagcttccggggttttattacaggtttcacacctagaggctgttttgctaagccccgccccttcagaactgccctgcagctgctttaaccccttctctcctggagtataaagaggaccctctggcttctccctaagatgaacttgggtctccaaactgctcccaatgtcctcaccctcccagcttcccttccaagatctgttctgtgaaatgcaaaagccagtcttgacaccctgagaatgctggcctttgtcagcagatgaagcagatattgtcgagctgggacaaaagtgcccttgtgatttgtggagaccaggcgtcctctgtggggtccggtggggtgggcagcaatggggcccgggagtgggaggcacagcccggcctccaccaaggaggctggggccaagaggatcgtgaggggtcgggtatattttggaaacatcttgcgtgttatgggttcttgcacttttagcacaggcctggggggggggggggagtcgagcgggaatcccggggtcctttatttattcctcatcctgtgggtctcctgtgtggaggatgctttgcctacaaccagtgacagcctgcaggggaacgggaacaggatgggcccctccccaggagcagatccttgatgaggaccttcaaggtcaagggctgctggttgggggttgggggggacagaaaagcgaggtgcccattgctaccccaagcaggggccagcgagggaggatggcttgcaggcccccaccccccaccgccctacactgacccagccgggacacagcaaggggtgggcatgaggccccacacccctcgcctccccagacttcctctctttcgctgagcaattctggctcatgaatctactctcctcgccttgttcacggaagatgacgcctcctctctctctctctctctttctctctctctccggcttcttcttccctgtgcccccctccctgcgtccccgcccccacccccccaccgtgtccaccctgggtggaccagacccagacgcagctggagcacgcgcgcattggggagctggaacagagcctgctactggagaaggcgcaggccgagcggctgctccgagaattagcggacaacagggtaaccgcgccaccgcacccgcctggcccgccagccaccttgccctttgatgccccctctggcttctctgtttcattattgactctctttctttagctgctatcatcttttttatttttattttttatttttgcatccccttggaggagggaagtcaagatttagaaatgtgcttatgtggccgggtgcggtggctcacgcctgtaatcccagcactttgggaggctaaggagggtggatcgcctgaggtcaggagttcgagaccagcctggccaacatggtgaaaccccatctctactaaaaatataaaaattagctgggcgtggtggctcatgcctgtgatcccagctacttgggaggctgaggcaggagaatcgcttgaacctgggaggtggaggttgcagtgagctgagatcgtgccactgcactccagcctgggtgacagagtgagactccgcctcaaaaacaaaacaaaaagaaatgtgcttatgttccctggctcagtgttgcttattggggtggagttgggggtgggggtggtctttgttttttgggacttggctccccagcttattgccccagcagctgagaacgtcctgtgagaccccccagtctccccgatgcattgccatgacaaagtgttggagttcctgggaatgtcctgtctctatgtaggcagacctagaaaccactgatccatgtctcctgtctccccagctgaggaggctggggagaggaaggaggtcaggaactgcagatctcttcccggtttctctggcccagagagcctgaaacatgggtgcaggagggggctgggctgaaggacctggggctgaggaaggggtggggcttttgagggagtggaggtgtccccagggaatggtgttataatgggtcctggagccatggaacagctctgcttgtgggtgaggcttccagactcctagggcatggttctgagtccctgctccaggccccacagtcccctccaggcttaccatgcacgcctgggacccagcactctgtgcaggcactcacatgcgaacagccagccggccccccagcagtccctctgagagcaagcaaaaacaggcagcaagtgatgactggaaaagcaccccataaacagtatgtagatgtagaaggagcagtggtcagtttctgcatgttggtctccgtgcacaagtggctgtgtgcatgtgtgcaggtgtccagagacacacagggtccatttgcacacactggccattgctcagtgaccatgtgcttgtacggtacacactcatgtgcatgaagactgaacgcacaaactgacccagtcacggcggaccggccggagccctccaaatgcatcttgatctagggttcaacctgatgaaaacacaaaaacagggctgggtgtggtggctcacacctgtaatcccagcactttgggaggccaaggttggtgaatcatctgaggtcatctgaggtcaggagttcaagaccagactggccaacatggtgaaaccctgtctctattaaaaatacaaaaattaactgagcggggtggtgcacgcctgtagtcccagctacttgggaggctgagacaggagaatcatttgaaccggggaggtggaggttgcagtgagccgagatggtgccactacactccagcctgggcaagagagtgagactccatctcgaaaaaaacaaaaaccaaaaaacaaaacaataagtttattgaactaaaggataccttcagaaacaaaatgtttaaagcttgtaatagatttaaagcttgaaaatatatcattttcatatctatgaccatcaacgtgatcaaggtggttttttggagaatggagcctctaagagttttttgttgaaagatgggtctgggagcaccctcttctgctttaagcattaaactggacccttcttggccactgcctccagccagccccttgggctggatatccttcctaaggcaggataatgcaaaattcactgtggcctctgttctttaaaaagaatgttaacaaaaaaaaaatttcttaataaaaatacaaagaactttaactcagttgggcatggtggctcatgcccatagagtcccagctgcttttgaggctgaggcaggaagattgcttgagcccaggaatttgagggtacagtgagctattattgcacggctgcactccagcctgggcaacatagctagacccccgtctcttttaaaaaaaaaaaaaatgctgggcggtggctcatgcctataatcccaacactttgggacgccagggcgggtggatcacttgaggctaggagttcgagaccagcctaggcaaaagagtgacaccccatctttactaaaaaaacacaaaaattccccaggcgcatggtggtgcatgcctgtagtcccagctactcgggaggctgaggcaggagaatcgcttgaacctgggaagtagaggttgcagtgaggtgagatcacgccactgcattccagcctgcgtgacagagcgagactcaaaaaaaaaaaaaaaaaaaaaaaaaaagctgtaacctcaaataggtggtttcttttaaccaccaatttgtccaagccacctaggtagaggagtggcgacagttggctctgaatctttggggtacagccagggaagtctttctggatactgtgatgggccaggcctctacatccagccagcactcaggagggagtgagcgcctttcccttcccatgacctccacctgctggggctggtgccctcgaatggacgccccctacccggcccccaccattgtgccctccttaccttccagccagccagccagcccgctgatccctgtctccctctctccccacagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacgtaggcgcctgcccctcctgctggggcgggagggtcgggctggggagggcttggccttttgctgacctctgttctgcagcccaggaagcatttcccttgtccccgagagcatgcctggggcagtcaaggaaggggtcacctggcttagaggaggaggagctccttggccctctgttagaggggcagtgcgccctggtgaccagggagaaccgaagctggtctgagctgacctggctgcatccccccgcacagagcagacctggagagatgggacctccgtgcagaggacgggctttgatttacccatacatgtcttagggtgcagggctcctaggacccgggacctcagaccctgtgccctggggctggcacagacctgaaggcaagctctgcctatccccctgggggcacccatctccaacttagaagctcacctggggaatcagcggcagccccctttctgccagtcctaatgagactttagcaacggtgccaacgagtacttccccagaatgtgggagttcccggagtggggtctggaaggctagagggggtggccctaaagaggtcgctgtcaccaatgtcaattttgctccaaatctagaaattccttaagcatctaccccttcttccttcagctgaacccatcctcccagcccctctgaggaggtcaacacccaggtgggctgtgcccactccaccagggccaggaagggccttttgagtggctctgggtaccacgtcttatgccaggccctatgtgactccatttcaccttaacatccttagattgatactggctccatttcacaggtgagcaaaccaagactttcccaggtccacagcctctcagtggcagagatgttcaaccccattccctgtggggctgacagagagtgcccaagacaacaggaattaattcataggagggatggctagcaacggactcttgcctgtatacaaattgtactcagagattcttgagtttccagttcccccacatacattttttttttttttgagatggagttttgctcttgttgcccaggctggagtgcagtggtgggatctcggctcactgcaacctccgcctcccaggttcaagcaattctcctgtatcagcctcccaagtagctgcaattacaggcatgcaccaccacgcccagctaattcttatatttttagtagaggtggggtttcgccaggtagtccaggctggtctcaaactcctgacttcaggtgatctgcccgcctcggcctcccaaagtgctgggattacaggcgtgaggcaccatccctggccttttttttggttttgtttttgagacagggtcttgttctgtctcccaggctggagtgcagtggcatgatcatggctcactacagtctcaacctcccaggcttgagcgagcctcccacttcagccttccaagtcgccaggaccacaggtgtgccccaccacacctggctaatttttatagtttttgtagagatggggtttcctcatgttgcccaggctggtctcaaactcctgggctcaagctgtctgcccgcctttgcctcccaaagtgctgggattacagggagtaggtactgcacctgaccaccctcatgtatattcaaaccagaatttaggggtgggtgtggtggctcacacctataattccagcatttcgagaggctgaggcaggaggattgcttcaggccaggagtttgagaccagcctggacaacatagttagaccccatctctacaaaaataaaaaattagccgagtacagtggtagtgtacctgtagtccccagctacgctggaggctgaggcaagaggatcacttgagcccaggtgtttgaggctgcagtgagctatgattgcaccactgcactccagcctgagtgacagtgtgaggctgtgactcaagaaaatacacaaaccaaaaaaacccgagaatttagcatgtgggcagtaagttctcaggactaatgaatccagggggctttttttgtctaaaaggaaatctttttgcatcatgccttgaggtcccttgtaatggccttcctgccccttctcccaggaagggattttgttttttagcaagtgctcttccaggatcctgggctgaaagaaaaggaagaaacccaaattagcttacgtgcacatggcctgattagctgttcagggcaggcagaaacagcctgcaactcaggaactgaattccctgagcggggaggtttgaggttgctgtggttccacagagcatgggggacagaggcctgaggatgcctcccccagtccctgcccctcattcacaggtgcccttggaccaagaagtagtagtggccccagaaagcccatctcctggccgggcgcggtggctcacacctgtaatcccagctactcaggaggctgaggcacaaggattacttgaacccgggacgtggaggttgcagtgagccaagatcgtgccactgcactccggcctgggcaacagagggagactccgtctggaaaaaaaaaaaaaagcccatctcttgattttctgtatacactggggcttagtctaaacgcatatgtccccatgttcagaggtttaggcctaagcacaactggacttttggtctcaggtagtaaatatgggaattttaaaaattattttagtggccaggtgctgtggctcacacctgtaatcccagcactttgggatgccaaggcaggtggatcacctgaggtcaggagtttgagaccagcctggccaacatggtgaaaacccgtctctactaaaaatacaaaaaattagccgggcatggtggcgggcgcctgtagtcccagctactcgggaggctgaggcaggagaatcgcttcagagtcctggaggcagaggttgcagtgagccgagatcacgccactgcactccagcctgggcgacggagtgagactccatctcaaaaaataataataaaaaaaccccaaaattagctgggcgtggtggtgggcacctgtaatcccagctactcgctcgggaggccgaggcaggagaatcgcttgaacccgggaggtggaggttgcagtgagctgagattgagccattgcactctagcctggatatcagggcgagactccttctcaaaaaaaaagaaaaagaaaaatttagtgtgagcctcattactgcatcgtatataaattatgatccaaggggcttagttcattacaactaattgagactcaaatgggacttgggatgtatgaacagaagtatgaggggcaggatgatagaggtgactgcctactcagctctgtgcttccctgatctgcagtgccagactctggctggctcggaggacagccagcctgggcaggagactggaaactcctgccaagagtggcagggagcctattggttgtgttttgacttttgtcatagtgatgtgtgccaggctgatttttttttttaataggtcttttcttctttggcctctgggtttattattaaaaagaaatgttggagagaaagaagctagcatttaatgaagtccctccaggaggtggccccaagcacgctgtgcacacactaacccaaagcagccaatatttgtttgatggatgggaaactgaggccagaagtcttgtctctgggagacagagaaacaaattcccaggacaaatttctgtaggcattgcagggaaggagccatctgtttaatataataaacattttcaacaaaggaagggtaggaggtattcatgtataagctgcacaggcggccttcagcagagctgggtgcagaatgggggtcctctgttgtcagggaggtccgactgaggacgtctgcactccctgccaccgcagcaagtccctgagtccgtcactgaggtccccctttgtaggagtagggtgtgcaaactgcaggtgtgcttgctgggctggctggggctggggccaaggggcagaggtgagcatcccccttacaggggctctttttgcagatgattgagtcgaatgacatttcagaggagacgatcaggacgaaggaaactgtggagggtgagtggccaccaggccgggcgggactctgggctctgggaagaggctggctggctctgccttcctgctgggtcacattttggtttgcatcatctgccatttggtaagagtcacctcctgtgtgctgtgagctatgtactcctgcaagggaggaggccagtttacggagggataggcattgcaccagccttccaagttgctgtcttttttttctttttcttttgaaacagatttaacggaatagtaaacttaatggaatatcaaaccttattatttgtttggtttatattttatttttatttatttatttagtttatactttacttttatttatttatttattttagacggagtttcgctctgtcgccaggctggagtacagtggtgtgatctcagctcactgcaacctccaactccctggttcaagcgattctcctgcctcagcctcccgagtagctgggattacaggcatgcaccaccatgcccagctaatttttgtatttttagtagagacggggtttcaccatgttgaccagggtggtctcgatctcctgactgcgtgatccgcccgccttggcctcccgaagtgttgggattacaggcatgagccaccgtgcctagctggtttaaactttaaaaacaggtctaaacttcaaatggttcaaagggcatatggcaaactaactcttcactgttctctattcttccctccctgaaggcgcagtgttagcttctttatatcccctttccagaaatattttgtgcaggtacgagcaagcaagtgacacaaatggtaccatatcttccattctttcagctccttcatttattccatttaacaatgtatcttggagagggttccttatcagtagtacattcttttacagggtacagaatattccattgtgtggaggtaccattgtgtatttagctggtttccgataacaatcacagattgtttccagtcttggtcagttacaaagatggtagactgtttccagtcttggtcaattacaaacaccactgtagaaaattaccttgacttccattgggctcaaccaattttaattcccaccagctgtggttgaaaacctgtttcccctcaaactcccatcaacaaaacgtttgatcagactttgtgatctttgccaatctgaaaggtaaaaggtgtaacttcaactcacctttctcttatgtggatgaagttaagaggtatttctatttgcattttttttttgagacggagtttcacccttgttgcccaggctggagtgcaatgatgcgatctcagttcactgcaacctccgcctcccaggttcaagcaattctcctgcctcagcctcctgagtagctgggattacaggcatgcaccaccacgcctggctaatttttgtatttttttttttagtagagacggggtttctccatgttggggctggtcttttttttttttttttttaagacagagtctcactctgttgcccaggctggagtgcagtggcacgatctcagctcaccacaacctccacctcccaggttcaagcaattctcctgcctcagcctcctgagtagctgggactacacgtgcatgccaccatgccctgctaattttttttttttttttttttttagtagagatggagtttcactatgttggccaggctggtctcaaactcctgacctcatgatcctcccgccttggtctcccaaagtgctgggattacaggcatgagccaccatgcccggcttctatttgcatttctatttgtgtcttttgaccatttttttctgattgggttattgatctttttgctgatttttagaagctctttatgtatgacattgcagacattttccccactttgtcatttgcctttttacttttttcttatggtggtgttggccatgcagatatttaaaaaatcaggccaggtatggtggctcacacttgtaatcccagcactttgggaggctgagttaggagtattgcttgagcccaggagttcaagaccagcctgggcaacatagtgagaccctgtctctacaaaaaatacccccctccaaaaattagccaggtatggtggcatgcagctatagtcccagatacttgggaaggtgaggcgggaggatctcttgagcccaggaagtggaggctgcagtgagctacgatcatgccactgcactccagcctgagcaatagagtgagaccctgtcaccaaaaaaaaaaaaaaaaaaaaatcaattcttttttagtttaaaaaatgtatccagtggtttcttctggtacttttctgtcctattttctatgctgaaatctctgatccatctagaattcatccttatataagtgtgagataaggatccatttttattttttcccaaaggaatacccacttatcccaacactatttttgaaaatggtcattttctccccccaaccctcattgattggaattactaaccttattgtccttaaattcacttatgtaattgactctatttctggacttttgttctattccaatgacttgttattctcttcatgtgccaattctataatgttttaattagtcaagctttgtctatgttgtaatttctggcatggcttgttcttctctgctttatcaaaattctcttggctattgtttaaaaactaagctgaaattaacataaaatagacatgtgcaggtttgttataaaattaacaaatgaaaaaaattaacataacatacaatcagccattttaaagcaaacacttcaatggcatttagcgcagtcaacaatgtagtacacccagcacttctatctggtttccaaaacattctcatgggctggatttggtggcttacacctgtaattccagcactttgggaggcccgggcaggagaattgcttgaagtcaggagttcaagaccagcctggacaacatggcgaaaacccatctctacaaaagaaaagaaaaagaaataaagagaaaacaaacattctcatcatcccaaaaggagaacccatacccactagcagtgcttctccatcctcctctgcccccagcccatcacaaccactaatttactttctatctctgtggatttatctatttggaacatttcatgtcaggagttcgagaccagcctggtcaaaatggtgaaacccagtctctactaaaaatacaaaaattagctgggcgtggtggtgtgcgcctggaatcccagctacgcaggaagatgaggcagagagaatcacttgaacctgggaggcagaggttgcagtgagccaagatcgcgccactgcactcctgcctgggtgacagagtgagactccatctcaaacaacaacaacgacaacaaaacaaaacaaaaaagaacctcattcttttttgtggccaaatgatattccattgtatggacataccgcattttgttgatccattcctcagctgatgggcatttgggttgtttctaccttttggctattgtgaatgatgctgctaagaacatagatatgcatgtacttgttaagtacctgttttcagtgctttggggtatatacctagaagagtagaatgctaggtcatatgattttttttttttttttttttttgagatggagtctcactctgtcacccaggctggagtgcagtggtgcaatcttggctcactgcaacctccgcctcccaggttcaagcgattctcctgcctcagtctcctgagtagttgggattaaaggtgtgcgccatcacgcctggctaatttttgtatttttagtagagacagggtttcgcaatgttggccagactggtcttgaactcctggcctcaatcgatgcacctgcctcggcctcctgaagtgctgggataacaggcgtgagccaccgcgcctggcctcatatggtaattctgtttaaatttttgaggaactgccaaactcttgggtattcttgctcatttttataagtgacttagaatcggcacatctagttccaccaaaattttaaatcaggctgggcgcagtggctcacactgtaatcccaggactttaagaggctgaggcaggaggatcacttgagcctaggagttcaacaccagcctgggaaacatagtgagaccttgtctcttcaaaaaataaacaattaggctaggcgcggtggctcatgcctataatcccaacactttgggaggccgaggtgggtggatcacttgaggtcaaaagttcatgtccagcctggcggacatggtgaaaccctgtctctattaaaaatacaaaaaaaaaaaaaaaaaaaaaagttagccgggtgtggtgatgcatgcctgtaatcgcagctactcaggaggctgaggcaagagaatttcttgaacctgggaggtggaggttgcagtgagctgagatggcgccactgcactccagcctgggtgacagagcgagactctgtctccaaaaatataaaaaataaaaaattagctagatgtggtggcacatgcctgtggtctcagctactcgggaggctgaggaaggaggatgacttgaacccagggggtcgaggctgcagtgagctatgattgcacactccactccagcctgagcaacacaatgataacctgtctcaaaaaaaaaaaaaaaaaaggttaaaatcgtgttggtatttttagtggtattacattccctttataaattaacttgcagaaggtggagatgtttctgggtacttggcatccattctgtcctttatggctgtgaggagcacccaggcttgaatacacatgaccggtgacctaggcactgttagcactgttagcactgttattgttctccctgtttttcacttgaggggactaaggctgtgacaggttacctaagaccacatagtgtcgggtcttcttttttttttttttttttttttgagacagagtttcgctcttgttgcccaggctggagtgcgatggtgcgatctctgctcaccgcaacctctgcctcccaagttcaagcgattctcctgcctcaacctcccaagtagctggaattacaggcatgcaccaccacgcccagctaattttgtatttttagtagagatggggtttctccatgttggtcaggctggtctcgaactcccgacctcaggtgatccacctgccttggcctcccaaaatgctgggattataggcatgagccacctcgcccagcctcttttttttttttttttctttttgagaccgagtctcgctgtgtcgcccaggctggagtgcaatggcgctatcttggcttactgctgcctctgcctcccgggttcaaacgattctcctgcctcagcctcccgagtagctgggattacaggcacctgccactatgcccagctaatttttgtatttttagtagagactcggtttcaccatgtttgtcttgaaccccctgacctcaggtgatccgccggcctcggcctcccaaagtgctgggattacaggcatgagccaccacgcccggccagtgtcaggtcctcttcttcaggaggggttacccagcgagacggctggagtgaggaagaacttggaccctggaggccaagtgtgaccccgtcacagagctcctgtgggagggccatggccctacccactgctgctttggtccaggagcattgatgcttctcgtctctcctctctcccctaggcctgcaggacaagctgaacaagagggacaaagaggtgacagccttgacctcccagaccgagatgctcagggcccaagtaagtggtaagtctccctcccgcagggcagatgcggggggctttcactggggccgtgccattcagctgccaattaagcatggagtgggtcagggcctggcttagggtcccctccccgactctgctttgagaagaaaagggctggctggtcgcggtggctcgcgcctgtaatcccagcactttgggagtccgaggcaggcggatcacctgaggtcaggagttcgagaccagcctggccaacatggtgaaacctcgtctctactaaaaatacaaaaattagccgggcatggtggcatgcacctgtaatcccagctactcgggaggctgaggcaggagaatcgcttgaacctggaaggcagagctgccagtgagccgagatggcgccactgcactccagcctgggtgacagagcgagactccatctcaaaaaaaaaaaaaaaaaaaagggccagggccaggtcacctgcaccagacagacatgtacctggggagcagtgagtggcccacatgtggtccatcctataatgcctccccgccagcttctgtccccagagccagctctgtgttctctgtgtcctgaaattctatccattctatcccaggttccctctttctggtcctgaagactttctggtttctctctctctctctctttttgcttttgtttttgagacagggttgcactctgtcacctaggctggagtgcagtggtgcaatctcagctcactgaaacctccacttcccgggttcaagcgattctcctgcctcagcttcctgagtagctgggattacaggcgcacaccaccacacccggctaatttttgtatttttttagtagagatggggtttcgccatgttggccaggctggtctccaactcctgagctcaggtgatccacctgccttggcctcccaaagtgctgtgattacaggtgtgagccaccacgcccggcccctggccctgcttcttgttcaccagaacaccagtggtggtgggcatgagacagcccccctcctcggaaatggttgccaacctgtcttctgtccatcccccagtacaaggcagaattggccccaaaaaaggtcagtggacctcagactcctccaaggccaaggtgaaggtgaagcttttcctaatccaggcgacagtgtaaacacacgtgtgatatcgctccccacaccaggagcccaagcagctgctgtgcttggcgaggattgatctgtttattgtacctgttctctcaggccccttgccacctggcttgtagggacaactgagaccaatggtgcttttaaaattatgcagtggaggccgtgagcgatgctcatgcctataatctcagcactttgggaggccgaggagggaggtttgcttgaggccaggggttcgagaccagcctatgaaacattgtgaggcctcatttctatgaaacatacaaaaatttggccggggctgggcatggtggctcatgcctgtaatcccagcagtttgggaggccgaagcgggtagatcacctgaggtcaggagtttcagaccagcctggccaacatgatgaaatcccgtctctactaaaaatacaaaaaaattagctgagcgtggtagcgtgcacctgtagtcccagctactcaggaggttgaggcaggagagtcacttgaacccgggaggtagaggttgcaataagtcgagattgtgccatggcactccagcctggcagcggagtgagactctatcacacacacacacaaaaaaacaattagccaggcatggtggtgggcacctgtaatctcagctacttgggaggttgaggcaggagaattgctgcaacctgggaggcggaggttgcagtgagctgagaacatgccattgcactcctgggccgacaatagcaagactccgtctcaaaaaaaaaaaaaaatttggccgggcaccgcggctcacatctgtatcccagcacttttgaagccaagttgggtggattgtttgaggtcaggagttcgagatcagtctggccaacatggtgaaccccatctctactaaatatacagaaattagccaggtgtggtggcacatgcctgtagtcccagctacttgggaggttgaggcagaagaattgcttgaacccaggaagcggaggttgtagtgagccaagatcgtaccactgcactctagcctgggtgacagagtgagactttgtctccaaaaaaaaaaaaccgccaggtatgatggtgcactcctgtagtcccagctactcaggaggctgaggcaggaggattgcttgagctcaggagttggaggctgcaatgagctataattgtgccactgtactccagtctgggtgacagagccagacccaatctctaaaaaaaccgtcaaaactatgcagtggggtatgtcaccttcatcccctgggagaatcagcgccctgcccaggtctttgcccttgggtgggacagaagctcacgtgttcccaatcctcttcctcccttccctgccggctgaccccagcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggtgaggcggccgtggggccggctgggtcctccctgtggccctggcccttgctcctcttcttgacattagctcatgttatcttggggcagagagggggatagagctggtgggccaggtggccgatctcgagcgatcaccctgctctcctctaagctccgataaagtctccaaagcctctacactgttttccaagcagagcttatagaaaagagtagggccaggcacagtggctcatgcctgtaatcccagcactttgggaggctgaggcaggaggattgagcccaggagttcaagaccagcctgggcaacatagtgagacccctatctctaaaaaaaaaaaaaaaaaaaaaaaaattaggctgggtgcagtggctcacacctgtaatcccagcaccttgggaggccgaggcagccggatcacctgaggtcaggggttcaagactatcctggccaaaatggtgaaaccctgtttctactaaaaatacagaaattagctgggtgtagtggtgtgtgcctgtagtcccagctactcaggaggctggggcatgagaattccttgaacccgagaggaggaggctgcagtgagctgagatcatgccactgcactccaacctgggtgaccagagcaagactccatctcaaaaaaataataataataaagttttttttttttcttttaattagccaagcctggtggtatgcaccagtagtcctagctacttgggaggctgaggcaggatgatctcttgagcccaggagttcgaggctgcagtcagctatggcataccactgcactccagccggggcaatagagcaaaaccctgtctctttaaaaaaaaaaaagaaagaaagaaagaaagaaaagagagagagagagaaagaaagaaagaaaaagaaagaaagaagaaagaaagaaagaaagaaagaaagaaagaaagaaagaaagaaagaaagaaagaaagaaaggattaatgcctccccaaaatgtttggtctcagggacccctttaaactcctaaaaattattgaggatccccaaagagcttttgtttgtttattctatatttaccatattagaattaagactgaaaaagtgtaagatacgaatccatcttaaaataagaagccaggccaggcgtggtggctcacacttgtaatcccagcactttagaaggctgaggcaggaggatcacttgagccaaggactttgagaccagcctgggcaacatggcaaaacccctctctaccaaaaacacaaaatttagctgggcatagtagcatacatctgtaatcccagctactcaggaggctgaggtgggaggatcaccttaggtggcaagtcgaggctgcagtgagccaaggtcttgctactgcactgcagcctgggcggtggcagtaagaccctgtctcaaaaaataaaattaataagccaattgcatgtaacataagtagcatgcttttgataaaaagtaactattttctggcggggtggggggggtgggtgggggactgggcggggtggcttctgcctgtaatcccagcactttgggaggtcgaggtgggcagatcacctgaggtcgtgagttcaagaccagcctgtccaacatggcgaaaccctgtctctactaaaaatacaaaacattagccaggcgtgttggcaggcacctgtaatcccagctactcgggaggctgaggcaggagaatctcttgaacccggaaggcggaggttgcagtgagccgagattgcgccactacacaccagcctgggcaacaagagcgaaactccatcaaaaaaaaaagtaactattttccaaaacaaaaaatatttactgggaagagtggcattatttcaaatttttgcaaaatccttgaatattggggcttaataggagaaactagattctggcatctttttccatgttccatctttgcaatttgctcttttggttgaactatgttctaaaaatctgatcttacatagatatgtagttagaaaacaaaggagtatttgaatgtccttttcaaatcatggttagtatttctactagccccagaaaaaacctattgtattctgaagagaagtaatgaaaatagttttgttattattacaaaaatagttttgagccatagatcccttgaaaaggttttaagggacccactgggatttcctcagaacacactttagcatccaatgagctagattcagtcgatagacatggtttgtgtggtccctctgagcctttaagaaattagactaacaattaaaaatcagaagatggggccaggcgcagtgcttcacccctgtaataccagcactctgggaggccacggcaggcagatcacttgagctcaggagcttgagaccagcctggtcaacatggcgaaaccccgtctctactaaaaatacaaaaattagccaggcatggtggcacacacctgtagtcccagctactcaggaggctgaggcaggagagtcacttgaacccgggaggcagaggttgcagtgagtcgagattgtgccactgcactccagcctgggcaatagagtgagactctgtctcaaagaagaagaagaaaaaaaaaggttaattaattaaagaaaataaaaatcaaatgttacagaaaagccagatttctccacattcccttaaaaaatgggaagatctggcatggcatggtggctcacacctgaaatcccagcactttgggaggcggagactggaggatcacttgagctcaggagttcaagaccagcctgggcaacacagcaagaccccatctctacaaaaaaatagaaaaatagctgggcgtggctgggcgcagtggctcacgcctgtaatcccagcactttgggaggccgaggcaggcagatcacgaggtcaggagatcgagaccatcctgcctaacacgatgaaaccctgtctctactaaaaatacaaaaaattagccaggcttggtggtgggcacctgtagtcccagctactggggaggctgaggcaggagaatggcgtgaacctaggaggcggagcttggagtgagccaagatcacgccgctgcactccagcctgggcgacagagtgagactccatctcaaaaaaaaaaaaaagaaaaggaaagaaaagaaaatagctgggcgtggagcacacgcctgtgggtcccagctactcaggaggctgcggtagtaggattacttgggcccaggaagtggagactcagtaagccatgatcataccacagcctgggcgacagagcaagaccctgtctcaaaaaacaataagtaaaaggctgagtgtggtggctgctcacgcctgtaatcccagcactttgggaggccgaggcaggtagatcacctgaggtcaggagttcgagaccagcctggccaagatgatgaaaccccatatctactaaaaatacaaaaattatccaggtatggtgaagcacgcctgtaatcccagctacttcaggcaggagaatcacttgaactaggaggtggaggttgcagtgagccaagatcgtgccattgcactccagcctgggcaacaagagtgaaactctgtctcaaaaataataatagtaataaacacaattttaaaaaataacaaatggcaagacctaacaacacaggacagacttccagcatggcgatcaccccatcatagctggggagcccctgcccccttctgatgggcgtgggccccctgagtctcctggggaggccccactttcccttcattatttttcttactcccaattccccagcccctgtaagcatttgctttttttttttttttttttgagacggagtcttactctgttgcccaggctgcagtacagtggcgcgatctcaggtcactgcaacctccaccttctgggttcaagcgattctcctgcctcagcctcccgagtagctgggattacaggcgcccatcaccatgcccagctaatttttagtagggacagggtttcactgtgttggccaggctggtctccaactcctaacctcaagtgatctgcctgcctctgcctcccaaagtgctgggagtacaggcatgagccaccgcactgggcccagcatttgcatttctttttttttttgagatggagttttgctcttgttgtccaggctggagtgcagtggcacaatctctgctcactgcaacctccacctcctaggttcaagtgattctcctgcctcagccttatgagtagctgggattacaggcatgtgccaccatgcccggctaattttgtatttttagtagagatggggtttctccatgttggtcatgctggtctcgaactcccgacctcaggtgatccacccgcctcagcctcccaaagtgctgggaatacaggtgtgagccactctgccgggcccagcatttgcatttcaacccaagttaaaggaatctctttgaagcacagacatccttttgtaaaagaagaaatgctacctcctttccttctatacagattaagagttgctctagctacatttgctacaaatctaacacctttctagaaactgtagccctgcccaggaaggaaacagatgcgatgaggcaatctaggaattttccagaacaacactgccctctgcagatgcagcctgtgtttttccagtaggaacaaaccagccaggaccctggccagggttccagggctgccctccctcccctgtctcccatcctaagtggaaaagttattattggtgccctgcctggtctcactttctccgaggaagctttccgccctatctcagccgcaggatgcccctccgctgagtctcgatagaacttcctggagttttgggtctttatccattgtctctgaattttccctgtcatctgaagccacatttcctctttcccagagggcctcatccccgtctccctgctgtcaacagctgtcaacagcctccttccatccttcagctctcatcagttatgagattcctcccttctgggataccttctttttcttcttattttttttttttttttttttttgagatggagttttgctcttgttgcccaggctggagtgcagtggcacaatctctgctcaccgcaacctctgcctcctgggttcaagcaattctcctgccccagcttcccaagtagctgggattacaggcatgcgccaccatgccgggctaattttgtatttttagtatagatagggtttctccatgttggtcaggctggtctcaaactcccgacctcaggtgatccacctgcctcggcctcccaaagtgctgggagcacaggcgtgggccaccgccccgggcccagcatttgcatttcaacccgagttaaaggaatctctttgaagcacagacatccttttgtaaaagaagaaatgccatctcctttccttctatacagattaggagttgctctagctacatttgctacaaatctaacacctttctagaaactgtagccctgcccaggagggaaacagatgcgatgaggcaatctaggaattttccagaacaacactgccctctgcagatgcagcctgtgccttttccagtaggaacaaaccagccaggcccctggccagggttccagggctgccctccctcccctgtctcccatcctaagtggaaaagttattcttggtgccctgcctggtctcaccttctccgaggaagctttctgccctgtctcagccacaggatgcccctctgctgagtctcgatagaacttcctggagttttgggtctttatccattgtctctgaattttccctgtcatctgaagccacatttcctctttcccagagcctggcctcatccccgtctccctgctgtcaacagctgtcaacagcctccttccatccttcagttctcatcagttacgagattcctcccttctaggataccttctttttcttcttcttttttttttttctgagacggagttttgctctgtgacccaggctggagtgcagtggcgcaatcttggctcaccgcaacctctgcctcctgggttcaagcaattctcctgccccagcctctcaagtagctgggattacaggcatgcactaccacgcccagctaattttgtatttttagtagagatggggtttcaccatgttgacaggctggtcttgactcatgacctcaagtaatctgcccgccttggcctcccaaagtgctgggattacaggcatgtgctaccacacccagctaatttttgtattttgagtagagatagggttttgctatgttggccaggctggtctcaaactcctgacctcaggtgatctgtcctcctcagcctcccaaagtgctgggattacaggcataagccaccatgcctggccagagataccttctttttggccagtttgctaagtccagttcattcttcagggcttagcacattgtcacctcttccttgaagcctttcttgattgatacaggccaccgtgggctcctccacactcctgcagtgcttaggatggaggtgggagatcagctaggaatgctttggtgacggtgatgtcacatccatcaaacagcagattaaagtagcagagatttccttttcttacataacaagaaatctggaggggctgtgactggcagttggttcaggagcttaagatctcagtgccaacacctttgcagtgctccctgcctcatgattgcaaggtggctgctgaaagtccagccatcacatcatacatcatagcagaaaggaggaggaaagggaagggagctgtgccagcagatttccactgttctctacccgtggccacctagtaagggagttttcccctctgtagtagttgcaggcaagggaaaacgctagggcataggggtgcatgtgctcctgcctatgcccatggcaggcattaccaatcgatcactgcactgtttcctgcagaccccaaatgtggcctcagaaccattatcatcatagtactccaggtagatcctgtcagttgattaagaggtgacatgggagataaaacccatttgacatcaggtatttaaaatgtcttgctggccaggggtggtggctcaaacttgtaatcccagcgttttgggaagccaaggcgggaggatcacttgaggccaggagttcaagatgaccctgggcgacatagcaagaccctgtctctattttttaaaaatagataaaatgtcttgcctcatgagatttcttgggtaaatgttttggggttatgtgtgtgtgtgtgtgtgtgttttaattaaacaaatatattgtcttttctttaaaaattttatttattattattttctttgagacagccttgctctgttgcccaggctggagtgcaatggcacgatcttggctcactgcaacctccaccttccaggtccaagtgattctcctgcctcagctgcccgagtacctgggattacaggcacttaccaccacgactggctaatttttgtatttttagtagagatggggtttcaccatgttggccaggctggtctcaaactcctgacctcaaatgatccgcccacctcggccttctgaagtgctgggattacaggcgtgagccactgtgctttgcactccccccacaacaactttaaaaagtactctaggaaaggtcaagtcctcaggaccatcccagccccaaatcctggcccctcttgggctttggttgaattgtgtctactgtggcccctcgtggcacagatgccatctagtagcccatgtcccccaccagttggtcagcccctggacacttggcaaattgctagagtgtgggagctggaggagccagggctgagtgcagtggttctgtgcccgcctcacccccaggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggtatgtggggtaggggtggcctaggggcaggggcactagtccgggtggggctgggctagccttgctgtcaggccatggagactggagacctcctggaatgaccccagggacagctgagtcatggtgaggatttgaaatcttctaggaccacaggcaggtggagggaccctggctagccgcttttgcagacatcatggctgcctatgtggcagtctgtgtgatacggtgcaaaggaaaacttcctatctgacctgtccagaggcaggatgagccaatacaggtaaagagctccctgttcagaggagtaatcaaccacaagccagttccttgctcagggtcctgcagtggggcttcacacatcagtctcaggaaggagacaagaacttgaaagtctacagcaagcctgggattctgggtggctgagttttttttttttttttttttttttttgagacagagtctcgctctgttgcccaggctggagtgcagtggcgcgatctcagctcactgtaagctctgcctccctggttcacaccattctcctgcctcagcctcccaagtagctgggactacaggcacccgccaccacgcctggctaatttttttgtatttttagtagagacagggtttcaccgtgttaggcaggatggtctcgaactcctgaccttgtgatcctcctgcctcggcctcccaaagtggtgggattacaggtgtcagccactgcgcccggtcgagatttcttttctattatgaataggaacctgacttcactgagtctgcagagacgggttggggtaggcaggtgatgctggtagcatagcacaggaccatccccatcccttggccaggcgcaatggctcacacctgtaatcccagcactttgggaggctgaggcaggcggatcacttgaggtcaagagtacgagaccagcctggccaacatggcgaaaccccatctctgctaaaaatacaaaaattagccgggcatggtggagtgtgcctgtaatcccagctacttgggaggttgaggcaggagaatcacttgaacccaggaggcggaggttggagtgagctgagattgcgccactgcactgcagcctgggcgacagagtgagactttgtctcaaaaaaaaaagaataaagaaaccaccccatccccatcccatcctcctgtgatgagcactcaggacaagcctgagcctggtgaacgtcacgatatggagggcgtggggtccaggaggacaggcccttgcctgggaaagctgtcctgaagccccccaccaccctcctgcccagacattgggctcagccactgtagaggtgatggaaggagagcagggcccagccctgggcaagggggtggttcacaggctggagggagggcctcagcgccaccgaccccctatatccgggagtaggcccttggccctcagggttccgggataaagagcatcactctggccacacacccagactgtggctgtgggggtcactgagtcctgccggccttcaagtcctggcctatctggctagcaggggtttggtggctgcaccctctgtggtccctgtggctcaacagaagataagcccctggggttggcacggactggggagtcttgaatacccccaggggcttccctagagccttgtaggagtgcgcagtgctgagctcagactggtgcccatggggcacagattggtcaagtttacttgggaactggcggcctctgccccagggtagcctcttgtctcatcatctccctgcactgtgtccacgggagaacttgggaagccttggtgtgtgggtagaagcctcttgatttcaggatggaggttctgttgggaggtggtttggagggtcagagcaggcaggactgggcagtttgggcagtgctgaaggatggagtttgtgcaggagcgaggaggctggcgggccttggggcaggtacagctctgggtgccatggtgggggtgactatggagaggaggaacctcataagacagttgggtgggggcagtgtaagaagaagggtgctgggtgcggtggctcatgcctataatcccactgctttgggaggccaagttgggaggatggcttgaggtcaggagttcgagaccagcctggacctcataacaagaccgcatctctacaaaaaaagttaaaaattagccaagtgtggttgcatgccctgcagtatcagctactcgggaggctgaggtgggaggatcacttgagcccaggaattggaggctgtaatgagctgtgattgcaccactgcactccagcctgcacaatagagtgagactcagtctttttttgggggggggggggtggggaccaagtctcactctgtcgcccaggctggagtgcagtggcatgatcttggctcactgcaacctccacctcccgggttcaagcgattctcctgcctaggcctccagagtagctgggactacagatgtgagccaccacaccctgctaatttttgtacttttagtagaaatggggttttaccatgttgaccaggctggtctcgaactcctgacctcaggtgatctgcctgcctcggcctcccaaagtgctgggattacaggcgtgagccaccaggctcggtctctgtctctttttttaattatttttaaaggcaaggctgggcgcagtggctcatgcctgtaatcccagcactttgggaagccgaggcgggtggatcacgaggtcaggagattgagaccatcctggctaacacggtgaaaccacgtctctactaaaaataggaaaaaattagcggggcgtggtggtgggcccctcccagctactcaggaggctgaggcaggagaatggcatgaacccgggaggcggagcttgcagagacccaagatcgcgccactgcactccagcctaggtgatagagcgagactctgtctcaaaaaaaaaaaaaaaaaaaaagtcaagagggatggggtcctgggttccccacttggagaccatggagcacctcacagaggcctgagggacctctgggtgatgcccaggcttggaacccagagacaaagtgaggctggaagactttcctgcctagagttgagacgcccaccaacacacacacgcacactcatgtactcttccactctcctgccacttccaggacaaagagaaatccctgtcggatcagaggcgctactccctcatcgacccgtcctcggcgcccgagcttctgcggctgcagcaccagctgatgagcacggaggacgccctgcgggatgcgctggaccaggctcagcaggtggagaagctgatggaggccatgaggagctgccctgacaaggcccaggtgagccgcggctgacagggcccaccaggaggcaagccacggggcagtgtcctcggagcccccgtctgatgcgggaggcagccttgtctttaaaaccccagtctgaggaggtagggagctcgtcccaggaacctggtctgaagggggaggtagccctgtcccagaaaccctggtttgaagaaggaggcagctctgtcctgggaaccccagtctgaagggggaggcagccctgtctcaggaacccgggtctgaatggggaggtagctctgtcccgggaacccctggtctgaagggggaggcagctctgtcccaggaaccctgatgtgaagggggaggcagctctgtcccagaagcccccggtctgaagggggaggtagctctgtcccgggaaccctagtctgaagggggaggcatttctgtcctaggaaccttgatctgaagggagaggcagctctgtcctgggaaccctagtctgaaagggaaggcatctctgtcccgggaaccttgatctgaagagggaggcagctctgtcccggaaccctggtctgaagggggaggcagctctgtcccgggaaccctggtctgaagggggaggtggcgctgtcccaggaacctccatcagaaatgggaggcagccctggcccaggaaccctgatctaaagcgggaggcagctctgtcctgggaacccagctgaaaggggagggagccctgccctctggaacccccagttcaaggggcacatggctttgccctgaggagcttagactaagaaggaagatgcagccttacccctagaggcttggtctttgggggtgctgggagccccaggctgaaggggttggaatttggagcctgagacggtcccatgggaagacctcgccatctagtgggaaaatcgggaactgctgcctggtgcacctggctcagtgtctcccctaactcttccagaccatcggcaattccggttctgcaaacggcatccaccagcaggacaaagctcagaaacaagaggtgaggggcgcctcgggcctcccaggtccctcccgtgcaggcagacctctctggagaaaatccttgaaacgtcactaagaatacacacaaagatgcattctgcaagaagctttacagtagggtccctcagggagggtgctgttgcaggcaaacttgattccagattcaccctgctctttttgatttgtgttttcttcccttcttaaaaaagttataggttgggcgcagtggcccacgcctgtaaccccagcactttgggaggccaaggcaggaggatcatttgagcccaggagtttgagaccagcctggccaatatggtgaaactccgtctctactgaaaatacaaaattagccgggtagggtggacaatatagcgagaccctctctctattaaaaaaaaaaaattttaaaaaggctgggcacagtggctcatgtctgtaatcccaacactttgggaggccgaggccggtgggtcacttgaggtcaggaatttgagaccagcctggccaatatggtgaaactccatctggcgggcggatcacaaggtcaggagatcaagaccatcctggctaccacggtgaaaccccatctctactaaaaatacaaaaaaaaattagctgggcgtggtggcgggcacctgtagttccagctactctggaggctgaggcaggataatggcatgaacccggaaggcggagcttgcaatgagccgagatcgcgccactggactccagcctgggcgacagagcgagactccatctcaaaaaaaaaaaaaaccaaaaaaaaaaaaaaatacaaaattagctgggtagggtggcgcacacctgtaatcccagctacacgggaagctgaggcaggagaatcgcttgaacctggcaggtggaggttgcagtgagccgagatcgcaccattgcactccagcctgggcaacaagcacaaaactgtctcaaaaaatagtaataaaaattttaaaaattagctaggtgtggtggcgcatgcctgtagcctcagctactcaggaggctaaggcaagaggatcactcaagcccaggagtttgaggctgcagtgagctaggattgcgccactgcactccagccttggtgataaagtgagaccctgtctctaagaagaacacagaaagagagagaacctagttctgactgcagaatccctggagcacagatgctcgctagaaacaggagcagcacagccacagaatctgccaagctccagacacaggcagggttatgtgggcagagccagcctcagaggagttagtgtgattttgtcctcctggccttgttctcctggccaccctgcgagacacatggggtcatcccagttcacagatgtgaaaactgtccaggtgcagtggctcacacctataatcccagcactttaggaggccaaggcaggtggatcacttgaggtcaggagtttgagaccagcctggccaacatagcgaaaccccatctctactaaaaatacaaaaaaaaaaaaatcatctgggtgtggtggcacatgcctgtagtcccagctactcgggaggctgaggcaggagaatcgcttgaacccgggaggcagaggttgcagtgagccaagatcgtgccactgcactctagcctgagcaacagtgagactgtctcaaaaaaaaaaaaaaaaagagagagagatccagccccgtacaggcactgagggctctttgtaaaacctgcttctggctgggcgcagtggctcatgcctgtaatcccagaactttgggaggccgaggtgggtggatcatgaggtcaggagatcaagaccatcctggtcaacatggtgaaaccccatctctactaaaaatacaaaaattagctgggcatggtggcgcatgcctgttatcccagctactcaggaggctgaagcaggagaatcgcttgaaccagggagtcgaaggttgcagtgagctgagatcagaccactgcactccagcctggcgacagagcaagactccgtcttaaa

SEQ ID NO: 17522 - DNA, 61462 bp, Human
  misc_feature (1)...(61462): n = A,T,C or G
atgctcccactctaccttcctgaggctctcaccagaagcagatgctggcaccatgctttctgtacagcctgcagaatcatgaaccaattaaacctcttttctttataaattattcagcctcaagtatttctttatagcaaagcaaaaatggattaacacaacatttatatgaaatatttagaataggcaaatccataggtacagaaagtagattaatggttgcctaatactgggagtggtaatgaagattgattacaaatgggtaagaaagatgtcactgacgtgatgcaaatgttctaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttggcaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatggggcaaagagaagtggatggattttttaaaatattcaggatgtagaagtgacaagattttgtagcagttagatatagggagtggggaaaggtgaggaggcctcaaactgagtatgcttaaagttgaattcctgttgtcctccccgaactggctgtcctgtgctgccaatctcagtgaatggatcagcatcctggcacagagttgacattcattgattgcctttggagtgaatgaacagagtatgattaatagagtgaaaatatagctaaacaaggcagacaccaggtcctgccaaatagccagtacaaaactcaccattaaggttggctcagcagatgtccagcacaattttcttctcacttttcaaaccatttggggaatcatgaggtctttccctcatccagaagaacactcacctacatatcagccactccttccctagaacctacaggtatggagcaggctgggttttttcaagagcctcttatcctgtaaatctttacacagggcaatggcaggtgcatgtacagcccatatgagcatggggaatgcttggtgttatagaaaggggatcacagtggtgcccaactgatggatctatgttcagtttggctccaagcaggaagagactcttcccaccaaagaggtttgttaatcccggggtccccctcccagcccctggaggcatcagatacagctgtcagaaacattgcagacacagagtgatctcacagagacattcagtttgactggttttactgctgttcccagggttgacaagcagaaatacagaactaatcatggttcctgatacagacgccaaaacaaggaagtgatctgttccagtccaagcttccaagaaataaagaactaggtggggcacactaaacaagcccccagactcaaccaccccagtgaacattccctggttgtagagagaagtgaaatttgcaacccagaacagaaatctggctgtgtgagcagtaggattgggggtggaaacatttaatgaagtacaattttttaaccctcttttagacagtatcactggataaacatccttttcaataataaaaatccaagtcatttctggcccttttcctggaagtgctttcaagttacaggaacaccaataagaggcccttttctgggcatggagcccaggtctcaaagggaggctctagaaaacatctggtctgcttgatatatagaaactagcactgcatgtgtgtgtttctgtgcatgtgtttctcctgtgctgactcatggcattgaagcctctctggaaacacccccacccttctagccaggcagtttatacacacccctttggctcctccttgatttaaatgttagatcacgaggaagaaggaaaacgatttcaagagctgcacttaagcatctagaattttctgcgtcacacctcttgagagaagagactggctccaggtctgactcagtccactacaagctagacggtcttcttaaagcaccaacattacttgagtctttggataaaattgagaaaagagtctacaagtattgtggactctacaggaggcaggaggctgacaactggcagtaaagacaaagatgtcaggcctgcggcccggcactcaagtggaccctgagattgagctttttgtaaaggtaagttttccagttataataactgcatgtagaatatattagtttttgacactgaagtccaatgtctttaaaaattctccacatttgggctagagataggaaagaatgttgtgattattttcctactctgagttctagaagaatgcccgggtgtgtgactgttcttagatgacaacaggaaaacagatctcttctgaaaaaggcaaggtgatatggtggaaaagcactagactggtttgtagtgagcgactaaattatattcttaatggcttcctatataaccttagaaaaatccctccttctctccagacttttttttctccatctatacaatgaaggagcatgacaagatgatccttaagggctttccaagtctcaaaatctgtgttttatgagataggttttggaaggcctgactgggtggaggagagggccgagaatgacctgagaactccattcccacacatagcctagacagaactttctaaacttctacaatggacaaacatcacagcagggtcacatggacactgggagaaaaaaaacaggagtctgtgtgcttgttatgtgaggagggggacattttagaatgctctgcttcttctttttggtctgccatggagttgtttttttttttttttaacatgtcaacttttcagaaaagcactttggaaaacccctaaatcaagagaaaggaacatgtgtttccaaattagctcatcaagaaagaaaaatttatatgggttattcccagtagaaattaaacagcttactaaatcctcgcttacattaactgtgtagcttttccctttattttcactgactattggatagtattcaggataataagaacaataacaaactcatattgtgcctggctcttttctaaatactttacatatgttacctaatttagtcctaacaacttaggagataggttgttattaatggtgcttgtatagtactagcatcatcagtagtagtagtgatagtagtagttattactacttcattacaacttttagttattacaatattataatgttgttctcatcatttctagataggtaaactaaggcattaaagtttaagtaacttgcctctaaaactatacagctccctgatggcttacaaagacataaaataagatatacttaccaaatgttaagttaaatacctattggcaaaagtaatgcttttacagccagttagattatttaacagcttgtcacatatatacaccaaggacatcatcaacctgtcttttcaaaattgtaagagaaagacccttgaattcctgcagtgctaggtaatgcaattaagtgtttgctaaactatcgggcataagagcgacttcttctatctctgggttgtagcaaaacatataactgctcagataggatataaatgagctgtaatttcctaactggctttttacatttaccaattccaaatcagaagtaatgtctcttcactgggtaactaaagtgttccctttgtctgaactgttcattcaactcaattagactcctgaaatcaattgttggctttcacctatgtgtttatcttcatagacttttcatatttgggtggtaatctggacaggaaactttagcaagtcacacatggatgagaaaatgttgaattaaataataactttcaaaggaaccaataatttattgagtacttactatatggtaggcactgtgctaagtggtttattaaccctcttttatgaatacagaaattaaagcaaagagcagctaagtaactttgtccaaggtcacatagctagttagtggcagagttagaattctattcctttaaaatagctatgtctaatattattcaattgttttcagttgtgtgaactttttagtaaactagtccagaattttatcaggtggagtgctttagatgtaagcttatctaatgacattgatacaaattacagattttctggaagaacctcaaatatcatctggtccaggtttttgttttattttaagctgtgttccacagatctctagaagtttcgtggaagatactgggaggggaaataggggttgagaaagactaaaagtgctaatgagtaatttttaaaaggcattactacaagagattaagcattctcctgtcacaattaagaatttatactacgatatctatgtgttctgtgtagtcaataaaaacattgtcttttagctctgaatgatttgagcaaggtttctatccaataactaagaacaaagatttcataacacacattttattttctctaagtgtagggatgaaataatcttaatgatttgttgtttgttgttaaatggaatgtttgcattctgtaccaaagactctaaaattaagttttagtatatttgtacataaaattatggaatttaacatttgggccaaaattctgaatgtaatacttttgtcaaaaactttttttaatgtgtgggggaaagaaggaagagatgatactctactctgagtgttcagaccatttcaaagtatcttatagctattataaatacttataaagactgattaatataaaaattcaacaaaactattaaatgagagaaggcagtgtttaagagtatggtgtctggaggatatagtcctggtcctgaatttactgagtgagaagaggatgtatgtcatcaactcttgattagccgactgtacttgagcaagtcagcctctctgagcctcagtttcctcacctgtaaaacaagtgtaataacagagcctacctcatagcatcatcctatttgtaaggattaaataaaacaagtgtataaagcacagtagttggcaatgtagtaaacactttataaatgttaactattgttgccattattatttttcatgtttaaaaacttagatcacaaacacaaagaaaaaaattgttttggtgaatggctgcatcctgtctttgccagctgaagataattaagagatcagtaattcatcaatcaggctagcgaatttatatcctaaaattgtatgtgatggcactttaaatcagcataacataacagaaaaaaaaacccttcagttttcctgtaaaactttactgcatttcccccacacctcagtgttttgattttccttttgccaaaggcgatccacccttcctgctgtatctattatcagactccattcttcttcctgcctcccacccttaatcatgtttccactcactaaacctagttttgattggatccttagtctgacttctattacaaaacaaatgcagctggtaaggttggttgcctcttcccattcctcttcacaccctgccatcataaagatcaacaatatcattttctttgtcacatccactatcagggaaagaaaattttgtcaaaaaattgaaattttgtccagtgtttctggaccttaataattctacgcataatagatcagagcagccgtaagatgaagtaccttttatttccttctataggctactctctctagtctttcctatcataattcttggtgattttaatatctacacagatgattcttccaacactctagcccctcagatccctgactttccctcctccagggatcttagtcctcatcatctctcaggtgcttcttcccatagtcatacgcttacctttgtcattgcaatgtctgcaacctctgcataatatcatttatttgggggtgttttttgttcttctttttgaacttctctattttcataggtacatgtttaactttgacaaaatactttaaaaagcagttgtaccattttacacttcacttcattatgtgagagttccacttgctccactttcctgtcaacacttggtatggtcattctttttcatttcagttattctaatgtgtttatcatggtatctcattgtggttttaatttgcctttcccacatgtctaatgatattgggcatcttttcatgtccttatttatcatctgtatatcttcctttgtaaagttttcaaatctcttccccattttaattgttctttaactttaatttttaatttttgtgagtacatagtaggtatatatatttatgggttgcatggaatattttgatacaggcatgcaacatgtaataatcacatcaggtaaatgggatattcatcccctcaagcatttatcttttgggttacaaacaattcaattatactgttttagttatttttaaatgtacaattaaattatttttcactgcagtcaccttattgtgctagcaaatactaggtgttattcatccttcctagctattttttgtacccattaacactcttcacctccccacacacacagactcactacccttcccagcctctagtagccatcctttactctctctatgagttcaaatgtttttgttcttagctctcacaaataagtgagaacacgtgaagtttgtctttctgtgcctggcttattttatgtaatatatgacgtccagttccatccatgttgttgcaaatgactgaatctcattcttttttatggttgaatagtactctgctgtgtatatgcccacattttctgtatccattcatctgttgatgggatatttaggttgcttccaaatcttggctattgtgaatagtactgcaatgaatgtgggagtgcagagatctctgtgatatgctgatttcctttctttggggtagatacctagcagtgggattgctggaccataaggtagctctattttcatttttttgaggaacctccaaactgttctccatagtggttgtactaatgtttacattcccatcaacagtgtttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacctaataactgagctgagatgatatctcattgtagttttgatttgaatttctctgatgatcaatgacattgagcaccttttcatatggctcttcaccatttgtatatcttcttttgaggaatgtctattcacatcttttgcccatttgtcaaacacagtattagattttttcctatagagttatttgagctccttatatattctggttattaatcccttgtcagataggtggtttgcaaatactttctcccattctgtgggtcgtctttgcacattgttgattcctttgctgtgcagaagcttgttaacttgatgtgatcccattcgtccatttttgctttgcttgcctgtatttatggcatattattcaagaaatctctgcccactccaatgtcttggagagtttccctaatgttttcttttagtagtttcatagtttcaggtcttagatttaagcctttaatccatttgtatttgattttttgtatatggtgagagataggggtctagtttcattcttttgcatatggatatccagttttcccagcacctttccccagtgtatgatcttggcacctttcctgaaaatgagttcattgtaaatgtatagacttatctccaggttctctattcttttccactgatctatgtgtctttttttatgccaggaccatgccattttggttactatagctctgtagtataatttgaagtcaggtattgcttaggagatagctttggctattctgggtctttcctggttccatataaatattaggatttttaaaaatttctgtgaatatatgtctttgtcattttgatagggattgcattaaatctatagattgctttgggtactatggacattttaactatatttattcttccaattcataaatatagaatatctttccatttttgtatgtctttttcaatttcttgtatcaatgttttatagttttcaggtagaaatcttttagtatttttgttaattactatgtactttatttcatttgtagctattgcaaatggaattactttcttgattttttttcacattgttcactgttggcatatagaaatgtcactgatttttgtacgttgattttgtaacctgcaactttactgaatttatcaactttaagagttttcattggagtgtttaggtttttccaaatataagatcatatcatctgcaaacaaggtaatttgacttcctcctttccaatttggaagcctttttatttctttatcttgtctgattgctctggctaggacttccagtactatgttgaataactgtggtgaaagtgggcatccttgttatgttcccaatcttagaggacaggatttcagtttttgtccattcagtataatactagctatgggtttgtcatatatggcttttattctgttgaggtatgttccctctatacccatgtttttgagggttttttgtcataaagggatgtttaatattatcaaatgctttttcagcaacaattaaaatgatcatgaggtttttgttcttcattctgttgatatgatgtatctcattaattgatgtgtgtatgttgaatcattcttgcatcactggaataaattgcacttggtcatgataaatgatcttttgttttgtttttgttttcacttttaagtacaggggtacatgtgcagatttgttatataggtaaacttgtgtcatgggtgtttgttgtacaaattatttcatcacccaggtattaagcctagtacccattagctatttttttttctgagtccatgtattctcatcttttagctgccacttgtaagtgagaatgtgtggtatttggttttctgttgctgcattaatttgctagggataatggcttctagctctgttcatgttcctataaaggacatgatctcattcttttttaaaaaagtgactttattttattttagttacataaattacaaaatatcactaagtgaaaataaaatcaataaaaatcatccatgataccacccactttaacatttatgtgtatagcctcttatgctttatttcctcacatatatagataaatacattcatcaaaaagaggttatttcatatattaagttggtacaaaattaattgcgctttttgccattacttttaatacattgttttgcaaactatttttatttcacaatatattatgaatttatttctataacattaaatatattatctgtatgtatgtgtgtcttggtttcttatgactaaaattttttaaaattaaggcgttgttatgttgagatagttgaagattcacatgcagttttaagaaataatacagagagatgctgtgtgccctttaccaagtttcccttaatgataacatcttgtaaaactatagtatgataagaaaaccaggacattattgacattgatgcagtcagatacagaagattttcatcactacacagatccgtgttgcccttttaaagccacatccacttgtgtctcatccagtccctcaaccattaatctcttttctgctttgataattttatcatgtcaagaatgttacgtaaatggaataaaacagtatatcaccttttgggattgtcttttttttccccactcagcacaattccctggaacttcatccaagttgttgtgtgtatcaacagtttgatcctttttattgctgagtactactccatgatactgatatgccacagtttgtttaattattcagctgttgaaggacattttggttgtcactagttttgggttattacaaacaaggctgtataaatcctcttttacaggtttctttatggacataagttttcatttctctgagataaatgccaaagggtctagttgtttggtcgcgtagcagctgcatgtttagatttggaagaaattgccaaagtgctttccagtgtggtcatactattttacattaaaaccagcaatatttctgtgcattcttaccagcattttgtgttgtcactattattatcttaactattttgaaagctgtgtagtgacattttattgtttaaatttgcatttcccaaaaggctaataaaattgaacattttgtctgcttatttgtcatctgcatgtcctcttcagtgcaatgtctgtccatgtcctttgctaattttcttttttccttttttattttagagtatttagttggcaaataaagattgtatatattcaatgtatacaacacaatgattttgtttctttttaaaaagaattatttatttttcaatgggtttttggggaacaggtgaagtttggttacatgaataagatatatagtagtgatttcagagatattggtgcatccgtcacccaagcagtgtacactgtacccaatgtgtagtcttttatcttcactcccccacccctttctctgagtcttcaaagtccattgtatcattcttatgcctttgcgtcctcatagcttagctcccaattataagtgagaacataccatgtttggctttccattcctgagttacttcacttagaataatagtctccaattccttccaggttgctgcaaatgccattatttagtgcctttttatggctgagtagtattccatggtgtgtgtatgtgtgcatatatatatatatatatatatatatatatatatatatatatatatcacattttcttttttattatactttcagttcttggatgcatgtgcagaacgtgcaggtttgttacataggtatacatgtgccatggtggtttgctgcacccatcaacccgtcatctaggttttgggctccacatgcattaggtaatgctctccctctcatttccccccactccgcaactggctccagtgttccatgtgttctcattgttcagctcccacttatgagtgagaacatgtggtgtttgcttttctgttcctgtgttagtttgctgagaatgatgggttccatctttatccatgtctctgcaaaggacatgaactcattctcttttatggctgcataatattccatggtgtatctgtgccacattttctttgtccactctatcattgatggccctttgggttgattccaagtctttgctcttgtaaatagtgctgcagtaaacatatgtgtgcatgtgcctttatggtagaatgatttataatcctttgggtatatacccagtaatgggattgctgggtcaaatggtatttctgattctagatccttgaggaattttcacactgtcttccacaatgattgaactaattgacattcctactaacagtgtaaaagtgttcctatttctccacatcctctccagcatctgttgtttcctgactttttaatgattgccattttaactgatgtgagatggtatctcattgcggttttgatttgcatttctctaatgatcagtgatgattagcttttattcatatgattgttggccacataaatgtcttcttttgagacgctcatatccttcacccactttttgatggggttgtttggttttttcttgtaaatttatttaagttccttgtagattctggatattagccccttgtcagatggatagattgcaaaaattttctccattctgtaggttgcctgatcactctgatgacagtttcttttgccatgcagaagctctttagtttaattagatcccatttgtcaattttggcttttgttgccattgcttttgttgttttagtcatgaagtctttgcccatgcctatgtcctgaatggtattgcctaggtttttttctagggtttttatggttttaggtcttatgtttaagtttttaatccatcttgagttaatttttgtataaggtgtaaggaaggggtccagattccgttttctgcatatggctagccagttttcccagcaccatttattaaatagggaatctttccccatttcttgtttttgtcaggtttgtcaaagatcagatggttgtagatgtgtggtgttatatctgaggtctctgttatgttccattggtctatatatgtgttttggtactagtaccatgctgttttggttactgtagccttgtagtatagtttgaagtcaggtagcatgatgtctccagctttggttttttgtttgtttgtttgtttttgttttttgtttttgctttggattgttttggctatacaggctctttattggttccatatgaaatttaaagtaggtttttaaaaattattattatactttaagttttagggtacatgtgcacaacgtgcaggtttgttacatattccaattctgtgaagaaaggcaattgtagcttgatgggaatagcattgaatctataaattactttgggcagcatggccattttcatgatattgattattcctatccatgagcatggaatgtttttccatttgttgtgtcctctcttatttccttgagcagtggtttgtagttctcctcaaagaggtccttcacatcccttgtaagttgtatttctaggtattttattctctttgtagcaattgtgaatgggagttcactcatgatttggctctctattttggttgtataggaatgcttgtgatttttgcacattgattttgtgtcctgagactttgctgaagttgcttatcagcttaaggagtttttgggctgagacaatggggttttctaaatatgcaatcatgtcatctgcaaacagatacaatttgacttcctctcttcctatttgtatatgctttatttctttctcttgcctgattgccctggccagaacttccaatgctatgttgaataggagtggtgagagagggcatccttgtcttgtgccagttttcaaagggaatatttccagcttttgcccattcagtatgatattggctatgggtttttcatggatagctcttattattttcagatacattccatcaataactagttgattgagagtttttagcatgaaggtatattgaattttatcgaaggctttttatgcatctattgagacaataatgtggtttttgtcattggttctctttacatgctgtataatgtttattgatttgcatatgttgaaccagccttgtatcccagggatgaagccaacttgatcatggtgaataagctttttgatgtgctgctggattcagtttgccagtattttattgaggattttcacaacaatgtttatcagggatattggcgtgaaattttctttttgtgtgtgtgtctctgacaggttctggtgtcaggatgaaattggcatcataaaatgagttagggaggagtccctctttttctattgtttggaatagtttcagaaggaatggtaccagctcctctttgtacctctggtagaatttggctgtgaatccgtctgatcctgtgcttttttggttggtaaactgttaattgctgcctcaatttcagaacttgttattgttctattcagggattgacttcttcctgtgtccaggaatttatgcatttcttttagtttttctagtttatttgtgtagaggtgtttgcagtattatctgatggtagtttgtatttctgtgggatgagtggtgatatcccctttatcattttttattgtgtctatttgattcctctcagttttcttctttattagtctggctagcagtcaatctattttgttcatcttttcaaagaaccagctcctggatttattgatttttttgaaggatttttcgtgtctctatctccttcacttgtgctctgatcttagttgcttcttgtcttctgctagcttttgaatttgtttgctcttgcttctctagttcttttaattgtgatgttaggctgttgattttaaatctttcccgctttctgatgtgggattttagtgctataaatttccctctaaacactgctttagttatgtcccagagattccggtacattgtgtctttgttctcattagtttcaaagaactttatttctgccttaatgtcgttgtttacccagtagtcattcaggagcagttgttcagtttccatgtagttgtgcggttttgagtgagtttcttaatcctgagttctaatttgattgcactgtggtctgagagactgtttgtcatgatttccattcttttgcatttgctgaggagtgttttacttccaattatgtggtcaattttagaataagtgtgatgtggtgctgagaggaatgtatattctgttgatttggggtggagagttctgtagatgtctattcggtctgcttggtccggagctgagttcaagtcctgaatatccttgttaattttctgtctcgttgatctaatgttgacagtggggtgttaaagtctcccactattattgtgtgggagtctaagtctctttgtaggtctctaagaacttgctttatgaatctggttgctcctgtattgggtgcatatatatttaggatagttagctcttcttgttgcattgattccttgaccattatgtaatacccttctttgtcttttttgatctttgttggtttaaattttgctttatcaggaactaggattgcaacccctgctttttttttctttccatttgcttggtaaatattcctccatccctttattttgagcctatgtgtgtctttgcacatgagatgggtctcctgaatacagcacactgatgggtcttgactctttatccaatttgccggtctgtgtgttttaattggaacatttagcccatttatattcaaggttaatattgttatgtgtgaatttgatcctgtcattatgatgctagttattttgctcattagttgttgcagtttcttcacagtgtcgatggtctttacaatttggtatgtttttgcagttgctggtaccggttttttctttccatgtttagtgcttctttctggagctcttgaaaggcaggcctggtggtgacaaaatctctcagcatttgcttgtctgtaaaggattttatttttccttcgcttatgaagctttgcttgtctggatatgaaattcttggttgaaaattctgtttttaatgaatgttgaatattggcccccactctcttctggcttgtaggctttctgcagagagatctgctattagtctgatgggcttccctttgtgggtaacccgacctttctctctggctgcccttaacattttttccttcatttcaaccttggtgaatctgatgattatgtgtcttggggttgctcttctcgaggagtatctttgtggtgttctctgtatttccagaatttgaatgttggcctgccttgctaggttggggaagttctcctggataatatcctgaagagtgttttccaacttggttccattctccctgtcactttcaggtacaccagtcaaacgtaggtttggtcttttcacatagtcctatatttcttggaggctttgtttgtttcttttcattcttttttctctaatcttgtcttcatggtttatttcattaagttgatcttcaacctctgatatcctttcttccacttgattgatttggctattgatacttgtgtatgcttcacgaagttcttgtgctgtgtttttctgctccattaggtcacttatgttcttctctatactggtttttctagttagcaatttgcctaaccttttttcaaggttcttagcttctttgcattgggttagaacatgctcctttatcttggacgagtttgttattacccactttctgaagcctacttctgtcagtttgtcaaactcgttctccatccagtttatttcccttgctagcgaggagttgtgatactttggaggagaagaggcattctggtttttggaattttcagacgttttgcactggtttttcctcatatttgtggatttgtctacttttggtcttttatgttggtgaccttcggatggtgaccttctgtgtggacatcctttttgttgatgttgatgctattcctttctgtatcttagttttgcttctaacagtcaggaccctctgctgcaggtctgctggagttggctggaggtccactcccgacctatttgcctgggtatcaccagcagaggctgcagaacagcaaagattgccttctgttccttcctctggaagctttgtcccagaggggcacctgccagatgccagctggagctctcttgtatgaggggtctgtcgacccctgcagggaggagtctcccagtcaggaggcacgggggtcagggacccacttgaggaggcagtctgtcccttagcagagcttgagcaccatgctgggagatccactgctctctttagcaccagtaggcaggaacgtctaagtctgctgaagctgcacccacagccaccccttccccctggtgttctgtcgcagggagatgggagttttatctataagccctgactggggctgctgcctttctttcagagatgccctgcccagagggaggaatctagagaggcagtctggctacagcggctttgccgagctgcagtgggctctgcccatttccagctttctggtggctttgtttacactgtgaggggaaaagagcttactcaagcctcagtaatggtggacaccccttcccctaccaatctgaagcatcccaggtcgacttcagactgctgtgctggcagtgagaatttcaagccagtggatcttagcttgctgggctccatgggatgggatccactgagctagaccacttggctccctagcttcagccccctttccaggggagtgaatggttctgtctcactggtgttctaggcaccactggggtatgaaaaaaaaaactcctgcagctagcttggtgtctgcccaaatggccgcccagttttgtgcttgaaacccagggccctggtggagtaggcactggagggaatctcctggtctgctggttgcgaagactgtgggaaaagcatagtatctgggccagagtgcaccattcctcacggcacagtccttcaaggcttcccttggttaggggagggagttccccgaccccttgtgcttcctgagtgaggtgacgccccaccctgctttggctcaccctccttgggctacacccactgtctaaccagtcccaatgagatgagctgggtacctcagttggaaatgcagaaatcacctgccttctgtgttgatctcgctgggagctgcagaccaaagctgttcttatttggccatcttgccagcccccagttatttcttttgctatacagaagctttttcatttaattaattcccatctatttagctttgtttgtattgcatttgcttttgggttcttggtcatgaagtctttgcctaaaccaatgtctagaagagattttccaatgttttcttctagaatttttatggtttcaggtcttagatttaagtctttgattcatcttgaattatttctgtataaggtgagagatgaggatccagtttcattcttctacatgtggcttgccaattatcccgacattatttgttgaatagggtgtcctttccccactttatgtttttgtttgctttgttgaagatcagttggctataagtatttggctatatttctgggttctgtattcagttccattggtctatgtgtccatttttataccagtaccatgctgttttggtgactatagccttatagtctagtttgaagtcgggtaatgagatgcctccagatttgttctttttgcttagtctttcttttgctatgtgggcttttttggtttcatatgaattttagaattgtttttctagttccgtgaagaatgacagtggtattttcatgggaattgcattgaatttgtagattgcttttggcagtatggtcattttcacaatattgattctacccatccatgagcatgggatgtatttccatttgtttgtgtcatctatgatttctttcagcagtgttttgtagttttctttgtagaggtctttcacctccatggttaggtatattcctgagttgttcattttattttattttttgcaactatggtaaaagggattgagttcttattttattctcagcttggtcactattggtatataggagagctactgttttgtgtacattaattttgtatcctgaaactttgctgaatttatttaccagttctaggagctttttggatgagtctttagagttttctaggtatacaaacatatcatcagcaaacaggaacagtttgacttcctctttaccaatttggatgcccttgatttttttctcttttctgattgctctggctgggacttccagtactatcttgaatataagtggtaaaagtgagcatcattgtcttgttccagttctcagggggaatgctttcatcttttccctgttcagtataacgttggctatgggttcgtcatagatggcctttattaccttaaggtatgtttcttctctgccaattttgctgaaggttttaatcataaagagatgctggattttgtcgaatgctttttatgtatctattgagatgatcatgtgatttttgtttttaattatttctatgtggtgtatgacatttgttaacttgcagatgttaaaccatccctgcatccctggtatgaaactcacttgatcatggtggattatctttttgatatgctgttggatttaattagctagcattttgttaaagatttttgcatatatgttcatcatgaatattggtctgtagttttctttttttatgtccttccttggttttggtattagggggatactggcctcctggaatgatttagagataatttcctttttatccaatggaatagtgtcaataggattggtaccaattcttctttgaatgccagatagaatgcagctgtaaatctgtctggtcctggacttttgttgttgttgttggcaatttttaaattatcattttaatcttgctgcttgttattggtgtgttcagagttactataacttcctggtttaatctagaagatctttgtatttccaggaatttatcctcttctctaggctttctagtttatgcatgtaaagatgttcacagaagccttaaataatttttttgtatttctgtcgtatcagtagtaatatctctcatttcatttctaattgagtttatttggatcttctctcttcttggttaatctcactaactgtctatcaattttatttatcttttccaataacaagcttttgtttcacttatcttttgtgtcttgtttgtttgtttcaatttcacttagttctgctctgatctttatttcttttcttctgctgggtttgggtttggattgcttttgtttcttcagttctgtgaggtgtgacctcagattgtgtatttgtgctctttcagactttttgatgtaggcatttaatactatgagctttccttttagcaccactctgatggttaatactgagtgtcaacttgattggattgaaggatgcaaagtattgatcctgggtgtgtctgtgagggtgttcccaaaggagattaacatttgagtcagtgggctgggaaaggcacacccacccttaatctgattgggcagcatcttattagctgccagcatggctagaatataaagtaggcagaaaaatataaaaagatgagactgacttagcctcccagcctacatctttctctcgtgctggatacttcctaccctcaaacattggactccatgttcttcagttttgggacttggcctggttctccttgctcctcagcttacagacagcctattgtgggaccttgtgatcatgttagttaatacttaataaactaataggatatatataatatatatcctgttagttctgtccctctagagaaccctgacaaatacagccacttttgctgtatcccagaggttttgataagttgtgtcactgttatcgttcagttcaaacaatttttgatttccatcttcatttcattttgacccaacaatcattcaggaggttatttaattttcaggtatttgtgtggttttgaggattccttatggagtttatttctaattttattccactgtgttctgagagaatacttgatataattttgattttcttaaatttactgagacttgttttgtgccttatcatgtggtctatcttggagaatgttccatgtgttgataaatagaatgtatattctgcagttgttgggaagaatgttctgtaaatatctgttaagtccatttgttttagggtatagtttaagttgatggtttatttgttgactttcttttttgatgacctgtctagtgctgtcagtagagtcttaaagtcccccactattattgtgttaccatctatctcatttcttaggtctagtagtaattgttctataaattcaggagctctggtgttaggtgcatatatatttaggattgtgatattttcctgttggactagtccttttatcattctttaatgtctctgtttgtcttttttaactgctattgctttaaagtttgttttgtctgatataagaatagctacttctgctcacttttggtgtccatttgcatggaatatctttttcctttaccttaagtttacctgagtccttatgtgttaggtgagtctcctgaagacagcagaaacttgtttggtgaattcttatccattgtagaatggattctatatcttttaagtgaggcatttaggccatttacattcaatgttagtactgagatgtgaggtactattctattcatcatgctatttgttgcctcaataccttggtttttttttcattgtgttattgttatatagatcctgtgagatttgtgctttaagtaggttccattttggtgtatttcaaggatttgtttcaaaatttagagctccttttagcagttcttgtattgccagcttggtagtggcgaattctcccagcatttgtttgtctgtaaaagactgtatcttttcttcatttatgaagcttagtttcactggatacaaaattcttgggtgataattgttttgtttaaggaggctaaaaataggaccccaattccttttagcttgtagggtttctgctgagaaacctgctgttactctgataggttttcctttataggttacctgatgctttttcctcatagctcttaagattattttgtttgtcttgattttagataacctgatgactatgtgcctaggcaattatctttttgtgataaattttccaggtgttctttgagcttattttatttggatgcctagatatctaaaggctggagaagttttccttgattattccctcaaatatggttttcagacttttagatttctcctcttccttgggaacatcaattagtcttaggtttgggtgtttaacatagttccaagctttttggaggctttgttcactttttttgttttttaattatttttttctttgtctttgagggattcagttaatttgaaagccttatcttcaagctctgaagttctttctcctgcttgtttgattctactgctgagactttccagtgcattttgcatttctataagtgtgtccttaatttccagaagttgtggttgttttttatttatgctatctatttcattgaagatttttgctttcatatcattgaagatttttcctttcatatcctgtatcatgtttatgatttctttaagttggagttcacctttctctgatgtctccttgattagcttaataatctaccttctgaattctttttctggcaattcaggtattttatcttggtttggatccattgcttgtgagctggtgtgatcttttgggagtgttaaattaccttgttttgttgtattaccagaattgattttctagttatttctcacttgcttagactatgtcagagggaagatctgggaggggctgttcaaattcttttctcccacggggtggtcccttgattgttgttctcacacttcctctagaattcgggcttcctgagagccgaactgcggtgattgtttttgctcttctaggtctagccacctagcggagctactggcttcaggctggtactggagagtatctgcaaagagtcctgtgatatgacccatcttcatgtcttttggccatggataccagcacctgctctggtagagatagcaggggagtgaagtggattctgtgagagtctttggttgtatttttatttaatgtgctggatttgtattggttggcctccagccaggaggtggtgctttcaagagcacatcagttgtagtagtctagggaggaagcaaactttccctagggtcacctggttaagtattcaggtttctcgggtggtgggcagagccatagagctcccaagagattatgtcccttgtccttgcaaccagggtgggtagagaaagaccaccaagtgggggcagggttaggcatgtctgagctcagactctccttgagtgtagcttgctgtggctgctgtaggggatgggggtgtggttcccaggccaatggagttatgttcccacggggataatagctgcctctgctgagtcatacagatcaccaaggaagtaggggaaagctggcagtcacaggctcatcccgcacccatgcagcctgcagtcctaaaggccagtcttactcccactgtgccccctcaacagcaccgagtctatttctgggaatctggtgatcaaggctgagaacttgccccagaccaccagcctcccagctaaaaagcaaggagactcacagtttttcagcatctcagggagcatgcagcagtgctccagttccttcaaagggtctgtggattatctcagcttccctggaatgttgctgtggtacttcttggagcaaaagatcatgatgtgagcctccacacctctctgtctgtccaagtgggagctgcaagctagtgctgcctcctatctgccatcttaattatcttattcttttttatggctgcatcatattcagttgtgtatatgtaccacattgtctttatccagtctaccattgatgggcatttaggttgattccatgtttttgctattgtgaatagtgctgcagtgagcatgtgtgcatgcatctttatgataaaataatttatatctctttgggtagatacccagtaataggattgctgggtaaaatggtagttctatttttaggtctttaagaaaatgtcacactgctttccacaatagttgaactaatttagactcccacttaacagtgtctgtgttcctttttccctgcaactttgacagtagttttgttttttttttttttttttgccttatttatatagagaggtggcattttgctatgtatcctgggctggtctagaactcctgggctcaagtgatccatcctccctccgtggcatcccaaagtgctaggattgcaggcatgagccatggtgcccagcctatttttgactttttaatcatagccattctgactgcgtgagatggtgtctcattctggttttgatttgaatttctctaattatcaggggtgttgaacttttttttcatacgctcattggccacatgcatgtcttcttttgaaaagtgtctattcatgttatttgcccactttttcataggctttttcttgtaaatttgtttaagtttcttatagatgctggatattaggccttcatcagatgcatatggaaaaacattccatgttcatggataggaaaaataaatatcattaaaatggccatactgcccaaagcaatctatagattcaatgctattcctatcaaactaccaatgacattcttcacagaaccagaaaagactattttaaaattcatatggaatcacaaaaagagcccaaatagtcaaagcaatcctaagcaaaaagaacaaagctggaggaatcaccttacctcactcaaaactatactacagagctatggttaccaaaacagcatggtactggcacagaaacagacacatagaacaatggaacagaatagagagcccaaaaataaggccacacacctacaacaatctgatctttgacaagcctgacaaaaacaagcattggggaaaagactccttattcaataaatggtgctgggataattggctagccctatgcaggaggtttaaaatggacccctttcctacaccatatacaaaaataaactcaagatgggtgaagtactgaaatgcaaaatgcaaaagtgcaaaaaccctggaagaaaacctaggcaataccattctggacataggaacaggcaaagatttcatgatgaagacaccaaaaacaactgcaacaaaaggaaaaattgacaaatggggtctaattaaacttaagagctcctacacagcaaaagaaactatcaacacagtaaacagacaacctacagaatgaatgatcattttaatatgttgttgaattcagtttgctagtattttattgacaatttttgcaacaataatcatatggtttggctgtgtccccacccaaatttcatcttgaattgtagctcccataattccctcatgttgtgggagggacccagtgggagataattgaatcatgggcacagtttcccccatactgttctcatggtagtgaataagtctcacaagatctgatagttttataaggggaaaccgctttcccttggctctcattctcttctcttgtctgctgccatgtgagatgtgcctttcaccttctgccatgattttgaggcctccccagccacaaggaactatgagtccattaaacctctttcttttgtaaattgcccagtgtcgggtatgtctttatcagcagcatgaaaatggactaatacagtaaattggtaccaagaatagggtgctacttaaaagatactcaaaaatgtggaagcaactttggaactgggtaataggcagaggttggaacacatgggagggctcagaagaagacagaaaaatgtgggaaagctaggaacttcctagagacttgttgaatggctttgaccaaaatgctgatgatatggacaataaaatacaggctgaggtggtctcagatggagatgaggaacttgctgggaaccggagcaaaggtgacacttgttatgttttagcaaagagactggcagcattttgtccctgccctagagatttgtggaagtttgaacttgagagagatgatttagggtatctggcagaagaaatttctaagcagcaaagcattcaagaggtgacttgggtactgttaaaagcattcacttttaaaaaggaaacacagcataaaatttcagaaaatttgcagcctgacagtgtgatagaaaagaaaatcccattttctgaggagaaattcaagccagctacagaaatttgcataagtaacaaggagcagaatgttaatcaccaagacaatggggaaaatgtctccagggcatgtcagagacttttgtggcagccccttccaccacaggccctgagacctaagaatgaaaaatgattctgtgggctgggcgcagggtccctctgctgtttgcagtctagggacttggtgccctgcatcccagccactccaggcatgactagaagcggccaaagtatagctcaggctgtggctacagagcatgcaagccccaagctttggcagcttccatgtggtgttgagcctgcagtgcacagaagtcaagaattgaggtttgggaacctgtgcctagatttcagagaatgtatggaaatacctggatgtccaggcagagtttgcttcggggtggggccctcatggagaacctctgctggggcagtatggaagggaaatgtggggttggagcccccacacagagtccccatggggtgctgcctagtgtagctgtgagaagagggccaccatcctccagaccccagaatggtagatccactgacagtttgcaccatgtgcctggaaaagccacagacactcaatgccagcctgtgaaaacaaccaggagagaggctgtaccctgcaaagccacaggggcagagctgcccaaggaaacaaggtgagaaaaatgcaaatgcaagtgtcaggatggaccaagtggccagggcatagccaatccattcagtgatctcactggggaaattggcttcagaaacatacataaacaagccaccttgtggattcctataggttatttctccaggcttcctgacctggcactatatacagtcactataaatgttgatttccattcccaaaataaacaagaagacacctaagctaaaccttataaacccaagacaatgggaacccatctctcaagcatcagcatgacccagatgcaagacatgaagtctaaggagatcattttggagttttaagatctgactgccctgctggattccagacttgcatagggcctgtatcccctttgttttggccaatttctcccatttggaatgactgtgtttacccaatgtctgtacccctccattgtatctaggaaataactaacttgcttttgattttactggttcatagatggaagggacttgcattgtctcagatgagactttggattgtggacttttgagtaaatgctaaaatgagttaagactttgagggactgttgggaaggcataattggttttgaaatgtgaagacatgagatttgggaggggccaggggcagaatgatatggtttggctgtgcccccacccaaatttcatcttgaattgtaacacccataattccctcatgttgtgggagggacccagtgggagataattgaatcatggggacagtttcccccatactgttctcatggtagtaagtctcatgagatctgatggctttataagggcccctttcacttggctctcattctcttctcttgtctgctgccatgtgagatgtgcctttcaccttcttccatgattgtgaggccttcccagccacgtggaactgtgagtccattaaacctctttttatttttattttttttgtaaattgctcagtctcatgtatgtctttatcagcagcatggaaacagactaatacaaatatttatcagtgatattggcctatagttttcttttttgatgtgtctttggttttggtatcatggtaatactggccttgtagaatgatattagaagtattttctccacctataattttcagaatagtttgagtagaattggtgtgagttatttttatttttttatttttgagacaggggctcactcatgttgcccaggctggagtgcagtggcacaatcttagctcccttcaaccttgacttcccaagctcaggtgatcctcctacctcagtctcctgagtagctgggactacaggcacgtgccaccatgcctggataattgtttatatttttagtagagacagagggttttttttacttgtatcttattgtactgtctatgtctcaaaacattgttgtagttattatttttgattggttcatcatttagtctttctacttaagagtagtttacaaaccacagttacagtattataatattctgtgtttttctgtgagttttatgccttctggtgattacttatttgtcattaaccttattttttttctgattgaagtactccctttagcatttcttgtagggtatatctggtgttgataaaaagccctcagctttcatttgtctgggaagatttttatttctccatgtttgaaggatgtttttgctggatatactattctagggtaaaagtgtttttctttcaacaccttcactgtgtcatgccactctctcctgacctgtaagattgccactgaaaagtctgcttccagacgcactgaagtgccattgtatgttattagtttcttttctcttgctgctttaagatcctttctttatccttgacctttgagagttggacgttaaatgccctgagatagtcttttttgggttaaatctacttggtgttctatgacattctcgtacttgcatatcaatgtctttctctaggttttggaagttctctgttgatatcccttgaataaactttctatcctatctctttctctacctcctctttaaggccaataactcttagatttgcccttttgaagctattttgtagatttcataggcatgctttattcttttttatgatttttttcttttttctcgtctgtgtgttttaaaatagcctgccttcaagctcattaattctttcttctgcttgatcaattctactattaaaagactttgatgcatttttcggtatgtcagttacatttttcaactccagaatttccactcgattcttttaagttatttcaatctctttgttaggtttacctgatagaattctctgtgttatctcaatttttttttagtttcctcaaaacagttattttgaatctttgtctgaaatgtcacgtatctctgttgctccaggattggtccctagtgccttatttagttcatttggtgaggtcatgttttcctggatggtcttgattcttatggatgtttatctacatctgggcattaaagagttaggtatttattgtaatcttcacagtctgggcctgtttgtacccatcgttcttgggaaggctttaatttggctttcctgctccacctctcctctcttttgcccaatttattttaagacagagtctcactctgttgcccatgctggagtagagtggcatgatcttggctcactgcaacctctgcctccagggttcaagcaattctcctgcctcagcctgccaagtagctgggattacaggagcccaccaccatgcccagctaatttttagtagagatggggtttcatcatgttgctcaggctggtctcgaacccctgacctcaagtgatctgcctgcctcagcctcccaaagtgctaggattacaggcatgagccaccacacttggcgtctcttgcccatttttaaagttgggtagttagttgttgagttgtgttctttatttgtatttttatatgttatagatacaggacttttttattttcttaataattcttttgaaaagcaggacattttatttttgctctatcccagcttattgaatttttctcttctctccctcctctgaattccagtcacattgaccttctttcagttctttatacatgccatgctcaagcctattgcaagacctttgcacatgttattccctgtttagaatgccctcttcgtgcccattcatctaattaactgttacttatcctttgaacttagtttaaatgctacttcctcagggaaggccttccctgacagaccccatatagatttctcagagtttctctgttatacactcataaaatgcacttcctttcttcaaataatttatctctgtttaaaactgagagttaatttgggggaatatttttattttaatatctggtgtgtatatatatatgtatatgtctggtatatgttacacacataatttgttcagtgaatattcattgggtaagtaaatgagtaagtgaagaaagagggtccaccaataaactcaagtgcatataaaatttcaaagcagaaaaagtgttttccatcagtagaaaaaatgatggctgatatagtttagatatttctccttgcccaaatctcatgttaaattttaattcccaattctggaggtggggcatggtggaaagtgtttggatcatgagggcaaacctctcatggcttagtgctgccctcatgatagtgagtgagttctcatgagatctggttgttgtaaagtgtggcatctcatcccccactctctctctctctctctcactcctgctttcgccatgtgaagtgtctgctcccagttcaatttctgctatgagtaaaatttccctgaggcctccccagaagctgagcagatgctggtgccatgtttgtacagccagcagaactgtgagccaattaaacctcttttcttataaattatccagtctcaagtatttctttagagtaatgcaagagtgacctaatacaatgatgtatcaggctgtgtttgcaatactataaaaaaaatctgagcctgggtaaattataaagaaaaaaagtttaattgactcatagttctgcagatattacaagaagcatggtgctggcatctgattctggtgagggccttaggaagcttacaatcatggtggaaagtgaagagggagcaggtgtctccatgctgaaagtgggaacaagagagcaaggggggaggtgccacatacttttaacaaccagatctcgagggaactaactgagcaggaacaaacttattaacaagatgatggtgctaaaccattaatgagggatccgcccccaggatccaatcacctcctaccaggccccacctccaacattggagattacatttcaacatgagatttggaggggacaaatatccaaaccatatcagatggatttatttaatgaaaggcataagactattaactatttgtaaaaatttaaaaatactaaagaagtcctcatacacttcttacaccaaaacaaaatccaaataaatgaaacaaatgcaaaaattaaaccatgatggtactagaagaaaacgtgatagaaaatccttatggtaaatcaaaatataaaaataaagtaaggaaatatgttttttgtaatcttgatgtatataagcagatcagaaaagccagaccacgtagagaaaaagcatggtagatctcatgtaaatttaaattttacataatccatgtttttaaaattacatgtaacatatatcacaaagagttaatgtctttaaaatacaaataatttttccaaacaataagaaaaagtcattaccttcataaaaaaattaaaaactgtcataaacaaacaattcacaaaataaggaaatggccaatggccatatggaaaggcacctttcagaaaggaaatttggtggagggaggagccaagatggccgaataggaacagctccggtctacagctcccaggatgagcgacgcataagacgggtgatttctgcatttccatctgaggtaccgggttcatctcactatggagtgccagacagtgggcgcatgtcattgggtgcgtgcaccgtgcgcgagccgaagcatggcgaggcattgcctcacttgggaagatcaaggggtcagggagttccctttctgagtcaaagaaaggggtgacagatggcacctggaaaatcggatcactcccacccaaatactgcgcttttccggcgggcttaaaaaacggcgcaccacatatcccgcacctggctcggagggtcccacgcccacggagtctcgctgattgctagcacagcagtctgagatcaaactgcaaggtggcagcgaggctgggggaggggcgcccgccattgcccaggcttgattaggtaaacaaagcagcccagaagctcgaactgggtggagcccaccacagctcaaagaggtctgcctgcctctgtaggctccacctctgggggcagggcatagacaaacaaaaagacagcagtaacctctgccgacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtactccaacagacctgcagctgagggtcctgtctgttagaaggaaaactaacaaacagaaatgacatccacaccaaaaacccatctgtacatcaccatcatcaaagaccaaagtagataaaaccacaaagatggggaaaaaacagaacagaaaaactggaaactctaaaaagcagagcgcctctcctcctccaaaggaacgcagttcctcaccagcaacagaacaaagctggatggagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaaagcgatgaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcgggatattatccaggagaacttccccaatctagcaaggcaggccaacgttcagattcaggaaatacagagaacgccacaaagatactcctcgaaaagagcaactccaagacacataattgtcagattcaccaaagttgaaatgaaggaaaaaatgttaagggcagccagagagaaaggtcgggttaccctcaaagggaagcccatcagactaacagcggatctgtcggcagaaaccctacaagccagaagagagtgggggccaatattcaacattcttaaagaaaagaattttcaacccagaatttcatatccagccaaactaagcttcatgagtgaaggagaaataaaatactttacagacaagcaaatgctgagagattttgtcaccaccaggcctgccttacaagagctcctgaaggaagcactaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacacatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcggctctgcaccaaggggacctaatagacatctacagaactctccaccccaaatcaatagaatatacatttttttcagcaccacaccacacctattccaaaattgaccacatactgggaagtaaagctctcctcagcaaatgcaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggaggtggttttttgaaagggtcaacaaaattgatagaccgctagcaagactaataaagaaaaaaagagagaagaatcaaatagacgcaataaaaaatgataaaggggatatcaccactgattccacagaaatacaaactaccatcagagaatactacaaacacctctacgcaaataaactagaaaatctagacgaaatggataaattcctggacatatacactctcccaagactaaaccaggaagaagttgaatctctgaatagaccaataacaggagctgaaattgtggaaataatcaatagcttaccaaccaaaaagagtccaggaccagatggattcacagccgaattctaccagaggtacaaggaggaactggtaccattccttctgaaactcttccaatcaatagaaaaagagggaatcctccctaactcattttatgaggccagcatcattctgataccaaagccaggcagagacacaacaaaaaaagagaattttagaccaatatccttgatgaacattgatgcaaaaatcctcagtaaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaagtaaataaagggtattcaattaggaaaagaggaagtcaaattgtccctgtgtgcagacgacatgattgtagatctagaaaaccccattgtctcagcccaaaatctccttaagctgataagcaacttcagcaaagtctcgggatacaaaatcaatgtgcaaaaatcacaggcattcttatacaccaacaacagacaaacagagagccaaatcatgagtgaactcccattcacaattacttcaaagagaatgaaatacctaggaatccaacttacaagggatgtgaaggacctcttcaaggagaactacaaaccactgctcaaggaaataaaagaggttacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcacaaagtcaatcctaagccaaaagaacaaagctggaggcatcacactacctgacttcaaactatactacaaggctacagtaaccaaaacagcatggtactggtaccaaaacagagatatagatcaatggaacagaacacagccctcagaaataacgctgcatatctacaactatctgatctttgacaaacctgagaaaaacaagcaatggggaaaggattccctatttattaaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcgtgtctaaaacaccaaaagcaatggcaacaaaagacaaaattgacaaatgggatctaattcaactaaagagcttctgcacagcaaaagaaactaccatcagagtcaacaggcaacctacaaaatgggagaaaattttcgcaacctactcatctgacaaagggctaatatccagaatctacaatgaactcaaacaaatttacaagaggaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcactccagttagaatggcaatcattaaaaagtcaggaaacaacaggtgctggagaggatgtagagaaataggaacacttttacactgttggtgggactgtaaactagttcaaccattgtggaagtcagtgtggcgattcctcagggatctagaactggaaataccatttgacccagccatcccattactgggtatatacccaaagaactataaatcatgctgctataaagacacatgcacacgtatgtttattgcggcattattcacaatagcaaagacttggaaccaacccaaatgtccaacaatgatagactggattcagaaaatgtggcatatatacaccatggaatactatgcagccatagaaaatgaggagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggataacatcaggagatatacctaatgctagatgacgagttagtgggtgcagcgcaccagcatggcacatgtatacatatgtaactaacctgcacaatgtgcacatgtaccctaaaacttaaagtataataataaaaaaaaaagaaaggaaatttggtaagatctatcaaaatgggaaatgtgcatacattttactgaccattttcattttaaagattaaccttaaagatataatctcagaagtggaagaagctatatgcccagaaatgtttgtttctgaagtgcttagagtagtaataattttggaatatcttaaatgtctatcaataggaaaattatataaattctgataatatataaaatttattattattattatgtacccatcacagttgtaactttacatataatgagattatttgcttccctatatctctctgtccatagatgatggagtacatgagattaagaatgtccatgtttgtctctagcaactggctcatttcctattaggaactaaatacatacttattgaacaaacaaatgaactgaggtctctctttatcttaataggctggaagtgatggagagagtattggaaactgtcccttttgccaacgccttttcatgatcctctggcttaaaggagttaaatttaatgtgacaactgttgacatgaccaggtaagagaaatcaggacatgttaaattctaggaattgagattggtagataccaataaaatattggtgtttatttaatgtgtactttatctagagacctaactctgcttatttttaataatcatagaaagcctgaagaactaaaggacttagccccaggtaccaatcctccgttcctggtgtataacaaggagttgaaaacagacttcattaaaattgaggagtttttagaacaaaccctggctcctccaaggtacagcatttacaagatactattttgctgaagataatctattttactggcttgtttattgcagatttagtattcttaccaatttaagtacttttggatttctgggcctacatgtcaaatgacacacatgcataaacatacccctccaacttcaaatacaaaaagatgatatgtgtaatatttcaaataatttttaaaagctgcataacatacataacacaagaaggtaagttctctgtgctctagaaatagagtaggaacatatagtgagatgggagtgagggaatgggatactaacactatgtaattcataaggattggtcatgactggtccttaacaccactgacgaaatgacagaacatacccaacacgagggctagtggccaggacatagacttcaagcagttaaccagaggccagaactgtactgcctacacttgaatgacaaccgcacatctctgtctacccaggataggtctagaaacaagaagcatgctgtattaattttctattgctgtgtaacaaattaccacaaacttagtatcttaaaacaacagctatttattatctcacagcttccattggtcagttgtctgggcatagcctgctaaggtcctctgctcagggtatcaaaaagtggcattcaaggtgttggtcgggaacacagttatcatatggggcccaggtgactcttccatcttcattcaagtttttggcagaattcagttccttgcagctatatgactgaggtcttaggttattgggtagctgtttgttggggttgggttggcattcaattactagaggctgcccctctgtataggcatttcgcaacatggctgattgttctcttcctctaaaacctgcaggagaatgtctctctgatggttcaccttcttttttttttttttttttttttttttgagaccggagtctcgctctgtcccccaggctggagggcagtggcacatgttggctcactgcaagctccccctttcgggtctcgggttcacgccattctcctgcctcaacctcccgagtagctgggactacagatgcccgccaccacgcccgggtaattttttttttttttttttggaattttaataaaaatgagggttcacccggttaaccaggatgggctcaatctcctgaccttgtgatccacccgcctcggcctcccaaagggctgggattacaggcgtgagccactgcgcccggcctgatgggtccctttcttttaaatttttttatcagcacaaattatgggatacctatgaaattctattatgtgtttgtaatgcatagtgataaagtcaaggtatctacggtgtccataacccaaatacaatacatttttgtaactatagtcaccctgctcttctatcaaacattgaatttattccttctatcttatttatgtgtgtactttttaacacacttctcttcatcttcccttctcctcccaatcaccctccccagtctctgttatctctctttccattctctatcttcatgtgatcaacttttttaactcccacatataagtgagaacatgctatttttgtctttttgtgcctggcttatttcacttgacataacaactccagttccatccatgttgttccaaatgacaggatttcattctcttttatggctgaatactatttcattgtgtatgtataccacactttctttatccatttatctgttgatggacacttagatcgattccataccttgtctattgtgaataatgcaataataaacatgagagtgcaggtatccctttgacatactgatttctcgtgctttggataaatgccaattagtgagatttttggatcttatggtagtgctacttttggttttttcagaaattctccatgcgttttccatagtggctatatttatactgnnnnnnnnnnnnnnnnnnnnagtgtatagagttcctttttgctccacatgccttgccaacgtgctgttgaatttttttttgtctttttaataatagcaattctgactgaggtgagatgatatctcattttggttttggtttgcatttctctgttgattagtaaagttgagcatttctttatgtacattttggccatgccctttgcccatattttatgagattttttttattgttgagttgtttgatttccttgtatattctggatattagtcccctgttgaagtttgcaaacatttcctctcattcaaaaggttgtctcttcactcatttcttttgctgtgcagaagctttttagtttacttgagtcctatttgtctatttttgtttctattgcctgtgcttttgacatctcaatcataaattatttgtctagaacaatgtccagaagaattttccctaggttttctcttattatttttatagttttgagtattatgtttaagtcttcagtccattttgagttgatttttgtatacagtgagagataaggatcaagtttcattcttctgcatatggctgtccaattttcccagtaccattaattgaaaaaggtgtcctttccccaatgttcttgtgaactttgtcaaagatcagctggcagtaaatatgtgaatttatttctaggttctctattctgaccattgctctgtgtgtctatttttataccataacatgctattttggttactatagccttgtaatatatttcaaagtcaggtaatgtgatgcctctagctttgttctttttgctcagaattgctttggctatatggaatcttttttggttacatgtgaattttagtattctttttttgtaattctgtgaaaaatgacattggtattttgacagggattgcattgaatctgtaggttactttgggaaaatcacaattttaataatattcattcttctgatccatgagcatgagatgttttcccatatatttttatcattttcaattcctttcattagcattttgtagttttcattgtaaagatcttccacctccttgattaaaattattcctagatattttaatttttagctattgtaaatggaattgccatcttcatttcttttgtgggtagatcattattggtgtatagaaatgctacatattttttagtgttgatgtttttaacctggaactttactgaatttacttatcaaatctaagaattttttggtggagtttttaggttttactagatacaagatcatggcaccagtaaaaagggacaattttacttcctttttcccaatttggatgccttttatttctttctcttgcctgattgccatacctaggacttccaatactatgttgaataggagtggtgaaagtgggcattcttgttttttttccatttcttggaggaaaggctttcaatttttccctattcagcatgatatcagctgtgggtttatcatatatagcctttattattttgacatattttccttctatgccccatttgttgagaggttttatcatgaaggggtgttgaattttatcaaatgctttttctgtatctattgagatgatgatatgttttttgtcctttattctatggatgtcatatattgaggttattgatttgcacatgttgaaccattcttgtatcactggtataaatcccacttgatcatggtgtattatctttctgatatgctattggattcagtttgctagtattttgtcaagagtttttgtatctatgttcatcagaaatattggcctgtagttttcttctatgtgtgtgttcttgtctggtttttgtatcagggtggtgctggcctcatagaatgagttaaggagagttctctcctcttccattttttagaatagtttcaggagaattggtattagttcttctggtagaatttgtcagtgaatttgtccagtcctgtgcttttcttcattgggagacttttttattactgactcaatcttgctactcattattggtctgttcatgttttctatttcttcccaattcagtctcagcacattgtatgtttcctggaacttatccatttcctctaggtttatcagtttgtcagcatacagttgtacataatggtctctggtaatcttttgtatttcttacatatatgacttaatgtgtcctttttcatttctaatttgtttgtttgggtcttctacttttttggttagtctagctggcagtttatcaatttaacaaaaaccaactttttcaatcatgatgctttgtattttttagtctgtatttcatttagttctgttctttattacttcctttttctgctaatttggtatttggtttgttcttgcttttctagcagcttcacatacattattagattgttaatttgtcattttcctacttttttcatgtaggcatttattgctataagcttgcctcttagtgctgcttttgctgtatcccacaggtttatgtatgttatgtttcaattttcatttgtttcaagaattttttttcttcttaaattctttattgaccattggttgttcaggagcatgttggttaatttttatgtatttatgcagtttctaaagttcctcttggtgtttatttatagttgatttgatttcattgtggcctgagaatatccttggtatgattttcattgtgttaaatttattgagacattttgtggcctgacatatggtccatcctggagaatattccatgtgctgatgaatgtatattctgtagttgttggatagaatgttctgtaaatgtctgtttggttcatttggtctaaagtccagtttaagtctaatgtttatttgttgattttctgtctagattatctatctaatgttgacagtgggatgttaaagttccttcctattattgcactgcagtctgtctctacctttagatctagtaatgtttgctttatgaatctggatgctccagtattgggtgcatatatatttaggattgttatatcttttttgctgggttgatctgtcattatataatgatagttttagtccttttttcactttttttgatttaatgtctgttttgtcttatatgattatagctaatcctgctcacttttggtttccgtttgtgtgaaatatctttatcaacccatttcagtctatatgtgtctttactagtgaggtgagtctcttgtaagtactatgtagttggattatgttttttaagtctattcatccagtgtatgtcttttaagtggaatatttaatctgtttatgtttacatgtgaagacttatttctgtcattttgttatttttttctggttgttttgtatattctttgttttttttctctctctcttgtcatttatcattacagtttggtggttttgtgtagtggtaatatttgagtcctttattttctttatatccaggcaagaaggatggccactattctcacactgggagcagtgtataagtgattcagcctttcctttcttgttggactccttacccttcagacaaattccacatatagcatttggaatgactttgggcttgtacccaggaactgagttggacagtacagaacgtttgggagcatcttttcttggagtggcagctttgtcttttgatttctgtcttccctggaaagagtcctcctggctgtcaggagagctttccccttcagataccttgccagaggagctgtccgaagtgcctttatttttccgcttctcatcacctcaaccatcttcgccgtcatctgaatcaccgtcactgtctagagcagggagctcaggatccagagtggcctcgtacagggctgtgtttaatggcagataccacagctcatctggtgagtacctcttataatattcctggaactgtccggggatgagagccactgggtaagaactgacctttgttcgccctgttggcaaaacttcctacttcccttgaggcacctggataacgtgtctgcaagtcaaaataagctcttctttcttccatgcgttcccggtttaagttgctgctttttttggcagcttttttatttgtttgtttgtttgtttgtttgtttgtttgtttgttttgagacggagtctcgctctgtcgcccaggctggagtgcagtggcgcgatcttggctcactgcaagctctgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgtctcggcctcccaaagtgctgggattacaggcagctttcttaatatactcaggcactttactggcttcaactttctgagtattctgttgttacatttgggaatactctttgtaatggtctgtaattcgttgacgttctttttcttgtagaataacagaatactcagcatgtttggctggatattcctttatcgttaaaacaatcacttcatcactgcccagttaaacctagagtgcattgagtttcagtaatgacatttggctctctcaggtagagtttctccttgtgagacaaatctcgtctctctaaatctggatatttccttttaaaggaggtcacacccaaatattaactgacttgttcttgaagcatatagtattctcctgtttcatcaggtggccatttgtactctatcaaattttatgctggatagtaactaaagccaagatcttgacttgaagtttcacagctcctagaaccatctcctgagcccattcgcctctttttggatgcctgggtccggtcatttgaattatcttcaatttcatccttcgaggactgcgctccgggggtggctgggtcgctgtcgcatggccgcggggctgcgggcgggaatggagaaggtcctgcggcggcggcagcgctcctgacatccgtccgaccccatttttttaaatatctgttttattcagcatactctttcccaacatatctgtaatactaggcattagcactctttttacatctgtgccaatataacaggtgtagtgacatctcattgatacttaacttgtatttccttgaatgatagatacatttaagcatctttacctatgttgtttgatcatttggttttgttctcctgtgaatcatcttgtcaaatccgtctgattttctattagcttcatactgaataggcaaaagctggaagcattccactttaaaagaggcacaggacaaggatgcccttcttaccactcttatttaaaatagtattggaagttctagccagagcagtgaggcaagagaaagaaataaagggcatctaaataggaacatagaaagtcaaactatccctgtttgcagacgacatgattccatatctagaaaaccccatactcggctgcactcagcatcggagccaggagctagtggccgccgccacgtcccaccagacctgcatccaagcaagtgaagatgttaaagagatcttgccagagccagaaatggaaagtacagacctctgaaaatatctattgaaaatgggcaacttatgattggatcatatatagtcagccttcagattcctgggataacgattatgattcctttgttttacccctgttggaggacaaacaactgtgctatatattattcaggttagattctcagaatgcccagggatatgaatggatattcattgcatggtttccagatcattctcatgtccgtcaaaaaaggttatatgcagcaacaagagcaactctggaaaaggaatctggaggtggccacgttaaagatgaagtatttggaacagtaaaggaagatgtatcattacatggatataaaaaatgtttgctctcacaatcttcccctgccccactgactgcagctgaggaagaattatgacattaaaatcaatgaggtacagactgacgtgggtgtggacgctaagcatcaaacactacaaggagtagcatttcctatttctcgagaagcttttcaggctttggaaaaaataaataacagctgaactatgtgcagttggaaataaacataaaaaatgaaattataattttggccaacacaacaaatacagaactaaaagatttgccaaagaggattcccaaggattcagctcgttaccatttctttctgtataaacattcccatgaaggagactatttagagtccatagtttttatctattcaatgcccagatacacatgcagtataagagaacggatgctgtattctagctgcaagagccctctgctagaaattgtagaaagacaactatggatgttgtaatggatgtaattagaaagattgagatagacaatgaggattagttgacttcagacttcctttgtgaagaagaagtacatcccaagcagcatgcaggaaaaagaagaattcgaagactaattaggggcccagcggaaaatgaagctactactgattcaagtcatcacattaaacatagcaatactagttttttaaaagtccagctttcaatacaggagaactgaaatcattccatgttgatataaagtagggaaaaaattgtactttttggaaaatagcacttgtcacttctatgtactttttaaattaatgttacataagagtcatgatttctatttttgacttaaagctagaaaagagttcaacataatgtttaattttgtcacactgtttttatagtgttgattctacactttcacatacttgttaaaattttatacaattgagccagttctagaaagtctgatgtctcgaaggataaacttactactttcttgtaggacagaaagaccttaaaatattcttatcacttaatgaatatgttaaagaccaggctagagtattttctaagctggaaacttagtgtgcctcggaaaaggccagaagttgcttattctgagtagctgtgctaactctgtcagactataggatcatctctgcaacttttagaaatagtgctttatattgcagcagtcttttatatttgacttttttttaaacagcattaaaattgcagatcagctcactctgaaactttaagggtaccagatattttctatactgcaggatttctgatgacattgaaagactttaaacagccttagtaaattatctaaggctctgtgaagccaaacatttatgttcagattgaaatttaaattaatatcattcaaaaggaaataaaaaatgttgaaagagttttaaaaatcaggattgacttttttctccaaaaccatacatttataggcaaattgtgttctttgtcacttctgaacaaatattcagatttaaaattactttaaagtcctagtatttaacaggctaacacagataaacaccttaataatctcctttcaattaatattgtatttcaaaccacatttaactgtcttctaatgctttgcattttcagttacaacctagagagattttgagcctcatatttctttgatacttgaaatagaggaagctagaatacttcatgtttagtctgttaaacctgctacaaaaaccataactttgaggcattttctaaatgagctgtggggatccaggatttgtaatttattgatctaaactttatgctgcgtaaatcagttatcagaaatgcacatttcatagggtgaaacactcattttttttttttttgagacggagttttgctcttgttgcccaggctggagagcaatcgcacgatctccgctcactgcaacctctgcctccagggttcaagtgattctcatgcctcagcctcccaagtagctggtattacaggcatgtgccaccatgcctggctaattttgtatttttagtagagacggggtttctccatgttggtcaggctggttgtgaactcccgacctcaggtgacccgcccgccttgccctcccaaagtgctgggattacaggtgtgagccactgcgcccggccaaagcacttatttctaaaccttattatctaaggtaatatatgtacctttcagaaatttgtgttcaagtaagtaaagcatattagaataattatgggttgacagattttttatatagaatttagagtatttgtgtggggttttgtttgtttacaaataatcagactatagtatttaaacatgcaaaataattgacaataatgttgcacttgtttattaaagatataagttgttccatgggagcacacatggacagacatacatacacccaaactattgcattaagaatcctggagctgtgttgcagaccatagctgaagcagttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaacctatgattgctgaaaatcagtgatgcatttgttatagagcataactcatcatttacagtatgttttaggtggcattatcatacctagacaatgaataacatattcccaataaatttatatagcagtgaagaattacatgccttctggtggacattttataagtgcattttatatcacaataaaaaatttttctcaaagaaaaccccatactctcaacccaataggtccttcagctgataaacaactttggcaaagtttcaggatgcaaaatcaatgtacaaaaatcacttgcatttctatacatcaacatcagccaagctgagagcccaattgggaaggcaatcccattcacaattgccacacacaaaaaaataaaatacctgggaatacagctaactcaggaggtgaaggatatctacaatgagaattacaaaacactgctcaaagaaataagagaagacacaaacaaatggaaaaatatcccatgctcatggataggaagaatcaatatcaacaaaatgaccatactgcccaaagcaatctaaagattcagtgttatttctaacaaactaacaatgacattcttcacagaactagaaaaaactattttaaaattcttatgaaaccaaaaaagagcccgaatagccaaggcaattctaagcaaaaataacaaagctggaagtatcgcattagccaacttcgaactatactgcaaggctacagtaagcaaaacacagcatggtactgatacaacacctgtaatccctgcacttttggaggccgaggcaggtggatcacctgaggtcagctgttccagatcagcctggccaacatggtgaaaccccatctctactaaaaatacaaaagttagccaggcttggtgacacacgcctgtaatcccacctactcaggagaccaaggcaggagaattgcttgaacctgagagatggaggttgcagtgagccaagatcacgtcattgcactccagcctgggcaacagagtgaaactctgtctcaaaagaaaaaaagaaagaaagaaagaaaaaaacaggcacatagaccaatgggacataatagagagcccagtaataaggccgcacacctacaaccatgtgatttttgacaaagctgacaaaagcaatggggaaagcactccctgttcaataaatggtgctgggctggctagccctatgcagacgattgaagctggacccgttccttataccatatacaaaaatcaagatggattaaagacttaagtgtaaaacccaaaactacaaaaacccagaagacaacctaggcaatgccatcctagacataggaacaggcaaagatttcatgacaaagatgtcaaaagcaattgcaacaaaagcaaaaattgacaaatgggatttaattaaatgaaagagcttctacacagcaaaagaaacaatcaacagagtaaacagacaacctacagaatggaagaaaatttttacaaactatgcatctaacaaaggtctaatatccagtgtctataaggagcttaaataaatttacaagaaaaaaatcgcattcaaatgtgggcaaaggacatgaacagatgaacagacatacatggggcaaattagcatatgaaaaaagctcattagtgatcattggagaaatgcaaatcaaaaccacaatgatataccatctcacacaagtcagaatggctaaaaataaaaataaaaagtcaagaaatagcagatgctggcaaggttgtggagaaaagcaaacacttatacactgtcagtgggagtgtaaactagtgcaaccattgtggaagatagtgtagtgattcttcaaagagctaacagcagaactaccatttgacccagcaatcccattactggatatatacccagaggaatataaatcattctaccataaagacacgtgcatgagaatgttcattgcagcactattcacaatgacaaagacatggaatcaacccaaatgcccatcaatgacagactgaataaagaaaaggtggtacatatataccatggaatagtatgtagccatagaaaagaatgagatcgtgtcttttgcaggaacatggatggagctacaggctattattcttagcaaactaacacaggaacagaaatccaatactacatgttcgcatatataagcgggagctaaatgatgagaactcatgaacacaaagaagggaacaatacacactggggtgttcttgagggtggagggttggaggagggaaaggagcagaaaagataacaactgggtactgagcttaataccttggtgatgaaataatctgtacagcaaattcccatgacatgagttcacctatgtaacaaaccttcacatgtatccgaaactaaaataaatttttttaatgaaataaatatggtttttggggggcctcctctttcggctttggagcccccctccctctgtctcggtatgggggagtttcttccttctgtcttctcccttccttcttgcctattaaactctccgctccttaaaaccaaaataaaaaaaaaagaaagaaagaaatatggtttttatttttctcacataagaaactcagaatgaacctaggatgatagctccgtaatttcattagggatttcaactcctaatctttcttctctgccatccttcaagtgaggcttccagtctcaaagttaactcatggtgacaatatgtctgctggaactccaggcaacagatctaatatacaagtcagctctaaggagttttcacagaagccacacccaaaaatttccatttacagctcattgtccagaggtaattcatgtggttagatctaagtagtggtatataagtgtgttatctgccatagtttgcccctctgaccacccaaataaatgtatgtatccctcttctcacatatggaacacacagttactacagtcggcttaaagtccagtacctttggatgatgtgcaatatctccattagatactaatggtcaagcagtcaaatatattaaaaattatctccacccactctttgacacacccatttttaaaagtgaagattcgataacacacaacaaccactggttcatactagttcataatagttaccatgacttgaaaaaggactgaaatattgtttctacgttttattgttacaaacactgctaaaaggaattgtctttttacaaggccctccacaacggttagtcttccatattgctggatatgggaacccttccatatgaactttgttttatctactttttaaaagccttgtaaacacccacattaatggaaatggtggagtagggaattccagaactccattctttcataaaagcaatgaataggctggcaaaactgtcagaagcaactttttcagaactctggaatctaagcaaaaattacagcagccaggagaacacttaatgaataaaaaatttaaatttcagtgagagttctgtggcatttttggttaccttgagaccatcctccaaccctcagcccatcaatagtcttaaaaatggcagcttatattgcaggtgcaggttactggtaccagaggaagcgatattgaccttattttcaatgaactgtgattgtgtagtttgatctatctggtggttccctgaaggattacctcaatggtttacctttttatcacctgcactagagcttccccagggctgaggcaccttccctggtgctggttgtggaaagaattttaaagcaaatgtattagtcacagctacacagaacaaggaataacatctgggaaaagcaatagacaaatggaaaaatcccaggaagggccaggcgcggtggctcatgcctgtaatcccagcagtttgggaggccgaggcgggcaggtcacctgaagtcaggagttcgagaccagcctgaccaacatggagaaaccccatctctactaaaaacacaaaattagccaggcgtggtggtgcatgcctgtaatcccagctactcgggaggctgaggcaggagaatcgcttgaacctgggaggcagaggttgtggtgagccgagattgcgccattgcactctagcctgggcatggacaacaagagcaaaactccatctcaaaaaaaaaaaaaaaaaatcccagggagaaagaggctgagatacttgggggatgcttagggaaataatggcttcaaaacattttatgtattctgaggactatagaagactatgcatggacccatttctagatgtgtgctcacaaaagaactgagaagactaggctctcaattctggctaaatttcaggcactgcacaagcagaaaatgaaggcaaaggcagaactttaaactgtatagctaagcaatgaaggagagccccaacacagaaccaaccctcaaaaactaagaaagctttttgttttcatagtttgtttctttgttttgcttccaggagtttaataaaatctctgtaaaatcaataactgactaaagctaatggaacaaatatttcagaggccacacataccaaaaaaatataggctttacaaaattagttaagaaaattaactaaaccaacaacaaccacaataagcagcaacaacaagaccaggggactgggagaatcaatcagatttccagagtttctacattataacattcaaaacatctggttttcaagaaaaaaaaaaaactgaggcatgtgaggaaacaagaaagtatggcaaggacaaaaaaccaaacaccgcatgttctcactcataggtggaaattgaacaatgagaacacttggacacaggatggaacatcacacaccggggcctgtcggagggtggggagggatagcattaggagatatacctaatgggcgcagcacaccaacatggcacatgtatgcatatgtgacaaacctgcatgttgtgcacatgtaccctagaacttaaagtataataaaaaaagaaatgaaaaaaatacattgcatagaagaaatacgatcatacatttatagcatttagcacaattcctgacataataaaatactcaataaaacaacaacaacaaaaagaaaaacccacagctgacattgtactcaatagtgaaggactgaagtttttccccttaagatcagaaacaagacaaggatgttcattgtggttggaaaaaataattgatgtaatttcaatcttcttaagtggttaagaattgttttgtggcctaacatatgatctatcctggtgaatattctgtatgcacttgaaaataatgtgtattctgctacagttgcccaaaatctggggttgaagaagccagcttagttctgggtcgggcctgaagcctggggctctgtgggtcagccttttttggactcggttggagcctggtctgggcctgaagcctgagcttgaatgggccagcctgaaatctggggccaccagggatggcctggagtctgtacccatgagggctgtattggaggctgaatgtttggatgctgacctggtacctgtggccatgggggccagcctggagctgaggtccatgggtgtcaacgtggcactgggacagacccaaagcctgggagtgtgaaggccagcctggagctgagttggtctggatactgggtctgtgggtattggccttaaactggggtccaaaggtgctagtcttgtgatggagagggcctgaaagctgagtctgggggtacagtggctgtcctgaagcaaaggggctgtcttggaggggtgcaagcctggaggtatgatctggtgctgaaggaagtctggagtctggggctactggcccagggctgggagactacatctgcagggatggcctggacattggggctacaagggctggcctactgcccaagtctgtggggaccagcctaaagtctggggtaatcatggcctgtccagggctagactttactgtgttgggcccagtgtttgggtctgaggcaaagtctggtgttcacttacctcttcttctcccaagcaaagggcatctctctccatactgtgggttggagaaggcataacacaggtaatttaaaactgtcctgctaaggtgaaaaataaagcaaaaaagagaagtagtgatgttagggaaaggagtgatgttgcaacgttacaattgagcgtccagagaaaggcttcacttagaaagagatacccatgaaaaagacctgaaagaaaagtgggagcaagggatgtccatgtgtccccctcacctacgggcagaccaagttaaaaggctctggggtaggagctttccaggcctatttgaatggtagcaagaaggtctgtgtcataattgagcgagtgagggatatgagagaagagaggtaaggtgggatcacatcatgtggatccttataggctactgtaatgagttaggctgtgactcggtaagatgagacgactgcagactactgagtaggggaaagccatcactctggcttctgggtggttaatagactgggtgggaaagaaggtggttcatatcatgtgggtccttgtagaccactatgagcacttgggctctaactctgagatgaggacattgcaggctaatgagtaggggaaagacatgacatgacttacattttaacatgattgctctgtctatgggtggagaatattccaggtgtatgagggacaagtatgggaatagggagaatagtcaggaggctgttacagtaatataggctttggactgggcaggggcgcgggggtggacagattctggatacattttgaaaggtaagctgaccagagttgctaatagatcaaatgtggagttagaaggaaagagaggaatcaaggaagatacctaagtttttgacctgaccatttctagcttccagtgaatttttttttatgaaaaggaattgagtgttttagcctttgtttgtattgtatatatttaaggtatatcacatgatgtcttgatatacatatatatagtgaaatgattactacagtcaagtaaattaacatatccatcgcttcatatagttatcttttttatatggtaagagcacctaaaatctaccctttgcaaattttcagtatacaatattattagtcctcatattatacattatatctctagacttactcattctacataactgcaactttgtacccttcgacctacatctccctctttcctccccccactgccccggtaatcactgctctattcttttttctatatatttgacctcttaaagatgccacacataagtgagatcatggagtatttgtctttctgtgcctggcttatttcacttaacataacgtcctccaggctcatccacgttgttgcaaatgacaggatttcattctttttaaggctgattaatattctattacatatatatatatatatatatatatctcacaatttctatatccattcatctgttgatgggaacttaggttgtttctatatgttagcttttgtgaataatgctgcagtgaacatggcagcacagatatctccatgaggtgctgattttttattgaatacttttctgcatctagtcattatcaaatgggttttcttatttgatttgttaatgtggtgaattatattggctacttttttcccattttctccatcctatttattccaccatttgttttataagttgtaatatttgaaaccatatttttctttttctttttctttttttgagactgagtttcacttgtcccccaggctggagtgcaatggcgcaatctcagctcactgcaacctccacttcccagcttcaagcaattctcctgcctcagcctcccaagtagctggaactacaggcgcccgccaccacgcccagctaatgtttgtatttttagtagagacaaggtttcaccatgttggccaggctggtctcaaactcctgacctcaggtgatccacccacctcagcctcccaaagtgctgggattacaggcatgagccactgcgcctggccaaaaccatatttttctactactcatgtctgcaaatgtattgtactgacattatatcttctgacaaataggcttttaggagcaagtatggaaaccaccatttgaaacattgtttctacagataaatgagctttggattccagacaactgattaccctgtgaactttagaaaccaaagtgttctgagattggaaaaaatataaacttctactgagagacttctaagggtgtttagtttccagcacaatgttccagaacttccattttcagtatagtgcaagctagggcacctggtctctgtcatgttatgtgcaaatgatagttgacgcatgtttctttttaaggtaccctcacctgagtcccaagtacaaggagtcttttgatgtgggctgtaacctctttgccaagttttctgcatacattaagaatacacaaaaggaggcaaataagagtaagatacctttctttaaatctctatttttctctcactcttcatcttctcactcagcaaaaatagaattttcctgaatatatagtatattttggggactggcctagtcttcccctcattctctatactctcctctgaaattccctcgcatgaagttgtattagatttagaactcaagattcaatatagctattaccaaccatagctcaattagaatattgacatactaggtgtgaactaactgcaggactgtgtacctttaaggtttcttaaactgtggcacctaccatttcccatgaacattcttaaatagatttattatcctctgagtcacaagaactgtgttttttctttcactttctaactcttctgatcacttttctttctttcttttactctcctgccaatgcacctccctaagaaaagcccaaaagattaacactcactatttcatcttactttgtcttatcagtgagtagctgagcattctaaatagttaactagatattgaagagccagtgtaagtagtatgtatagatagaggtgtctaaatgtgtggaaagcatatttagaatgtatttagtcaaaagacaatacatttacaagtaactctattacttcattgcctcagattttgaaaaatctctgctcaaagaattcaagcgtctggatgactacttaaacaccccacttctggatgaaattgatccagacagtgctgaggaacccccagtttccagaagactattcttggatggggaccagctaacactggctgattgtagcttgttacccaagctgaacattattaaagtaagtctttataaggcaggctgaatgggtgggaggggtttgccagttgccagcacaaagcatagtgaccttccagtgcggtattattatattatagctttgtcattatcatcatcatcatgtgtactatatacatctcttttctctttagagggaagatccataatgttctcttctgggaagtattaaaacttgtttctttttttttcttttttgagatagggtcttgctctgtcacccaggttggagtgcagtggcatgatcaaggcttattgcaacccccacctctgaggctcaagcagtcctcccaccccactcttgagtagctgggactacaggtgcgtgccaccacgcctggctaattttttgtactttttgtagagacagggtttcaccatgttgcacaggctggtcttgaactcctgggctcaagtgatccgcctgccttggcctcccaaagtgttgggattacaggcgtgagccaccgtgcccagccaaaacttgtttctttctttctaaatcagaaggtattttccactgtcttattttgtaataatattacctattttacagaattgttaagagaattaaataaattaaagcatttaaaatgcttagaacagtgcctagatcataatagggaataaccaatttgggctattagtattatgatgaattaatcataaatttaataaatatttattgcatagacttacacagaatttactctttgagtcctatgccaaacacagagaatatgtaaagaaagaagacataggactctaaataaactcttagtctagtcgtggtggatatgtgctcattttctgtggttccttcctctaaatatagtcataattaaatacagaatcaatatcaacatgattgtaagcatgtagttttgtcaacatttgtagacaaaacatcaaaatagtccaagattcgtgtctacttcatagtttattttatagtgctttttgtgtcgataagatgcctttgataatcttgacttctaagaaacatttctacatagtaggcatattactgatgccttctttttcctcttttttttgcaaaattctaggttgctgccaagaaatatcgtgactttgacattccagcagaattctcaggagtctggcgttatctccacaatgcctatgcccgtgaagaatttacccacacgtgtcctgaagacaaagaaattgaaaatacttacgcaaatgtggctaaacagaagagttaggagagctcttacaggagaaaaggctatatttgtgatcagattttacttattgacatattagaaaggtttttgcaaataagaatatgaaaaatactgtttcttctatccaactctcttatgaaaaggaactctgtattttctattagccataaataatctgtccactgtattttacaggtcttcatacttttacttaattttctttatctgtatggcaaaccactgcaatcctgaatgacatggaaagcatcacaatcttttgccctttgcttgaattcctggaatgcatacatataagctaaacagatgtctgcagttataaatgtcataagtagaggtacaatctcaccctgctccttagaaacatttccatataaatcgctaaaataatttcacatttttgttagtttaatatatacatgagtttatttctgatataaataataaatacagagagtgagcatatcagagaggcaaattcttaaagaatgatttttaaaatcagctctaggaagagctcaagatcaattggtcatagaacagcatttgacgcctagaactatgaccacctcatggtcagagatgagaatgtagcctttgtgaccagattatattatttttaaatgaagaagcactcattaaataaaacataattttaaaaaacaatataagaaacaaagtcaactgaatcttttattcatagaaatgaaaaggaaaataaaaactgtggctgaccaaaaggtcttcttgttgtccataaaaggataaggtaaacagtccttagataattacaaaactttctacaaaagttaaaatgttacattactatacgtattcagattcacttgttaaagtactcttaaatcattcaaatctggaaacaaaagctgaacttaactcttgctccctcaaaagagaaacacaagcataagtgcagcttcaaaaaaggaaaatattttaggctttggtggaagggtggagtttagataaaatttaaatgaagtagcgttttaataggttcaaagaaaagtaaggcaatgagcaaactcaaagtactgtccttgaaaaccatagagtcaagataaatgtatagtgtatggttaggtggcagagaaatgcaatcatgttgataatctttgagatacatcctgtcatcagtatatttcagaatacatgcaatgcactagcaagttacaattgatagaatacatttgaaatgttaaatgaaataagccaggcacagaaagacaaacaccacatgatctcactcatatgtggaattttaaaaagttgatctcactcatatgtggaattttaaaaagttgatctcacacaagtagagggtagaatcgtggttaccaggggctagggagagaaagaaggcagaggcactgaaagatgttggtcaatgggtataaagttacacctaggaagaataaattttggtattcaccacagtagggtgactatagcaaataataatgtagcatgtatttcaagatagctagaaaagcaggtttttaaatgtcaccacaaagaaataacaaatgtttatagtggtggatatggtaattacgcctatttgatcattatactgtgtgtacatgcattgaaacaccacattgtatcccatatatatgtacaattatgtgcccattatacatttaaaaaataaattttaaaaaccttcaattaactcttggtttaaaagaaaaatataaaccaaaactacatgatctctaaaacaaataatgatgatgtaaacacttcatatcagaatccatgggataaatataaagcagtgatcagaggaaattttataactaaacactgctattagtaaaaataaaagattgaaaataaattgattaaatattgaactaacaaaaatttttaaaatgtgcacaacaatgtgaatatacttgacacttctcaactctctgcttcaaaatagttaaggtgatgagttttaagctatgtgtttttaacacaacttaaaaaaaaatgtccaaatggatcttggtagagcaccagcaaaaaacagaaagaaacttagaataagtacaacaaattaagtaaaagaacacaagagattaacaaaaaaagtaagaattaacaaaagaatagaaatagcatagacctagttaacgaatcaaaacctttattttttaaaagattgataatacagacaaaccattagctacattaattgaaataaaacagagaaagcaaaagtatgcaaaataaagaatggggaaataactattagaagaaatttaagacattataagagactactttgcagacctctgtgcaaacaaatttcaaaatctagatgatagagataatttcctagcaaagtaaagattacgaaaaacaactttattagagatatgaaaattgaagagctcaatcttcatagaagaaagagagaacattttttaaaaagaagaaatagagaaaattataaggaactacttaccaaaaagtatcaatccccagatagtttcacagggaaatgctaccaaactttaaaagaccatatagtctcaaagtaactttgcgaaacagtgtttcttctggaaaatataaaacaaaatataaagaaactatacataaatattgtactctaattggcaaagttgtttctcaaggggatatgtgtagacaattctgaaacagccatacatgtatactaagattgaaaaaataagtaaatgaactg

SEQ ID NO: 17523 - DNA, 5441 bp, Human
cagaattgccttgaatctatagatgtatttgattacattaaattttcataaaagcataagtaaccaaagcaaaattatataaagtgggactacatcaaactaaaaatgttctgcacagcaaaggaaacagcagagtgaaaggcaacctatagatttgagaaaacattgcaaataacatatctgttaaggtattaatgtccagaatatataaggaacctctacaacttaataccaaaaacaaaaaatagcccaattttaaaaaatggatgaaggacttgaatagacatttctccacaaaagacatgcatgtggccagtgggtatataaaaaaatgctcaacatcactaatcattagggaaatattctaagatgctacctaacacctgttaggatgactattttacatatatatatatatatatatatatatggatacattcacatatccatatattcattcatatatacccagaagaaggagatgagccatcctctcactttcatttattaccctcttccttaaaacgaatatatccatatacatatatatgaagatatatatatatatatatatatatatatatatatatatatatatatgttggtaagaatgtgaagaaattggaaccctagcacattgttgataagaatgcactatgaaaaaggtgtatagagcttcctcaaaaattaagagtaaaactacccatataacccaataatatcacttctgggtatacagtatatccaaaagaattaaaattagtatcttgaagagatatctgcactcccacatcaatggtaggattatcaagaataaataatatttaaacaacctaaatgtacactgacagatgaacagataaagaaaatgtagtatgtacatatgatggaatattcttcagccttaaagaaagaatattctgccattcatgacaacatgaatgacccttgaggacattaagctaaataaaataagccagtcacagaagaacaaatgctttatgattatactatatgagttatctaaagtagtcaaattcataggaacagagaatggtggttaccagggactcactttcaattggttaagtttcagttacgaaagacgaataagttctagagatatactgtaccacatagtacgtatagttagcaacaatacgttgatcactttaaaatctgctaggagggtagatctcatgtcaagtgtcttacttgccctctgctcccaaaataaaggtactcaagaaaaactttgtagatgataaacatgcctactatcttcattgggtgatggtattacgaatgtatgcatatgtccaaactcatcaaattgtatacgttaaaaatgcacagtttttttgtatataaactatacctcaataaagctattgtaataaatctccaatatagcatctattaatggtcatcactccaacataatttgaagaaatgaaaattataatataaaccacgacatagctatttgtttcgaacaaaaaataaatatattaataattaatcttcttaaagaagaaaaatatttagtgtagaattattcagtgtgttgctggttttgtgtcttcttagaaatgtaatagcaggctgtatatacaagatccattttcatataaatagattacaatggtccattaattttttaagtatttatctgtggtcaactgaaaatatattttcgacccgcctcgcatgggcccagggggcgggggtttgggtggctgccctcagtattgcctgcacaaatatctaccaagtctgcgacgaatagctccagcaactttgcaccgtgttttccagtaagcctaccgacaggcactgtgcagattcaagcagagagaagtccaagcactgaggccgctgctgcaccggccatcctgagaccctagtcgaccttccggcctccgcatccccgccccgcactaggacccctgcagacgatcaggcggcagccggggtgactttcttcctcttttggcaacatggcgggcggagaagctggggtgactctggggcagccgcacctttcgcgtcaggatctcaccaccttggatgttaccaagttgacgccactttcacacgaagttatcagcagacaagccacaattaatataggtacaattggtcatgtagctcatgggaaatccacagtcgtcaaagctatttctggagttcacaccgtcaggttcaaaaatgaactagaaagaaatattacaatcaagcttggatatgctaatgctaagatttatcaacttgatgacccaagttgccctcggccagaatgttatcgatcttgtgggagcagtatgcctgatgagtttcctacagacattccaggaaccaaagggaacttcagattagtcagacatgtttcctttgttgactgtcctggccacgatattttgatggctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaatttccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaaccaatcttttccaaaattgtttcactttttgcggagcataatgatctgcaatatgctgctccaggcggtcttattggagttggaacaaaaattgaccccactttgtgccgggctgacagaatggtggggcaaatacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcgacaggagggagagttagtgctgtcaaggccgatttgggcaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccggttaaataatacattcggatggagctggaagttggaatttctctttaacaaccaaggggtttattttcaaagcgatattggggaattgatttcacagtttgttaccttagtaggtaacggtaaggttattctctctttttttttttggttatgaaaacttagggactacaattagtataaaaattggcataatgttggattgaatctacattttggcagaagttaagcattcccacataatgtcaaaattatacattatgcagtttttttgtttgttttattttgttttgtttttgagtctggctctgtcacctaggctggcatgtagtggcatgatctgcaatctctgcctcccaggttcaagcgattctcctgcctcagccccccaagtagctgagattacaggtgtgtgccaccacacggggctaatttttgtattagtagagacggggtttcggcatgttggccaggccagtctctcctgacctcagggtgatcagcccacctcggcctcacaaagtgccgggattacaggcgtgagccaccttgcctagcccacatcatgcagtttgaaatgaaactttgccacaaccagcctttgctgtagcacacacatatatcactgaaactgttcgaaataaagtttttttttgtttttcatgattcgtctttgagtacctccaggctgaaggactgttgtaccagtaaaaacttaaaggcacaaattatccttgaagaccttctcccttttctttggccccatattttatgttgctttatctttgaaattttgcatgaaaaggatgcaatgaatgggttcgaattgcatgaaaaggatgcatgaatgggttcgaatgaaattgtcctttagagcatgattacttgttcccatgggcaaataattttctccccttgctcttcctggcctgaaatacgggaaactagagtcagaagttatctccctctccctgtgatgccttgagatgtttttctgcattgttttatgcctgaaatccaatagtcttcctccattggaaaatactgttataccaaataattctagatgagtaacaaagatccttctaggccttcattttatgttttttcttaactgttatatgattgtgacacagattataatattactaatttttggatgtttcaaaaggtcaataagtaaaagatgttagaaagcaaaaaaaaaaaaaaaaaaaaaaggaaaatatattttctatcatgttcttctgataaagtaattcaaactttaaccagccctgaagacggcattgtgattatacatccctgggttctcctgctgacctaaagtaatattaatctccatatataacattaaaatatattcccttattagcttaagggaataaatgtgaataatcaaattttttcttttgttagtgtagggcaaattaaaatttttctgctttttaaagttatgaaaccatagactcatagaaaaaaaattcttcatatacaggatttaagtataaaaacttgcgtgtacatatgtgtatataaattcttagaaaagttgttaaaatctcttatatgttaaagcacatgagaaccgtcagataaaatctgacctccttcaaaaaatctaatatttatgtgagggtaatattaatacaatacttatcttctttgtttctccattttatgttgagtgttgaggagcaaattaattgtcttttagaaagtggcattcttgcagtgggcagcctgtctgctacttagtgctctattatttctctatatctattgttattttgtcctgttaaatgtttaaagaaagattaactattgcattactgtgagatttttatcaagattcttatcattgttagaatattattctttaattctgcctattcctccacagtatttttctagcattctatctatatgccaccttgaggtcttcatttttttaactgaggtaatatatagacacacttaaatattaagagtattatcttactgtcagatggcttg

SEQ ID NO: 17524 - DNA, 122626 bp, Human
aagggctgggggggaaggggttattgtttaatgtttgggatggtgaacacgttctggaaatgggtagtgtgatggttgcacgacattgtgaatgtatttaatcctattgaattatacctttaaatatggttaaaatgttaaattttatgttacgtatgttttacaatttaaaaagcacaagttttttgaggcatgaaatgatagctgcaaaagatgttcaatcttagctcattgctgctgccccaggtgtgtgtgcataggagattatgtaaggaaggctcaactcacaacacatggtctgacaaagtacaagtgtatattcatgggaatgagggaaaagataaaacttttgaaaaggtagtgaaaatatgacataaatataggcgatgcctggaacactcttcactggcccctttgcctggttgactcctgagttccatatcacttcttttggaggaccttatagggcagtatttttccagacttcactgtgcataagaatcacctggggaccttgttaaaactgcaaattctcattcagtagatctgaagtgaagctctagcggcatttctaacaagttcccaggcgatgctgatactatagatccacaggctatactagggggctgcgtaaatttagtctttctttatcttttggaaacagatcttgctctgttgcctaggctggagtgcagtggcatgatcttggctcattgcgacctctgcctcccgggttcaagcgattctcctgcctcagcctcgcgagtagttgggactacaggcgcccgccaccacgcctggttaatttttgtatttttagtagagacggggtttcaccatattggccagactggtctggaactcccgacctcaggtgatccaccagcctcggcctcccaaagtgctgggattacaggcgtgagccaccgtgcccggctaaatttagtctttcttagttcaccattatatccctcatgtccagcaaggtgattagcacgtaggaggtgctaaataaatatttattggatgaatgaagtatttaaggttggtgtaggaggttcacacactttgcgaagttgcctcatgctctgtagaataaggatattaatactaaattatttctgaccttaccaccttgctgcgtcaactctaatctttgaaatagtggccgtagacactgcataccctggtatgcaagcctgaggaagccttgctgtggtctacaatccttggaaacaaattctctccagccaacgaggaagcggagtgcaaggaacctgctggtgtggggatttccagattttggtgcctgagtaattgctaccttggcctcctccaaatcaaagaaattaacagcttgttaaacagagtgttgtgggaggttcattacccttaaatccacgaatgtaataatattgccattatttactcttatcgtttaggatgatgataacgacagtggcagttgagggatgaagtaggtggggaagttgggggaggggacagagggtgtgagacagccggagaaagaggaactacaactcccagaactccccgggaaagcccacgccgcggcggcgccccacccctctcagcgaccagacccgcccctccgatgacgtcacagaggtgacgtcacggcgcccagagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctgtatccttcgtggaggggaattcgggctgtgtgtggggggcggtgtggggatgcccagggcacccccggaaccactgcaagggccctggggcactccaggccactgtccgagactcccctcctcccccagtgcctacggcggctccttggcacctcccaggggccgagagccttttcagctcgccttttctccgcagcaccccgaaatacgcgttgctgctcgctcttcctgtatccccagagcctgtgactttcctccgcgacgtttggactcccgagacggccttttttctttttgcacgaccagtcgcctcactctctaccaccgagcccattttcagggtttctctctcctgtttgctcgctttggatttagggaatcaaggcagaaattcccgagagggaagcctttctccgtttcttgagatgcccccatttcctccaaccacaatgctgcttgaactggggtcactcaagcgacctcttttatccctaattcctttctatattaggaagagagtctcctgctcagggccccctcttctaagaaagagctctgtgtgttttcagtcagtccctcctgttaagctttctggtccccgggagaaccctactgttttcctttccactgacaaagcctgtcccacccatagttgtatgtgatgaagacccccgggccctccagcaagccaccctccatattgtgggtatgacagctggggaaagaggagctcctggacaaaataaatagtccctggactggccacttgggcaaaacttcctctgtgagggtcaggttcttgggggaatacttgccctgatgtcgccaagtgacaccctttattttctgccccctccccccaactttatgcactctggaggttgcagtgggaaagctataactgataagagcccttcaggcagtggttttggttggagtccagactgattatttcaggaccagctagagaaattcgcgaaggttcctgtgacaaatcgagaattttttttttttgaagggtagtttagagggtagggggagcccagagttctgaacagctagtccttggggaggggggcaagtgggggcttagagggtggtagtgtggaacacagtttaaaagtcctgtctcctgtttctctccctcctccccatccccccaccgtttccccctgttgcagggttttgtttatataactcaagttgtttggctaaattcttcaggtgaataccttttttcttccttttatttgttgctgtttttgattgagtgttttacctctttgtagagatcagtggttattgtcaaaaaattcagttagggaatttgctgaagttttaaaaaagtagtttttgcatatggtttggcagtgggggatgggagggaagttgtctgggcaagagatttttaaaaaataatcttttcagaaataaggtgtttttctccttgctcagggaaaacttggttagaaattaggagcagtagatagacttctaagtttgtggtttggagtttagaatttttgggggagtgggagattagagcggagcaactaataaagtatagtgtacccaatatatgttcaggcgcaagtgaaatcaactctttatgagctgtttgtggctgtgattgttttgtaaatgtgtgaatgataccagtaatgttggcttttcataaggctgcaggaaaacttgtaactatgactgtgtgtacattttacacaaagcagtttcgggttttatttttgtttagaaactaggaaatgacatagtggcagcatctgagttatttttatcttgaattgagagttactgtcacacctaatgcgaatttctacctaatgtttaattgggatggagtggggagacaattccagctgtttgtgatcgttgtcagagtctcaaattatgtacatagacatatttttaaaagattgaggataaagaggggggcctaacttgacctgatgccttttccatacagtgccttttgttcatttagtagttgtggcatctagaatgattaccgcatttaggagtcggggtgtggggggtggagagggagaggaaaacagacaaagaacagcagggtgtcttttttttctccccctaagtggcttatttcatagcttatttttagtagaagatgaagaaaggcaaagatgcattggccttctgttctttccccaccttccttcctttctgacaaaagaaagcagaggcgctttaaaattgtagatctgagataggaggataacagtttcgagatttaaaagccagaggttatctttgtttcgtgtttattttctggtataatggagtttggaagttaaaatgtttcggatttccttttgtgtgtgttgtgtaggtgagagattttgtgtcctcctttctctgttgaattcacagatcagtaggcccaaatggagccaacaatttttgagtaaggtatatttagcagaaaatttaaggaaaaattccccagccctctactaaaatgagtacaattgtgtgaaaaggctgggggttgagaaagatggtggagaggaagtaggaagaaaaggtctgaaggaatgcacttcttgccccccatgccccttgatgatttctttggtgtggggggcgatagctggtttccttgcagtctcctgtttcagcccatttttggatgtctcctgagcgtaattataccaccacgatttacagcctggcagggaacctatatagtaggaaagtagcagtgtgggggtagggagagaagaggatgtgtaactaattggccgctgccttccaccacctcgctcggttcttttggagacaccgtctctggttgttgtttggagtcagtgatatttcttttgtgacgggttggtaggagagctgactcccaagttatgcagggagtgagtgttttgcaccaatgcacttaataatctgctgggtgattatgttctgaaactctgactcattcattgtttctcttctgatcctttgctaagggttgtgcaaacctccccaggagcctagaaactgatttacatgacttttggatcctttaggaatgtgtcccagtaaaaaaaccttgcagttagcccagatcctatggaatagtctcgaatagtgcggccatttgtttgcaaagtcaggtagattggtgatctgtgctgcccagagcctggcaacctttgaggtttccacctccaaccagctgattatttagattgtctgagagctggggctctggtgaccttaaagcgtgatttgccctaaaggaatatcggtttaagttctccctggtggaggaacaaacagctcagattacacgggtttccttgttggtgggggttactcgtctcaccctgttgcacagccctggtgatcctttcatctgtgaaccagtggcccctgctgaaggctagagctgcttgttttggaaaagcgtatgcaggcaaaaggccgcaggcaccgctcctcagcgctcattggccgccctgttactacccggaaaaggaggaggggaggagctaccaaacagctgatggagtatgtgacaagagagtgtgtttatatacaaaagaggtgggggctggggaggccctctgagtggtgttacaggaacaagtgtgttttcgaggggtaaaaagagaagaggaaaacctgacctgttagagtacaagaaatgtttagaaaaattaaggttaaatcagaaaagtagatcggataataatggggaccggcatacaccatatgtacaattttgtaacttacaataccaagagttttcaatgattcttcttttcagagggagttcagtaataggatcccccccttatttatttttacattttttgtagagaccgaggtctgactaggttaccaggctggcctcccaactcctggcctcaaatcttcctcctgccttggcctcccagagtgctggaattacaggtgtgagcccagtgcacctggcccagggcatgccactttaaatgcacttaactgactcatttgcagggattccaaagtatggcagaaatgtcagcttcccttaagaaagcgtcaagtgtgatagaaagggacggtgtcttacattaaaacggcctgagttaattttacagaatcgttggtgtctgctttagggtttcagaagctttctctaacaaattcaaaacctcagatgtggccaagtgtggtggctcacacctgtaatcccagcattttgggaggctgaggcgggaggatcacctaagtgtaggagtttgagggtccagtgagctaagatcatgccactgcactcatgcctgggcaacagagcaagactctcttaattaaaaaaaaaaaaaagctggcacagtggcttatgcctgtaatcccagcactttgggaggccaaggcgggcagatcacctgaggtcaggagttcgggacaagcctggccaacatggcaaaaccccgtatgtacttgtactaaaaatataaaaaattagccaggcgtgatggtgcgggcttgtagtcccagctacttgggaggctgagtcacgagaatagcttgaacccatgaggcggaggttgtggtgagcctaaattacaccattgcactccagcctggacgacagagcaagactcttatctcaaaaaaaaaaaatcctcatatgtttgggtacttgctttgtgccagcattgtgctgggagtttagtagtgaaaaattcagtatgggtggtcatggtgcttatgcaattagttaaaactttttttagtcggaaaggacaggctgtgttaggtcattgctgtgtgtagtgcctttttgagtaacttgtatttacttagagtggacttttcaaggaatagaaaggttaaaatgaattttgtgtgctaggatgtatatggggatctgtacacctgtttaaaaaaatttcaaaactaaaatattaaaatatgtagccatttgtctttgacttaactttggtattttgctgttaatcagtagttactctatccctaagttagtagtctttgttactctttaatttgtgttcaaagggtagacagttccctaaatcttttaactagttctagtgtcaattgggaacctgtggtttgcctctttatttccagtggactctgttttagtgagatgatgagatgaaagttggcacagctttatggtcttcaagctaaaagttaaagatttggcaactctcagtgttctgaatttgtcttccctgcctagattttggtgacaaatataacatactggtacttattttggttaggcaggaacctacatgagtaagcattcacagcttcagaacatctgattcctgcagtgcagttctagtaaattacacgcaagcctaaaaattcagctttttgggaaaaaatgtttcgcagatgtgacccataaacgtccctcctgtatttgtgtatgtatgttagaacaacctaagtttgttggttttctagtgttgcaattttcttagccccttgacctgcattttatagatatatttaaacattggtattcttttcagtcttaacagatttgatggttccaagaatcattggatttttaggcatgtaatccagaccttacattacgttataatgtttgcaacgtaatagctttttacctgtagacctacagagtgtacctgttagtaaaatacttaaaagaacttagttggatttcaaaagtaaaaagataattgagaaaaacataggttacaagaaggaaaaccagtcacctgtaatcctagttctttaaacagtagttctcaaactttagtttgagattgcaccactgcactccagcccgggggacagagcaagattccatctcaaaaaacaaaaaacaaataatcacctggagagtttgttaaaacaggttactgcataccactcctggagttttctaattcattgggtctagggtggggtctaagaagttcgcagatgatgcttctggtccaggaccactgtttaagaactgttggccttaaatgttaaccttatggcttttttcctatatcttttattctccccaggatgtattgttttcaacctgttgatcatactgtatgtgtctgccctgtttttgcttaatatttttgcaactgtttttcccagttaaaaataatgactaggggccgggcgcggtggctcacgcctgtaatcccaacactttgggaggttgaggcagacaaatcatgaggtcaggagattgagaccatcctggctaacatggtaaaaacccatctctactaaaaatacaaaaaaaaaaaaattagccgggcgtggtggcgggcgcctgtagtcccagctactcaggaggctgaggcaggagaatggtgtgaacccgggaggcggagcttgcagtgagcagagatagcgccactgtgctccagcctgggccacagagtgagacttcgtctcaaaaaaaaaaaaaaataatgactaggctgggcacagtggctcatgcctatacatccagcactttgggaggctgaggtgggcagatcacctgaggtcaggagtttgagacctgcttgactaacgtgaagaaaccccatctctactaaaaaatacaaaattagctgggcgtggtggcgcatgcctgtaatcccagctacttgggaggttgaggcaggagaatcaattcgcttgaacctgggaggtggaggttgcggtgagctgagattgcgccattgcactccagcctaggcaacaagagcgaaactcagtctcaaaaaaaaaaaaagtagctcatgtaatatgccatcccatggctgtgccattgatttaattctttgccatttttctctgatgaataagattgaaattaacatctttgtgcataggcttttctttgggttatttctgttttcccgaaatgggattctagatcaaagaaggtaaacatttgaattaaaatatttaattaaaaatctcagagccctacactcagcgggctcttgttttgttgtgttgtgttttagttggtatcgttttggcactgaaatagcctggcatagtgattaaagatgaattctaatttcctcattgtttaaactttgatgttttttgtgataatggtgatcctcaatttaggcataattttgtattctcagagtgcatactgcaagtcggtaggttaaatatatttatgagcagatagatctaacaggaactgtagaattagttttggcatcttggattcttttttgttattgaggtataattgacatacagttaactgtacatatttaaagtgatacttttgataagttttaattttatgtatcacccatgaagcttatccttatcaagagaggagacatatttatcttcccccaaagtttcttgtggccctttgtaatctttccctccctcccttccaaccattgatctcatttctgtcactgtagattattttacattttctagaattgtatatataagcggaatcattcagtacatactctttttgtgtgggttctttcacttataattctgagattcacccatgttatttagttcattttttttttattgctgagtagtattctattatgtggatataccacaatttgtttatgcattcacctcttaatgcttggtggcatttgggttatttccagttttgggctattaccagtaaagttgctatgaacattgtatggatatacgcttttttttctcttggctaagctagatcatgtggtagggtttgcgcatgcgcgtgcgtgcgtgcgtgtgtgtgtgtgtgtgtgtgtgtgtgtgtgtgtgttttgagcgcatgcgcacgtgtgtgttttgagacaggatttcactctgttgcccagatgagagttcatggtgtgatctcagctcactgcagtcgtggccacttgcctggctaattttattttttttgtagagatgaggtctcactgttggccaggctggtctcaaattcctgggcttaagtgatcctctggccttggcctcccaaagtgctgggattacagatgtaagccgctgtgcccagccatgtttaacacgtagtttgaatttaatgtttactgatgatggtccatatttcacacccaaataaaattgtgacaacggttgtttcacttgtgtgttttgttttgttttgttttgttttgagacggagtcttcgctctgtcgcccaggctgagtgtagtggcgcgatctcggctcactgccagctccgcctcctgggttcacgccattctcctgcctcggcctcctgagtagctggaactacaggcacccgccaccaagcctggctaattttttgtatttttagtagcgacagggtttcaccatgttagcgaggatggtcttgatctcctgacctcatgatctgcccaccgtggcctcccaaagtgctgggattacaggcatgagccacagcgcctggcctcacttgtgtattttaaaggaatcatgttaaattacatgctcttaaagcactgatttattttttattattaaccttattttatagtatatgaattttgttaatttttttatcaataaaacaaattttaccacaatgattgtgatacctttcacttgaataatgatttaaacactttatcttccttttttaaagacagaatcagtctcgctctgtcgcccagactggctctctgcaacctctgcctcctgagttcaagcgattctcctgcctcaccctcccgagtagctgggattacaggggcctgccaccacacccagctaatttttgtatttttagttagagacagggttttgccatgttggccaggttggtcttgaactcttgacctcaggtgatccgcctgcctctgcctctcaagtactgggattacaggtgtgagccacgatgcctggccaatctggttttttgtttgtttttgtgtttgtgtttttagacggagtctggctgtgttgcccaggctagagtgcagtggtgcgatttcaactcactgcaacctctgcctcccggcgcttggcctaaagcattgatttctagctgaatttggttaaagctgatttggtagctactcttctctccccacccccatttgaaattagtaaattaaatttttattgtgaaatatttttgttagcctgagctacatggcaaaagcctatttctaccaaaacagataaaaaattagccaggtatggtggcatgcacttgtaatcccagctactctgggggctgaggcagaaggatcacttaagcccaggaggcagaggttgtggtgagttaagatcatgccactgcagtccagcctgggtgacagggcaaggccctgtctaaaaaaaatgttttgtggccctttgaaattacactttaggaatctggccggccatagtggctcatgcctgtaatcctggcactttgggaggctgaggtgggcagatcacctgaggtcaagagttcaagaccaacctggccaacatggcgaaaccccatctctactaaaaatgcaaaaactagctgggtgtggtggtgcacacctgtaatcccagctactcaggaggctgaggcaggagaattgcttgaacctgggagtcggaggttgtggtgagccgagattatgccactgcactccaaccccggggaacagagcaagactccatctcaaaaaacaaaaaaaaaaacacattacactttaggatcatagtcacaaacagcaattttatttttatatttgctagtaaggctctatatctttgtgaataggtaagcacactttttgttgatggtattattttctttgtaaagtattgataagattttttttaacatttctttagcatttctagtgaagtttacagcagttgataaatatttctggagcactctgttgaagtctgaataatatcttcaattttcacatggaataaactcaggtgaaaggaactaacagcagctcagtgacagaatgggaaacagactataagagttaggatatcctttgatatcatgctttcctggaatttttgtgtgtgtgagagacggagtttcactcttgttgcccaggctggagtgcaatggcatgatctcggctcactgcgacctctgcctcccaggttcaagcgattctcctgcctcagcctcctgagtagctgggattacaggcatgtgccaccacgcctggctaattttttatttttagtagagaggtgatccccctgccttggcctcccagagtgctgggattacaggtgtgagccaccgcgcccagcctggaattttttgaagcttttttttttttttttttttttttgagaccgagtctcacactgtcacctaggctggagtgcagtggtgtgatcacagctcactgcagcctcgaacttccggattctgaactcaatcctcctgcttcagcctcccgagtagctgggactacaggcgtgtgccaccacacctggcttatttttgtatttttcgtagaaacagggttgcgccatgttggccaaactggtctccaactcctgggctcaagcggtctggctgccttggcctcccaaagtgttgggattacaggggtagccactgtgcctggccttaagttaatttttagtgaaatggtgcttaaaatttttttttggcatcttaagagttatttgataggttattggacactgccataataaaattagacattgatttgtaatagttgttgttacattctttctgataaattataaacaatttatcttatggacatttacatgtgtgttgctaaaaaaaaaattaaagctggattcagtggctcatgcttgtaatctcaccactttgggaggagtgcttgagctcaggagattgagggtgcagcaagccatcattatgccactgcactccagcctggacaacagagtgagaccctgtctcaaaaaaaattaatattactgacagctggaacttttagtttggctaacaaaaaggtgacctggcttgtacctgttttagtttggagcaatgatagtatgtttggtaagtagactgttttggtattcagacacaggaatggtgccctgagcatataaattccagtgtcttggccagacgcagtggctcatgcctgtaatcctagcactttgggaggctgaggtgggcagattgcttgaactcgggagttcgagaccaaccagcctgggcaacatagtgaaaccctgtctctactaaaatacaaaaaattagccgggcattgcttgaactcaggagttcgagaccaaccagcctgggcaacatggtgaaaccctgtctctactaaaatacaaaaaattagccgggcgttgcttgaactcaggagttcgagaccaaccagcctgggcaacatggtgaaaccctgtctctactaaaatacaaaaaattagccgggcgtggtggcttgcgcctgtagtcccggctacttgggaggctgaggcaggagaattgcttgaacccgggaggtggaggttgcagtgagctgagatggtgccattgtactacagcctgggcaacagactgtgactccgtctccaaaaaaaaagattccagtttgttattttctatgctgaagtgtaattcgagtgcattgtagaaacttttgaaaacacagtagtctgttgagaggctgttgttgcattagtgattctcaattgggtatcacattggagaagaattaagcttttgggggcccaggtactatggttattgtaatttcttctctgtacctcaccagatgcttggggaaggtgtctggttgtttataggctggtgctcaagggggtatctgcccatgaccagtagaacccaaatcctcaagagcctggggaagccctacatggcagccatatgcttaagagggaaggaggatcctttttgcctctccctgctttgtaggtatctaggacgttatgtaggcagtgtgaatagttgctgctgatcttctgacctgtccctgcagagaagtcagagagaggagtaggtagcccttgtgaagggagaggcttggctggactttgccattctctggaagactttgccattctctagaagataggcatggttggcgggtctgtcagtggactcaaaaaaggcacctgttctgtagcacttggaggatccatatttaggatatcaattaattgagaatgtaatctttgtctttggttcaatctcctggtttctaacttttaaaccatttttagggaagcattatatgtgaaggtaggagatactccctacatacaaaatcatgttattaatgttgtgaattatgcatttcctttttagtattaggcaactttttttcatatatcaagttatcatgtacacttttcaaggttttttggattataaaatcttagttgaggtaatataaatagaaaactagatacagagtgcgtgtctggtttgtgttacctcagaagcaattgggctgtcacttagcctagcaaaaagtaaatttagttgttttgtccaaagggtgccagtataactttggtaatctggattttgcttttctttctttctttctttctttttttttttgagatggagtctcatgttgtcgcccagtctggagtgcagtggctccatctcggctcactgcaatctccgcctctcaggttcaagcgattctcctgcctcaggctcccgagtagctgggattacaggcacgcgccaccatgcccggctaattttttgtatctttagtagagatggggtttcaccatgttggccaggctggtctcaaactcctgacctcgtgatccacctgctttggcctcccaaagtgctgggattacaggcatgagccaccgtgcccagcctggattttgcttttcaatttgatgactatgttgcatagacagttgctgataagttgattaatttaaaaattcagaatttggttggacatttccattgtagcatttgtatgtagaaggttgattggttaaagtcatatcagtaagagatcaccaagagtaatatatagatggatataatgttttcatggtcttcctgctggatgtttactacccttttgctattcttgaatctaaacctgtaaataaattagtgattctccttggcagcaaagcttggaactatataactcttttaattgtattccgaaagaaggaaactgggtaacaaatgctcactttcgctggttgcagtggctcattccttcagtcccagctactgggaaggctgaagcaggaggattgcttgagtccaaggctgtagtgtacaatgactgtgcctgtgaatagtcactgcattctcccacctgagcactatagtgagaccctgtctctaaaaattaaaaaaacagtcacttttatatggcatttggttctcacagctgtgaattgtacttgatcagatcattaattcaaactagaggccgggcgtggtggctcatgcctgtaatcgtagcactttgggacgccaaggcggatagatcacctgaggtcaggagttcgagaccagcctggccaacatggtgaagccccatctctactaaaaatacaaaagttagttgggtgtggtggcaggcgcctgtaatcaaagctgctcgggaggctgaggcaggagaattgcttgaacctaggaggtggaggttgcagggagccgagatcgcatcactgcactccagcctggtgacagactgagactctgtctcaaaaaaaaacaaaaaaaacaaaaaaacaaaaacatcaaactaagcctacaagtacataatcttgtgaggggaatcttggacagtttgggtcggctttgtttttttttttttgagacgaagttttgctcttggcgcccaggctggagtgcaatggcgtaatctcgactcaccacaacctccgcctcccgggttcaaacaattctcagcctatcgagtagctgggattacaggcatgtgccaccatgcccagctaattttgtatttttagtagagacgggtttctccatattggtcagggtggttttgaactcctgacctcaggtgatccacccgcctcggcctttcaaagtgctgggattgcaagcatgagccagcctttttttttttttttttttttttttttttgaatgaggcagtctctctctctgttgcccacgctggagtgcagtggtgccatcatggctcactgaagccttgacctcctgggtgcaaagcaatcccgcctcatccccctgagtagctggaactacagtcacacgccaccatgcccagctaatttttgtatatttttgtagagacagggttttgccatgttgcccaggctgttcttgaactcctgagttcaagcaatcctcttgccttggccttccaaagtgctgggattacagttgtgaaccattgtgcctggccatggatttttattacaaattatattcaaatagatgaaaacaggagggaaaagaattttcagtatgtgtagtagttttgacaggagttttagccttttatcttggtggctgatattagatattaacgttgctcttaagtgtacttaagcacactaaaacattgaacacaatatgtgtttgataacacaattatcaagggaactgaggataaaagcactcatctttgcatcacaatatgacattattagcatctgttaactttacaaacctgattcatttagttcttcatagccaccatcttgataatgaataaagaaaaaacaaatgatgtattttgtcactctattcatttttatctataaagatttaaaatacctttcttttgagttaggttggttttatggttggaagaaggaaaggaggtagacctttgaatgccttgattgctgcccatttctctaggcagtgaagaaaggcagctaaagtgctgtctctgattatcaaatgccatatatgtgagtatacctgtgttgtttgtcatgctgttgtgaatactcacttgcttttttatccactcatcttttttatccacgagctcctgcattaaagtagttagtaaccagttctttctcttggagtaattaatgtgacttttcccttgtttgagatttagttaagagttttatatataacatataaaccatgatatatctgaaaaactgtatttgtggttcataaagactgtaatttcatttcattttcataaattgtatgttttttcttttttcttttttttgttttgagatggagtctcactctgttgcccaggccggagtgcagttgtgtgatctcggctcactgcaagctctgcctcctgggttcacgccattctcctgcctcagccttccgagtagctggggctacaggtgcctgccaccatgcccggctaatttttttgtatttttgtagagacggggtttcactgtgttggccaggatggtctcgatctcctgacctcgtgatccatccgcctcagcctcccagagtgctgggactacaggcgcgagccaccaccacacctggcccataaattgtatgttttcaagtctgtgtgttttttttgttgttgttgtttgtttgtttgttattttgatatggagcctcacacttgttgcccaggctggagtatagtggcgtgatctcggctcactgcaacctctgtctccccagttcaagcgattttcctgcctcagcctcctgggtagctgggattacaggcgcctgccaccacacctggctaactttttttttttttttttttttttcctagtagagacggggtttcaccatgttggccaggctctaggctggtctcgaactcctgacctcaggtgatccacctgccttggcctcccaaagtgctaggattacaggcacaagccactgcacgtggcctgaactggattatcttaatggacatatgtatctttttatttgcttaatgagaattagaaattctatttttttttttttttgagatggagtctggctgtgtcacccaggctggagtgcagtggcgcaatctcagctcactgcaagctccgcctcctgggttcatgccattctcctgcctcagcctcccgagtagctgggactacaggcgcccgccactacgcccggctaattttttgtatttttagtagagacggagtttcaccatgttagccaggatggtctcgatctcctgacctcgtgatctgcccgcctcggcctcccaaagtactgggattacaggcgtgagccaccgtgcccggcttagaaattctattttttgtagaatcagaaatcagtttgtgacttgtgtgcttttaaattgggcatattactcacttgaatgaattggataaaacatgatggttttagtctgccagttctggcagttttatttcttaaatgtcattcttaaagtgttttgtcagttctgatgaagttctgatggcatcttattatttaaagttaaattttaataggtattagagtcatagattttagcatgtttttatacttcgagaaaacctggactgcaaatactagtattacaaagcaatggtggctttccgaatataagggctcttagtgtggaaattaataatcatattctctctaggcaataatagcatttgttgccttaaatagtagcttaagaagtaataatgcttgactgtacacttcattaatgcttgactgtaccgcttcagattaggagagtaaactctggtaactttgttattattgatagaaaaaaacagatgaaagttgagaggatactacttttcaactgtgattaacatcagttttactagtagtcatgtttgttgtgtgaaaaatagaattaaaacaacagcctagtaatgtctgttaatcctgcttatcaatataagattcgtaaagaaaaataaaaatgacttagtagattttaatatcagtgttctggtacctctctacaacaatagattagatggcattgcatcttttcttaaggtgtcagaattgtatttaccctgttaatttaaagaatagaataagtgctgtaaaagtgcctgatttatggaagcttttgtcaggatagaatggcagcatgctgttttcatttcaaagttttatgtatttaattacctgagttatattttcttttctgttttttttttttttttctttgagacagtctcgctctgtcgcccaggctggagtgcagtggtgtgatgtcagctcactatgaccctcgcctctcgggttcaagcgattctcctgcctcagcctcctgagtagctgggattcaggcatgcactaccacgcccagcaaatttttgtatttttagtagatacagggtttcaccatgttggtcttgaactcctgacctcgtgatctgcccacctcagcctcccataatggtgggattacagatgtgagccaccatgcccagccttaaatttatttttaaaagttatatatttatctatatatatttctgcttctatgtatacctctatatatacatatgtttatttttacctttcacctctattttgtggtgcatatatatatatacacacacacacacacatatacacacacatatatatacacacacatatatacacatatatatacacacacacacatatatatatatacacatatatatacacacacacatatatatactttttgtagaaatggggtcttgtcctgtctgtttttgaactcctgacctcaagtgatctggctaccttggcctcccaaagtgctgggattacagggtgagccaccctgactgttttttaaaatttttattttatttttttatatatattttccacttcagaattttctaagcagttgaaattactcctttaaatgagaaaaccttgatgatttttggtgtatgtgtttttatttcagcttttttttttttttttttttttttaaagacggagtcttgctctgtcgcccaggctggagtgcagtggcatgatcttggctcattgcaacctctacctcccaggttcaagcgattctcctgcctcagtctcctgagtagctgggattacaggtgcccacgaccatgcccgactaatttttgtagttttagtagagacagggtttcaccatattggccaggctggtcttgaactcctgacctcaggtgatccacccgccttggcctcccaaagtgctgagattataggtgtgagccaccactcctggcctcagctcatgtttttgttgttcttttttgtttttaaagcaaggtcggtctgtgttgcctaggctggagtgcagtggtgctttctcggctcactgcaacctccacctcccaggctcaagcggtcctcctgcctcagcctcctgagtagctaggagtacagtcgtgtgctataatgcccggataatttttgtaattttagtagagatagggtttcaccatgttgcccagggtggtctcaaactcctgagctcaagtgatctgcccaccttggcctcgcaaagtgctgggattacaggcatgagtgactgtgcctggcttgtcattgctctataatgtacttttcattctaatacatttcacgtttatccttgcagcatttttgctttgagatgttatggcccactttttgtgggttaaaaatctggaccacacaggtcagttaaaggtgctgagatcagagtaagtccttatcacagtggatctggggctaactatggtttcctaagcttttgtcccttatagctttgcctgtgtagtagatgctcagcaaacacctgttaaacggattagaataaattatatactactgggttttcaccaagtccttaggtcatttttagactaaactttggcacctgcaattgaaacgatatggaaatcttgcaggaaagtgttgaatcttcctccaatgatggggaattcaattcttttctgtgtggatgtcatttgcctttttatgtagtgttcattttcccacatgtaacgtgtgtttgttttcttaaatggtcctaaatgctaataccttataggttattcaatgccgttttcagatggttgagattgtttgattcctggtgtttaagataaaaggaaattaaggttgtgcattggggaaagaaacagctgaaacttgctttacttcatttgtaaaatagaataccttaaactcatccaaattatggagctttttagtaccctgttttataagttgcaaagtgtttccagttcctccttacaaatttagaagttctaaaaggggttttccttaatatttgatactgtcaacttcttagtttgctcaggacttcattaaggacctttatgttgtgtttatttttacctttcacctgtattctgtgacaaaagaggacttaagaactacttcagcagctcacaccttccataaaagtatgtggccttttcttagttattcagaataataggaaagatacttaaaccagatatttaaaatctcattttacagatgcaaaacctgaagtttagtgttatatttaaatgtatatacacataagtatagcttttgtttttctttgtttgtggacatgtgcttggtgaaagaggaacagaattttactctttaggtttttggtaagtaacagaggttctggcacaggtgatgtctggagccccctagggatccccaagatactttcaaggggaatgtgaggtcagaacttttcatagtaatattgattcattatgtgccctttttgcccagccaacagttttctgatgtagatagacagttctgacaggacttttttttttttttttttttttttgagacggagtctcgctctgtcgcccaggctggagtgcaatggcgtgatcttagctcactgcaacctccgccttccgggttcaggcaattcttctgcctcagcctcccgagtagctgggactacaggtgcccaccaccacgcccggctaattttttgtatttttagtagagacggggtttcactgtgttagccagcgtggtctcgatctcctctgacaggatttttgatgtatgatgaaatggtgtcaacatttggaagatctgtgtaagtcagtgaaaactgttttccaaatggccagtgcatgacagaaaaattatgcctggttaaaagatccattaaaaatgcaaagtaggctgggcgtggtgcctcacgcctataatcccagcactttgggaggccgaggtgggtggatcatgaggtcaggagattgagaccatcctggctaacacagtgaaaccccatctctactaaaaatacaaaaaattagccgggcgtggtggcgggcgcctgtagtcccagctactcagggggctgaggcaggagaatggtgtgaacccgggaggtggagcttgcagtgagccgagattgcgccactgcactccagcctgggcaacaagagcgagactccatctccaaaaaaaaaagcaaagtgggctgggcgcagtggctcacacttgtaatcccagcactttgggaggccgaggcagtcggatcacgtggtcaggagtttgagactagcttggccaacacagtgaaaccccatctctactaaaagtacaaaaattagctgggtgtggtggcgggcgcttgtaatccctgttactggggaggctgaggagtagaatcgcttaaacctgggaggcggagctgagattgtgccactgcactccagcctgggtgacagagctagactccgtctcaaaaaaaaaaaaaaaaagcaaagtagaacagtggattttaatataagaatatgaaaagttcgttggtacaatttaagattccacattgcagttagcctttacgagacaactgcttgtcaattttggcattatatcaacaaaaaatgtccagaattatctgaaaagtctgttaaagtactcttttccaattacattcaaaacataccagattcaatacagaagcacatatgaaaatccagctttcttttcttaagctggatattaaagagagttgcaaaatgattaaaaactgttcttactatgttattctttgttttggaaattagttttttttttcttaaagatgatttatatttatatgcataagatttacttttaaatgaattaatattttgtgtttctaaaatggtaaataacacacatagaaaagctctttgaggtcttcaggttttttttttctttccccaagacagagtcttactctgttgcccaggctggagtgccatggcgtgatctcagctcactgcaacctccgcctcctgggttcaggcaattctcctgcctcagcctctccagtagctgggattacaggcgcataccaccacgcgtggcaattttttttttttctttttgagacagggttttgctcttgttgcccaggctggagtgcagtggcacaatctcagctcactgctgcaacctgtgcctcctgggttcaagcgattctcctgcctcagcctcccaagtagctgggactacaggcatgcaccaccacgcccagctaattttttgtatttaatagagattgggtttcaccatgttggtcaggctggtcttgaactcctgacctcaggtgatccacctgcctcagcctcccaaagtgctgggattgcaggtgtgagccactgtgcccggccttgttttttttttttttttttttttttgtgagacggggtctcgctctctcacccaggctggagtgcagtggggcgatctcggctcactgcaacccctgcctcctggctttaagcaattttcctgcctcagcctccggagtagctgggactacaggcgcgtaccaccatgcccggctaattttttgtatttttagtagagatggggtttcaccgtgttagccaggatggtctcgatttcctaacctcgtgatccacccgcctcggcctcccaaagtgctgggattacaggtgtgagccactgtgcccagctgttaatttttttttatttttagtagagatgggttttcaccatgttggccaggctggtcttgaacacctgacctcgtgatccacccgccttggcctcccaaagtactgggattacaggcgtaagtcaccatgcccagccgaggtctttaatttttaagaatgtagaccgcatgaggtggctcacgcctgtaatcccaacactttgggaggccaaggtgggcaggtcacctgaggtcgtcgggagtttgagaccagcttgagcaacatggagaaacctcgtctctactaaaaatacaaaattagctggtcatggtggcgcatgcctgtaatcccagctactccggaggctgaggcaggagaattacttgaacccaggaggcagaggttgcagtgagccgagatcgtgccattacactgcagcgtgggcaacaagagcgaaaccccgtcgcaaaaaaaaatacagagtgtaaggcgtgctgagaccagagtgtttgagagctactactcctaacaaatgtatattggaagagaagtcatattatgataaagtctaggatgtgctttaattgtaacctagcacagtttcttgtatatccgttttttttgttttgttttgttttttgagatggagtctttgtcgcccaggctggagtgcagcagtgcgatcttggctcgctgtaacctccacctcctgggttcaagtgactcttctgcctcagcctctcaagtagctgggattacaaggggcctgccaccacacctggctaattttgttgttttagtagagacagagtttcaccatgttggccaggctggtctcgaacgcctgacctcaagtgatcagcccgccttggcctcccaaagtgctgggattacaggcatcagccactgtgcctggcaatgtgttaatataatatttgaaccagactggatagaattattcagtaaaccatgtaaatacacatttagctaagaaggaatattggtggcgtgtgaagatggtaagtgtttttatgtcagtaaacagtgtctggtttatcttgtattttatagattctgagacctttttttcccacatcttaacatctttgaaattgagatgtcttaaaatggtgataagtcatagtctaatgggcagcttttttctttcttggtgtgtcataaaataatggtgtgtcatagatgtaatgaaatgtgctagtgtctctttttgtgtggagaggagaaggaaacatactggatagcagttcagttcttgagctacgggatatggtgcattaaatgttactcttctttttttttttttttttgagatggagtttcactcttgttgcccaggctggagtgcaatggcacgatcttggctcaccgcaacctctgcctcctggattcaagtgattctcctgcctcggccccccaagtagctgggattaccggcatgtgccaccacgccagctaattttgtatttttagtagagacggggtttctccatgttgttcaggctggtctcaaactcccgacctcaggtgatccgcctgcctcggcctcccaaagtgctgggattacaggcgtgagccaccgtgcctggcccctaaatgttactcttatcaggcacttaattgactctgggcaattgacagtgcactcattgttggaatattctattcataaagcagttatctttatttcaagcaagaaaactagatttcaatgctagaattcaagtcttttaaaacaaagtgtaaaactcatatttgtgtatcttttttaatatgcagagccttttttctgtttaaccatattgttgattttctcctctttatatatgtatatatatatttagttttaattgacatatttatggcatacagtgatacttctatagatgtattcaatgtgtaatgatcaaattgggcatatctgtcaccttatttatcacttctttgtgttgggaacatccaaaatccactcttctagttatttgaaaagacaaaatatttgtttttatttatttatttatttttgagacggagtctcgctttgtcgcgcaggctggagtgcattggtgcaatctcggctcactgcaacctccacctcccgagttcaagcaattcttctgcctcaggcttctgagtagctgggattacaggtgtgtgccaccacacccggctaatttttgtatttttagtagagacgaggtttcaccatgttggcgaggctggtcttgaactcctgacctcaaatgatccacctgccttggcctcccaaagtgctgggattacaggcatgagccaccgtgcctggccataagttgtgtttgttttttgtttttatttttgtttttttgagacagagacttgctctgtcgccaggctggagttgaagcacttctcctgcctcagcctcccaagtggactacaggcacgtgtcaccatgcctggctcttttttgtatttttagtaggcacagggtttcaccgtgttggccaggatggtcttgaaccccagacctcatgatccgcctgcctcagcctcccaaagtattgggattacaggcgtgagccactgagcccagccaaatttttttttttttttttttttaattttgagatggtatttcgccatgttgcccaggttggttttaaactcctgggctcaactgacccgcctcccaaagtgctggaattacaggtgtgagccactgcgctcagctacaataaattgttaattatggtcaccttcgaatgcacactaagacttatttctcttatctatctgtaatttggtatttgttaaccgatctctggctacctccccaccagactctagtaaccactattctgctccatttctatgaaattaacttttttagctcccacgtatgagtgagaatatgcgatacatgtctttgcgtgcctgctttattttacttaacgtaatgtcccctaaactcatccatgatgctgggaattataagatgtggttttaatttttttatggctgaatagtattcatatatagtgtattacataccacattttatccatttatttgttgcccacatttttttgttgtgtttttatttttgagacggagtctcgctctgtcagccaggctggagtgcagtggcgcaatctcggctcactgcaacctctgcctccagggttcaagcaattctctgcctcagcctccccaagtagctgggattacaggagtccaccaccacgcccggctaatttttgtatttttagtagagacggggtttcacgatcttggccaggctggtcttgaattcctgaccttgtgatccacccccctctgcctctcaaagtgctgggattacaggcatgagccaccgcacctggcgaagttgcccacatttttaaatttctaataggtttcttaaaaaagttactgaattctattattaacattttagtgtctctgttttattctgtataaaaataataggaccattacatggagttatgaagatagtgtatgaataaaaagcctaggcatccttagaagtacgttttaaaaaggagaatagggccttggaaaagcacagagttgagtctatcagagaaggcttcctggtggaagcagaatgtcatagagacaggagatagatgagcaagagggcactcatgaggtatgaggcggttggtaggttatcttgattaaagaatcaggttgtaaataagttactgttaagtacatatgtactagtatgtactagagcgtggcgtttgtgaccaagattatgtgggctgctgtatggagaaggggctgagctttttatgatctgacactctgcaaccagtagggccatacctgatacttttctggaggtgtgatcacttatcagtcagccagaggaggactcttggtaaagaatttactcacaggttgaaatccaatcatggttggcagggttttaatgaattagaagacagtgaatggatttgtggcacattatatgagaatgattgagataattttttgaaatgcctctgctttttcaggtggctcatgactgtaatttcagcgactcaggaggctgaggtgggagaatcactcgaggccaggagtttcttttttctttttttttttttgagacggagtttagctcttgttgcccaggcggagtgcaatggtgtgatctcagctcactgcagcctctgcctcctgggttcaagcgattctcctgcctcagcctcctgagtagctgggattacaggcatgtgccaccacactgggctaattttgtatttttagtagagaaggggtttctccatgttggtcaggctggtctcgaactcctgacctcaggtgatccacccacctcagcctcccaaagtgctgggattacaggcatgagccactgtgccgggccgaggccaggagtttcagaccagcctgggcaacagagcaagaccctttatcttgaaaagaaaaaatcatagactttttcagatgtgtgacatttgaagaagtaaaatacagtggaataactataggcttcagtcacagattggatttgttatctctttgccttggtttcctcaaccgaaaaaggaaggaaatacttataatttgttttgaggttattttatatgaaatgtatgtgaatgtatttagcatgtaattgcttactggacagatcagttaggaattgtagttggctggtagtaacagttctggaataatgtagttgtgatggtaagttagggaggcagataagggcgggcttcatgtcatcagggaatccagattgccgcagtgtgtattcccagccctcttcagtgcattacttaatcttaaaggcatcgcttctgccatcacgtcactgtttcatgcagtgggaggaagaaaggggtgaataggcagaaggctaagagctagctgagactattcccctcctccaatgaccaaaggaacttttctgagtgtccctccctacacattgccctgatcatcctgagctagaagtgtctcgttgcaagaaaggctgggaaacaaggctctttgactgccctgaatacaatcggggttttgatagtaagaaggagagaatggatactgggttggatcacgtacagtgtctttcacagtgaatgttgtttcgcttttttctttcatttacatatttgggagcattattgtataggcctagctcccatgaactgtcccacattgtggattttatttttttcttgttttttttccacctggagaacaccgtgaatttttgtttatgaatatcttttttttttcgagactgagtcttgctctgttgcccagtctggagtgcagtggcgtaatcttggctcactgcaacctctgcctcctggattcaagcaattctcttcgtcagcctcccgagtagctgggattacaggagctcgccactacgcccagctaatttttgtatttttagtagagacggggtttctccatcttggccaggctggtcttgaactcctgacctcgtgatccacccaccttggcctcccaaagtgctgggattataggcgtgaaccaccgtgcctggccatttgtgaatatcttatgtctttcgggttctgctttgctgggggactgggcttatgtgataaaattacttaccttgagcattaaaggaaaacaaaaagttaaacttttttttttttattcatagtttagcttgtaccctcaacctttaactcagaggacctgatttgggagttcagcggtggttgaaggttggtagaggagaggcagagtgttgggaggaaaggagactgcctggaggaccgtccagggctttcgtccttggctctgtgcggctcagagaccttggggctttcacttccttcttgggttatctgtgtccttatctatcaaataaggagttggtttagatgattttaagtctctccaacttgaatattctgattttatatgtagacattatacatgcaactcttattttctgtgtgtgtgtgtgtgtgtgtgtgtgtgtgtgaatgtaaaaggccttcacaaccatatgtatacctggtattgccttctagggaatacagaattgaagatagagttatgacataaaatctcattttgaatcttattctctttgcagagaaatatgcacagtaaaactagataaattctgcaatttattaccttcttggtatgaatttttactagggcttttttagaagttcaaagtagaaaaccttttaacaccttcatttggaattttaaaatgtggcagtgaaatatttcacattcagaaacctgtgttaatgttaactaggaaaagtctcagtcttacgccattagtaatgatgtgttgttatcctttcatttctagaaatggatccctggaattagatggagtattgtgaaagtataattttaaacaaatgtttttgtagagacagggtctcactatattgcccaggctgatctctaactcccaggctcaagtgatcctattactttggcctcctgaagtgctaggattgcaagtgtgaaccaccatgcccatcctgaaggtataattattaaaatgctatccagtgttcataatctgcttatctaataattcaaatgctttgtttgccctgctgaggtcagactttggcctactctgtgaatgaatcagtttttgctgttgttacggatggtagagttgagtcaagatgttaatggcccttgtccaatatggggagctagttaagaatgtcttctgattctatcctgtggagtgagagtatctatttgttcacttgatggaaacttacagttccctcgtgtcttgtttcagttttgtttttcatgtggaatacatctagagagacagtatggcttagtggatgggacaggcccttgtgagaattatttcaaataattttgtaatttcaacccagtaaatttctccatcactgttcctgatccctggcattatgaacaataggtttcagaaagcttccatgttttagaacctctcctacctgagattacaggtgtgagccaccacatctggccaaggtgttatagattctttaacctaaatttggcttattacttggaaatgttattgaggaaattggttatcagttttatgattttctaaattactatataacttctagtcacataaaaagtgtctaagcttgtccatagcaagagagggctgcttcaaattatgattaatgatattgcagaacaaattctgggttggtagtaatatttattggttaaaatatagtagtaggcctttaacatggatatgactgtagatctttattttagctgccacatagttgtgaataaaaccaaacttacgaaaagcaggtaaaactttattttattttggaagttagttgataagggtaattcagattgaattgcataataatggcaatattaagtttcttgtttaacagttatggactggaaatttttctttcagcacttgggaggccgaggcgggtggatcacgaggtcaggagattgagaacatcctggctaacacggtggaaccctgtctctactaaaaatacaaaaaattagctgggcttggtggcgggtgcctgtaatcccagctactctgaggctgaggcaggagaatagcatgaacctgggaggcggagcttgcagtgagccgagatcatgccactgcactccaacctgggcgacagagcgagactccttctcaaaaaaaagaaaaaaaagaaaaatctcagatacaagccaggcactgtgtgtgcacttgtagtcccagctacttgggaggctgaggctggaggatcgtttaagcccaggagttcaagtcagtctgggcaatatagcaagatccccatctctaaaacaaaataactcagatacatataattagaatagtataaataaatatctgtataccaccctactatgtagactcaatattttgctatatttgctatctcatatttttggctgagccatttataatttgcaaatactgtgagacttcagtgtaaatactttaacatgcatcttcaaagaataaggactgtttttctgggcacagtggctcatgcctgtaacctcaggattttgagaagccgaggcgggtggatcacttgaggtcaggagttcgagaccagcatggccaaaatgttgaaatcccatctctacaaaaattagccaggcgtgatggcgtctgcctgtaatcccagctactcagaaggttgaggcaggagaatcacttgagcccaagaggcagaggttacagtgagccgagatcatgccattgcattccagcctgggtgccagagcaagactccatctcaaaataaaaattaaaaggccaggcacggtggctcatgcctgtaatcctagcactctgggaggctgaggtgggtggatcacctgaggtcaggagttcaagaccagcctggccaacatggcagaaacccatctctactaaaaatacaaaaattagccaggcgtggtggctggtgcacacctgtagtctcagctactcaggaggctgaggcaggagaattgctccaacccaggaggcagaggttgcagtgagccgagatcgtgccactgcactccagcctgggtgacaaagtgagactgtctaaaaaaaaaaaattaaaaaagaataaggacttttcttacataaacacagtaccattatcacaccagaggatattaatagtaacttcaattatatcatgtaatatccatagaggaaatattgaaatggtgagatgttttgtctagccactttcaaagaaagaaagcctgtatttttacattttaaacaacagtaattagacaaagttagcgccaaaaagattggtttgaaacccatgcaatgttagtgggaaaaatgttctcattcattctaataatttatgaagtcagctttttttttttttttttttttgtgacagagtctcttgttgcccaggctagatgcagtggcgtgatctcagctcactacaacctctgcctcccaggttcaagtgattctcctgcctcagcctcccaagtagctgggaccacagacgtgtgccaccatgcctggctaattttttgtatttttagtagagacagggtttcactgtgttggccagcctggtcttgaacgcctgacctcaagtcatccgcccgcctcggcctcccaaagtgctgggattacaggcgtgagccaccatgcccggcaaaatcagcttttaaattagggtttaaatttgcttttgtagctgcatattttaaaaagtttgcttgagcccagcaggttgatcctgcagtgagctatgattgcaccaatgcactccagcctaggtgacagagtgagaccctgtctctaaatagatgagtccatttttctgcccttagaaaatatagaatgatgagtacaattggaccctcaagagtaaagatcagagacagtgacacagtctagcagaaaataatggtacctgctgcaaagggtcattgttaccaagtaagtgaaattgtgtagtagtggttagcacagtatctaacacataagcacaccaatgttagctttaaaaaaaaaaatcacgtgtaatatatattgatttggaactataaacaccaggacttttttttttagaggcagagagtcttgataggttgtccaggttgttctcaaactcctggcctcaagtgatcctcccactttgaccacctaaacagtgagccactgtgcccggccaacaccaggacattttaaagattgctttttttttttttttttttttgactttttctagtcatttgtttattacatttttttcaatgacaaaatattttaagcaccacaacaaatatgtggaataaaataatgaacagcatccatttcccagttgtcagattttaacattgtcttcagaacttttttttgaggtaataacacctgaagttacactaaagcctcctgtgatgtctttcctgattccgcttccctccctgtcttcttgaattgtcatcataccattcatgtttattttctcatatatgtatgtatgtagtattttgtatgtttatataaatatacattttgattcaatattacttttaagatttattgatattattagaagtattctagtagctttacttcatttgtttccagttcatttatattgagttatatgtgtaccatattttttccattttgttaatgcacatttaggttatttccagtttttcaccgttatatacagtgtcataattaacatttatgagtgtctttttgagcacatatgtgtttttctgggatagtgtttttcaagccttttttgttcactagacacagtaagaaatgtattttacattgatacccaaaatatgtgtgtgtttatttgcataatgttcatatatatatgcataaatatttacatgtaatagaaattatagttttataaaatatttaccctgaaaaaatatttacgcatacaatgtgagagatgcatacttgagatatgaataaatatcccttcatttaaaaataagctgatcaggacaatatttgacaaataatagtctaatgtatgtaacctgaagcagaattgctgctttgacagtgctcattttcagcttggcgagagatgaaaaatatcactcttcaaagtaattttaccaaactcacattcccatcagcaacatatgagagttcctgtttattcatatccacaccatcatttatccagctttctaacattttgcctatctgatggatgtgaaatggtatcccagtgttttctcagtttattttctagtcaaatatttttggtgccttctttctgtcagaccctgtgcaaagcagtaaagatggtaacaagagaggtgagacatggctttcctattctagggagcttgcattctaggagagagatgaactttgtctcccagtgagtggcaaagggacacacaacggggtgcaatgtgcagcctgcctagggaaatggggctgttccaagagatgaagtttgaccttggtcttgaaagatgagtgggcattttcagagagctgtggagttgaggggcattccgggtggaggggaggcaaaggcatagagctgtaaaaccacattattcaagaaacttaatgagtgttcatgactgtagagtcccaggattggtgaggccaaggaataagcagaggagagcctgcagatatggaggcaggtggagttgtatgctgccggcaccagactcattgaaggttttaagtagggtgttaacaggagttttattttgtttttacaagtctaggaatggattctggtattaaacgtgatggtcaatcaagtttttgtcttaatttcagtttcaaacgcattagcttagctgtttactatagtctttttgaaacaggtagataatagaaattattatatttcctttgaactagagttggtcattttctattctttcctagcatatgacacatttcctttcatccatgtgccttgttttttggtgctttttttttttttttttttttactttgtttttgtttttgagacaaggtcttgctcagttacccaggcttgagtgcagtgacacaatcatagctcactgcagcctcgacctctcgggctcaagtgatccttctacctcagccacctcagtagctggtactataggcgtatactaccacacctggctaaattttgtatttttttgtagagatggggtttcaccatgttgcccaggctgatttcaaactcccgggctcaagtgatctacctgcctcaacctcccaaagtgctgggatcacaggcaagaaccacagtgcacagccttctttcttttctttcttacatgttaaacatatacatagagaaagggtctacattgtataggctggttgtgagctcctggcctcaagcatccagcccatgctccttagttttcagtgggacaacaaatggtcttcacaggtgttttttattgtcaaatatgaataggtatagctttgtacaggttggtaattttaagaatttggattttggggccgggcacttgagcctggccaacatggcaaaaccctgtctctattttaataaaaatacaaaaattagctgggtgtggtggcacatgcctgtaatcccagctactcaggaggttgagcatgagaatcatttgaacccaggaggcagaggtcgcagtgagtcttgattgtgttgctgcactccatcctgggtgacagagcaagactgtctcaaaaaaaaaaaaaaaagaatttggattttttggacaatgtctttcatgaggatactttcagtctttatctcttactcttgctacattgtatgtagcaagtatggatatagttaaaagaacttcctttagaaagctggagtgcctcctgttaatcaactgtatgtgcgtgcatgtatatataaaggtgatgatatgagagattgctttggacttcttgcagcttttggcattcctgggctgccagtccctttttaataggagcatttgtcttgctttaagacatgaaagtttgaggcctgccagtgtctaataaaagcagtttttggagagcaaattacagagagtcgtgttttgaaattctcagtgccttaaaagaatagatgtgaaccatagcatggaatagtaagcacttattcgcgtgtgcatacttgatactagcttttggtgagaagtctcacacttgtgctagtgttaaggagcgtattcaaaggtatgttggtatgttcattgagatgcaggggcaacactgagcattgtgtagatcctatttttaatttaggagaatcctatgcaggtaggttaacttttttaaaccttacagttcaaagttgttgtttttttacccctccttttcacctcccagttcaaagttttaattgtgtttcctagctccttgatatttaacaattacatacttccctgctctctctaaaataaaggctttttattagttcaggatttagtccagggagaccttttactgcgtgaaccatgcttgagatgaaaagaactagacagaagcatgtattgcccagtgtccctgcctgtgccctttcttctcagaaaaccctggctagttgattgtctcagcctcatggtcttttgttaccaccaacctccctgcaccccagactccagcaggcacacacacatctgcacacacacagtttagctgatggagaaggagtagggatgtgagggtgtgtcctcagggtaggggctgggactatttcattttctttctgtcttcagcaaatgtaatgcatgttaacaccttggcagtaaaagtgggctggatcagttggatacaaggtgactgttctaaaataaaatgaaaaacagcataatctcgaatttgtaggcaacatgtgagacccagcaaatggaactttttgtttgtttgtttgagacggagtctcgctttgttgccaggccggagtgcagtggcacgatctcggctcactgcaacttccacctcccaggttcaagcaattctcctgccagtagctgggactacaggcacctgccaccatgcccagctgtgtttttttttttttttttggagacggaatcttgctgtgtcgcccaggctgaagtgcagtggtgtgatctcggctcactgcaagctccgcctcccaggttcacgccattctcctgcctcagcctccagagtagctgggactacaggcgcccgccaccactcctggctaattttttgtatttttggtagagatggggtttcaccgtgttagccaggatggtcttgatctcttaacctcttgatcccccttcttggcctcccaaagtgctggaattacaggtgtgagccaccgctcccagccgcaaatggaacttttgcaggtggtttggccattagccgtgtacatgcttagagtgtgtttaggctagtggacaggatgttctctgtgtgtactgtgtaaccttgaggctttgcgtctatttctatttccctagaaatgaaatctaaaacaggctgctttccttccccctagctttccaaacaaaagtaaggcttgtagatgtgaactagactgttgcaaagttctggagaggatggctgtggtttgggatttgatttttggtaggcttttttttttttttaattgttagaacttgagtgtgataaatggcttcttttttttttttaagtgggaagaaaatacaagatcattaaccacttgtgcatattctatttcaaatggcttagaaatttaaagcaaacttgttaaagtttgtagaagctgagttgttgatttctgtggtggataaaagccagtgctgtatctggaaactgttttcctgtttttcttagataccccttgaatcggatctgtttaatggaagaggatttttctgttaagctggttataatgccggttaaactttgtgtttaggatgttaaagtcctggaatgaatataattacctgcctatataaaaaaagctgaagtcatttgatgaaaagttaacaagtgcaggcatgtgagctatttgaaaatttaaaatgcatctgagagagctttctaagattcagagggttttatggattttttctggctttttaataattgaactttatatgaaatgtacattttagctagatggacttacgaggcagatagaggtcaaggaatttttaaattatagattgtctttgcattgcctttggtctgtttctgtattctgaactgatgattgaaagaacgatctgtggtactcaacatttttatggattttgagatacaaagggagctcaaaagcaactgcatgctggggatggtaggagttctcttgaaagacaggcagagttaggagggtctgggccacttagcccgtttgcttttgctttggccacaggtacgggcaggctgttttacaaggagttaaagttctgcttctaaacagatgcctttctgtttcagtgtttcttcctagtgctctgaaaaccatatgtggggaaaatagttcgttctgtttagaggttaagggtgttgcctgcctgaaagtaccagtagtagtatttagtatttatttatttttttgagacagagtctcgctctgtcacccaggctggagtgcagtggcgcaatctcggctcactgcaaactccgcctcccaggttcatgccattctcctgcctcagcctcccaagtagctgggactacaggtgcccgccaccacacccggctaattttttgtatttttagtagacggggttccactgtgttagccaggatggtctcgatctcctgacctcgtgatctgcccgtctcaacctctcaaagtgctgggattacaggtgtgagacaccgcgcccggctgtatttagtatttaaataaagtgtgaagaagcaggtgaagaaaccttcctaccatttaacaagagggagccaagcccgtggtttttgttgcaggaaatgtgcttctgccactcctttaaagctgtgaaagttaatttcacagcctcggggaaagacattgtttcccctaaagatcaggtcttgaagttggaagttgtcatttggtctataacttacactaatgaaaagcctcttagagtgcttactgtgtgccagacacattaatcatagtagtaacagctgacatttgagcgcatcctgggccggacattgtgttttttagcactttaaatatcttcctcagtcctcagaataactcaagaggtaggtactgttttctttttttctgttttaaagatgaaaccttaggcccctatctcatgccaagtaagttgcagagctgagagataagctcagtctgtataactcgggagctttgactctgaacaactaaattctctattatggtactgataattccctggactgtctggcagagagtgtggttctttatttcatcaagggagtgggctcagagaagataagtaatttactgtcataagccttgtgttgaaaccagaactcaaacctgggtcggtttgaagtgaaagcttatgttcttgccactgagtgtatcatatgacctcttagagtacattactgtaatatctgatttacaaagatctttttatttcttgtgtcggcttccctctgtttctggaggggagttgtttaaaaggttgatttttggtcgggcatggtggctcacgcctgtaatcccagcacttcgggaggccaaggtgtgtggatcacttgaggtcaggagtttgagaccaccctggccaacatggcaaaaccccatctctactaaaatacaaaagttagccaggcatggtggggcgctcctgtagtcccagctactgaggaggctgaggcaggagaatcgcttgaacctgggaggcggaggttgcagtgagccaaaattgcacctctgcactccagcctgggcaacagagcaagactctgtctcaaaaaaaaaaaaaattgatttttgaggtggctgttgggaacttgatacgttgtctgctggcagctatgttgcacctggttgtggttctgaggctgtctggccagagcccattggtacagtcaatacatgttaccttcttaagctgctgacaccaatctggcttccaagatatgcattgagttccaagtggggaagacaagcagatatgtgtttcctagtgtccagattccatttgttcttttataagtgttatctccttccatgtcggtaacaaaagtatggggtcgtagttaagtacagagcctctgaggtcagacttggttctgtcacccgctccctactagatgacttgaggcaaggctcttaaccattttctccccttgagagacagggtctggctcttgctcaggctggagtacagtggcgtaatcatagctcactgcagcctccaattcctgggctcaagcaatccttgtgcctcagcctctggagtaactgggactacagatgcatgccactgcacccagttaaaggctcttaacccttctgaggctcagtttcctcatctgtaaaatggatggatgtcctcatgagttattgaggggctcgaatgaaacatacaggccttagatgcttggaatggcatctagacatggcgggtgttcagaaaatgatggcagtggtggtggagatagcaataacttctctgctgtgtggctcttctcttctattacaaaagatcaggaccttttgtaacaggtcaaggtgaatgctttctggagtagactgttgtgttaatgctctgaattggatataaagtaaaatttgggattccctttattttgtaggcacatgtaagtcaataaattgccttgtaatttaaatcctatatagtcaaattctgtgctgtactctttttttttttttttttttgagacggagtttcgctcttgctgcccaggctggagtgcagtggcatgatctcggctcactgcagcctctgcctccggggttcaagccattctcctgcctcagcctcccgagtagctgggattacaggcacccgccaccgtgcccagctaattttttgtatttttagtagagacgaggtttcactatgttggccaggctggtctcgaactcctgacctcaggcgacccacccgccttggcctccgaaagtgctgggattacaggcgtgaccaccgcacctggcccaatgttgtacatttttatattctttgaaaccttgacttttattggaaatgtacttggttgtgttgaacaaaatatttgaggaaaatttttagtgattaattattaaaaatgagccttttaagttcttgttgaacttgaacatagtgtacatttcatttctcaaatggaaaaactgaggtaggaaatagggataggctttgcctaaaggccgttgagtaaagtatgagtgagcgggctttataagggccaaaaacaggttgtgcatcccttatctgaaaatccaaaatctaaaatgctccaaaattcaaaactttttgagcacctacgtaacacaagtggaaaattccacacataaatacttaacacaaactttgtttcatgtacagaattatttaaaatattgtttaaaattaccttcagactatgtgtataagatgtatatgaaacataaatgagcccagtgtggtggctcatgatgtaatcccagcactttgggaggctgaggtgggaggatcgccaagcccaggagtttgagaccagcctggacagcattatgagaccccatctctttaaaaagaaagaaatgtaaatgaatttcatgtttagacttgagtctcatcgccaagatatgtcattatgtatatgcaaataaatccaaaacatttctggtcccatgcatttcagataaagaatactcagcctgtagtaaatattttaggctttgtgggctgtatggtcttttttgcaactattcaactctgctgttgcagcacagaagcagccatcaataatacgtaaatggatgggcatggcgtgttccagtaaaactttatttacaaaaacagggggtgggccctagttcgtggacccctaaactgaaggaacattttaaattctatctcataataaaggcctaccttggtcctgcatctctctgtgtacatgtattaaaggttgtttttcccttaggcttcattctcagtcatcttttcacataacacatcctttgctataaaatgattcatagacccggtatggtggctcatgtctgtaatcccagcactttgggaagccgaggcagaaggactgcttgaggccaggagtttgagattagcctgggcaacatatcaagacatcgtccctacaaagaaaaatttaagaattagccaggcatggtggcacacacctgtagtcccatagctactcgggaggctgaggcaggaggatcacttgaacccaggagttcaaggttacagtgagctatgatgatgccactgccttccagcctgggcaacagagtgagaccctgtctctaaaaaataattaaaaaaaacatatatgtgcatttttagttgagttgttgtttcctaaactctaggttagtgtaggtgcctgccttccaaatatctctccaagacgatcccaacaggcccctaaaaccttgcatgtccaatactgatgtcagtactatttcttccaaactcttactacaatctgtttttttgtttacttacctattgccgaagtgggaaacctgtgtgtcttaacaacctccctcatcctgtttgttctgtcctcattttttttttttttaattgagacggagtctcactctgtcacccaggctggagtggtgcaatggtgtgatctcagctcactggaacctccacctcccaggttcaagcaattctcctgcctcagcctcctgagtagctgggactacaggtgtgtgccaccatgcctggctaactttttttttgtatttttagtagagacagggttccaccgtgttagccaggatggtctcattttcctgaccctgtgatctgcgcgccttggcctcccaaagtgctgggattacaggcatgagtcaccatgcctgacctgttctgcctctttattctctcccccaaccctgccctccattgcgaccaccactgtttgattcagggcctcgggaccttacctggactgttggagataatctcacaacttcagggctccctgcatctagtctgtctccttccagtctgcctttcatcttggctgccagagtgatcctgttttgtttttgtttttgttttttgagatggaatcttactctgtcacccaggctggagtacggtggtgcgctctctgctcactgcaacctccgcttcccgggttcaagtgattctcctgcctcagccttccgagtagctgggattataggtgcccaccaccacacctggctaatttttgtatttttagtagagacggggtttcaccgtgttgtccaggctggtcttgaactccagacctcagacaatcagccttcctcggccttccaaagtgctgggattacaggcatgatactgttttttgtacatctgattatgctacttcttgcctaaaactccttagttgctctttagcacccatggtttaaagcctaaccttggtataaaaatcggtttgatggagtcttggtttaaaagtcagtttgatagagaagtagtgccttcctaccatcggtcaaagatacaatgctgtgctgtatgcctctcccctcccctagccttctcaagggacacttcctaactcttctacagagtccctttctcttttggcctttttgtttttgtttttgttttttttttgagatagagtcttgctctgttgtccaggctggagtgcagtggtgcaatctccgttcactgtaaccttcacctccagggttcaagcgactctcctgcctcagcctcttgagtagctgggattacaggtgcctgccaccacactcggctaatttttgtatttttggtagagatggggtttcgccatgttggccagactggtctcgaactcccgacctcaggtgatatgcctgcttcagcctcccaaagtgctgggattataggcgagccaccgtgcctggcaacttttgtttattcttcaatattcacctcaagccttgcatcttactcaaagccttccttgaatcaccccccctctatatttgttttcaacccttttcgtgtcttctgtatgctttaattgacccctttgttttcccctcagaccactttatataatcagctgtttgcttgtggctccaactcccacctctttcaagctgctccttagaagatagattctgtgtcttatctctttgtccctagatcctagaactgtttgtattgcgtctgggcttaagcattgtgaagaatgagtggaaaatggtaaatatttattactaaagaggtggggccacatgtacatttatatattttttaatacagacagggtctcattatgttgtctaggcaggtcttgaactcctagggtcaagtgatcctcccacctcagcctcccaaagtgctaagattacaggcgtgagccaccactcccggcccatttttctctttttgaagggttcttatttctactcttccagggcaattagaagcaaaaggaaaagacccttggactggagtctggtagaaagaatgctcagtgagcaaacctggggctctgaaccgtccccttgtatgtttttcatggccttgcagctcactccttggagctgtggttctttgaggtgtaggtcagaaattcacggggtgcttcatcaaagtgtgcatgtctgatgaatacctaccccctgcctgcccctctctaggtatcagtggggcggggaatgtcactctcctggtgattcttgtacatgtttcttcttcccatttccggccatttttcccacctgacattttctccctgctccttatattacatagttctttatgatctttctcctgtgttttgtattccttctctgagagagaggggctccagttgcaatgaggttcaaatgatggttttagtgtctcaattaaaactctgaatgcacttactttttttagtaaaagcattggtatagatgatggctaatattccagagttaaatagtgtacttcagataaaagtgagttaaattggcttttgtgtgtaggaagttacattctgagttctacgcaatggacttaagaacttttgaaacaaaacttaaggctgttagttaaggactcatggagtcagatctgcagtagagaacatcattctatacctcctgccttattcccctcttgtgaccccccatttcttccctttactggtaagaaacccaggagcaggcagtctttgttggggataatcatagattggcccttggaaagtggattggaaaatttgaaggtggtgctcatttgtgtttaaacaattatttgctatcatatttagcagtatgctttgctggtttttagattgaacctatgcagacagttagctggagcctctaaagaagaaactttttattcttaagtgactgactgcttagtaatctacataacaaatgaaccattttgcttcagagacgtgaaataggcatctataaatgaatagtttttgaaactaaagttgttaagacaaagttcatcttttcacagtagggtttctccagaaaaccctctttactctattgaaatgcagctagttgaactaggaaagcatattccaataataggcccatgcaattagcctttagtataatggaatgaatggtggaattttttgtgcattgtcatcatcagttggtgttagtcccaaaccacataatagctagaaaccttgattgggagacacaaaggtttcttattcatgggcatgctttaattcttgaaactagtaaaatgttagactcttaaatcttaacacttttttgataactgtctactgctggtaagattaagatatggtgcttcggaattatgtcattattttgagtgagaagaaatgtcgaggaactcttcatttagcaccatatccaagccaaacctcgtatagaaattacacagtggtgtgctggtgaatattgaacaaccaccctggggagggggataaagccctgatttgtaatgtttgctgatttctgaggtataaatactctatcatggctggtttcaggctactagtgttatgttgctgaagttgggaaaaaatgtgtataatcagctggcttgaattaatctcagctatcaaatattcaggattttacagcctgactttttttccagcctgtattttaataatctgcttattcttgtctttatctttgtcctttgttttgaaaaaattggtcttcctgaggtataatttatatgcagtaaaattcagcaattttaagtgtatacatttgatgagttttgacacatgtatacctcgccacaatgatgatattccattaacctttctatacacagttgccagattaattttcctaaaattgtgctttgcatccgtcatctacctcggcataaaaccttcactggctatgtactgttcataggataaagtacaaaatgctgtggtctggctctctaccgtcttgctttttgtctacttatctgcttttatctaccacaacccggctacatgaacctcttattgcaataaaactgatcaactggttctaggcacagttgctgcatctgtgcctttgctgtcagctgtaccctgcctatgatattccttggacatcatattccttcttgactgcttggcctttccttaaagtctggctcaagccccattttcttacacgatccaggctttactgattacttctgcatcccgacagctgtcataccgcttgttttggcacttaactatcgcaacttgtattgaaattccagaggtgttttttggagtcatttgatcttacccaacaaagttgtaaactatgatggggtaggaaacgtacaacggagtttttagcactttgctcaaaaaaaaaacaagaacaccccctaataaatggcttttgatgatgataaacctttaagcagctcttccaactcagtgagtcgcaaattcagtaacactactggggagaatagtactctgttgtaccattgacgtagagactgaaggtttggtctgtcccagagcatagatgtgtagtaatgtctctcaaaactagtattagtcattaaagtgcacattggagattttatctctgccttgaaaattcatccaaaggtagttagcttcatggactttggacttttggcacggattaagcgtttaaagtaggtctccaaagaaacttctttgtttctctcaaccagctttattgcactttttgaagtactggtaagaggtcaggagggtgtatctcattggtttccttcctgtcccaggaagccatgttacggtattctgaaagaactttttctttttcagtaactttactataagcaaatttttttttctttttaaaacttgaattttctctgtaagacattgcatacttgttgaaagcagacattaaatgataacctaacaaatacttaacttaattctagatgcctatctgtttctcaggataccttgtaggttcctcttctcttaaatactggctttactcagggctgggcgcgtgactcacaactgtaatcccagcactttgggaggctgatgtgggtggatcacatgaggccaggagttcgagaccagcctggccaacatggtgaaaccctgcctctactaaaaatacaaaaattagccgcatgtggtggcacacacctgtaatcccagctactcaggaggctgaggcacaagaatcgcttgaaccgggaggtggaggttgcagtgagccaaggtggcgccactgcactccagcctgggcaacagagcaagactgtctcaaaaaaaaaaaaagaaagaaaaaaaaatggctttactcggggtttcacagttcatccttatctcttggtagttagtaccctattcttgagtgatttcatctattattgcctgaatgtgtttttagaataaaaattccatatctcttgagctctggtcttggatggccaaatgcctactggacatcttctctttgctgcttttcagagaccccagattcaacatgtcctaaatggaacatctgtataagtcttttttttttggagacagtgtctcgctcagtggcccaggctggagtacagtggcactgtcatagctcattgtaacctctaactcctggctcctgggctcaaaccatccttctgctttggccttctgagtagctgggactgcaggcgtgagccgctgtgcctggcctctctgtaagtcttaggccctctcttattcctcgattgctgaatggtattaccatcagcaataccaggataactcaacttgagataactcaagccagaaacattggaatcatccttggcttgtccctcttccttctctttctgtgtctgtgaggttcacctcaaacatttcttacaaaaatccttttcctcctctgttttgagttctggccaaccttatcctttgttgggaaggggactcccctgccttccaagcatctaatttgtgtactaagagcagatctacttccatggcatcagatgaaccaagctcataagtctgaaaggtacaactggaaaaccagcatataattttaattgtgtaccagtgtttctggtctctataggtaaacatagctgggatcccatactatcattggaaagaaggttattcgagaaggcattagaacaaaaacaatgagatgaatcaaatgtataatggtctgacacaatctgatgataccaccatctcatcgtagatctgttgtgaccagaaacctcatgtctatgaacaaagactccttttctcccctatctagttgcttcagtggcccctgccagtctttctttttcattcttcttctgagcttgcaggggtgacccttttatgagataccttaatcctttgcatgtctgaatacattgattctggctgtacttgaatcttgctatgtggaaaaccagattttctctttcaaatggcttgtactcccctcagtcattgtgtgttgatctcgagttgaactctgaggggccatcttacttcatgtccttggaaaaaacttcactgtagctgccatataagagcaaaatgctaatctcccattgcatttagccagcatccaccacctcttgaaaacacctttggcttccccacctcctggattaggacaggagcaccttcagtgtgcctcttcagcactgctgagtaaccctcatatcactcttaactgcctctttggtagtttattgattgttcatttccccactaaacttggagctttcagagggcagatgctctcttatttccagatcctactgtctagcgtagtgcctggcacctactcacactattcatttaaccagtttctgttgagcatccactgacacgtagccgaggctagtcactcagctacatgtcaggaataaaggcaaataaggttcttgccctcttggaagtcgaatttcgttcgaggtgagggaggatataaaaagacaaaatagtactcatgataaaacctacaaggaaatagacaatagaatgaggtagagaataattgggatggtctgttgggcatgtacttcaggtgatcggaaaggtctctaaggaagtgccatttagacacaccataaaggcctggtgcagtggctcacactgttaatcccagcactttggaaggccaaggcaagaggattgcttaaggccaggagtttgagaccagcctcgccaacacagcgagatccccatctctatttaaaaaaaaaaaagacacaccttaaaggataagaatcagcaagctatctgtcaaaacagggaaatcagggctgggcagaagaaatagccattgcaaaggccctggggaggaagagagcttattgtgtttgaggaaatgaaagaagaccagtgtatctagaaaggtaagagaggaagaatgtggcagactgagaccgtgtcaggcatattgtgggcttggatgagtgaaattagacagctgtcgatacagtgagtgattcacatactttagatttgtttggaactagcactgttataaattgggattctaaatgttaattttgcacattcttttctggaatgttaatactcaaaaaataacgattgaaagataacctagaacttattattttttaagagacagggtgtcactctattgccgaggctggagtacagatgccagcatagctacctgtagccttgaactcctgggctcaagggatcctcccatttcagccttctcagtagcttggataacaggtgtgtaacactgtgctcagctagttttgttttgttttttaaataatagagatggcgtcttgctttgttgcgtaggctagtctcaaactcctgggctcaagcagtcctcctgccttggcttcccaaagtgctgggattacagacgtgagccaccacatgcagccatagttttaaaatttttgtagatatggcgtcttgctgtgttgcccaggctggtctcaaactcctggcctcaagtggttctcccacctgggtctcctaaagtgttgggattacaggcatgagccactatgcctggccgagaatttcagtctttatgtgaaatatatcctacaattacagacactcttaggatgttccttttcttgtctgaattcctatccctcaggagcctggaataaagctatattgagagttttctgtgtcttattgagaattttcacatagtcttattaaccgtcgttgcattctgctggttgatctattttagcacaactgttgaaataaatactgttcatttaatgccacatccttatctgaaaatcagttcaaggataagcacagctgagtcatttaagcttatatgagtacagtttttgaactttgtggattgtgctttaaactagtgtttagattctctgtaggtgcaaggcttctttcctcccttgctctcacacattctgtgcccttggctgcactaggttgcatatgcattattgaggttaatgggaagccaaatgcagagcagggagccacagtgagtagcagctctacgactcaatagcagtccgaccttggacggggttgcagcccgacagtgtattcattttttataatggaaacaatacttgcatgatagggttgttgagaggattaaacgatgtaacatatgtaagacactaacacctcttgatagaggcttggtaaatatttggcacctgttaatcctcagtttccccgtagggtaaatatgcttatccccacttttgtaaatggtggggggaggcaaggcttagagatcatttcacttgccttaggctggtgcttctcagttactggggactcttgttaaaatggagattttgattcagttagtctgaaactggggtccagtgtgttcatttctaacaagctcctccaccttaaataggaggctgtaggctacttcctaggaaatgggggagatgggcctcaaacccaggtttgctctactccaaagccttcccccgtcccatggagcctcccttattctcacttgtgcaacaggttttttgtttgtttgagatggagtctcgctctgtcgcccaggctggagtgcaatggtgcatctcggctcactgcaacctccgcctcccaggtccaagcgattctcctgcctcagcctcccaagtagctaggattgcagctgcctgccaccatgcccagctaatttttttgtatttttagtagagacggggttttgccatattggccaggctggtcttgaactcctgacctcaggtgatccatccgcctcggcctcccaaagtgctgagattacagctgtgagccaccgtgcccggccatgtaatggttttgttaagagacttatatgtagtttaatgattccttagattactaagatctaaagttacatttttttattcatttgctcagccttttcttagaactctttgtatgctgagttcccgttttaaagatctactttgaaagaagtaggactaagtgaaaacgggttaataacacttaatgttgtctgttggacaattacttgttgtctcatcatgttaaatactccacattgttcttctctctcccccgctcccccaccaaacttgcttctgctactcctgcctgccttttatttttgttagaacagtgtcatcagccgggtgcagtggctcacacctgtaatcctagcattttgggaggctgaggtgggtggattacttgaggtcaagagttgagaccagcctggccaacatggtgaaacctcatctctactaaaaatacaaaaaattagccagacatggtggcgggcacctgtaatcccagctattcaggaggctgaggcaggagaatcgcttgaacccgggaggcagaggttgcagtgagctgagatcacacattgcactccagcctgggtaagaagatctcaaaaaaagaaagtgtcatcatctactagattggaaatatcagatattcttgagtctttcttctccctcatatacagttagtcatccagttcttcaaaatctcgttgaaatgtggcttcccctccagccagtctactgcctatcagtacttacctgtctgtgcattagcccccaccgacctctatcccaccagcatctccctgtggcgctgtgcagtctcgctgttggtcaccttcctcatcagaacaagcctgagtgtgccacactcctctccagaagccctgtggtcttgatagagagaggcaaatagggtggctcaaagaacagacttgaactagactgcctgggctcctgtcctccctccacaactcaccagccacaaataatgagaaaggtacatttgctagggaaaacatttaaatacaaatactcatcttgatgtgtttaaacatgttgagacagttctgtctgaggtgaggaacaaattaaggatagatacattggtttcttattaatttagtgtttaagacagtgcttatttccttggggaaaaatactgtaaagaaaaagaaaacacctggtacggtgagtcacgcctgttaatcccagcactttgggaggccaaggcgagtggatcatgaggtcaggagatggagaccatcctggctaacacggtgaaaccccttctctactaaaaatacaaaaaattagccgggcgtggtggtgggcacctgtagtcccagctactcaggaggctgaggcaggagaatggtgtgaacctgggaggtggagcttgcagtgagtggagatggtgccactgcactccagcctgggtgacagagtgagactctgtctcaaaaaaaaaaaaaaaaaggaaaaagaaatcttaatcatacgatgctatatggctcagaagtgaataatatttacatgtatacgtatgtaactaacctgcacaatgtgcacatgtaccctaaaacttaaagtataataaaaaaaaatttacatggtcataatataatctctaaatagtgatttggccaacaatggtgatgtgattgtattccatggagaggaagaagaaacatgggggtgaggttgaaaatcctgatactccaatgtgagaaagtcatttgataatattcgaaactataaaatcaaatagtatatacaaatgttatatagatacaatgaattatcttccatgtgtttgaattatcttctatgggatctcacatttaagtagtcaagggtaaactctatggcttttagcaaattggagagtaacatatgtgttacattaatgttggatgttgagataattaaatccatgtcattcttttgtgagaacacattattttgcatgctgtaatagcacagtagtttggaataaggagctatttgacgtatcaggtccacctaagaaataagaagttaacttcatatcctattttgggcatagatttattttattattttaatttttttttttttttgagatgggtcttactctgtagcccaggctggagtgcaatgatgtgatctcgggtcactgcagtctccacttcccatgttcaagcgattctcctgcctcagcctctcgagtagctggggttacagttgtgtgccaccacacctggctagtttttgtatttttagtagagagacggggttttgccatattggctaggctggtctcgtactcctcacctcaagtgatctgcctgcctcggcctcccaaagtgctggatttacaggtgtgagccatggtgtccagccctgtgggggcacagatttagaagtacaaatactttttaagtgtttgagatgtaggtaaaatactactccttgttgtttgattaagtgatgccgtatcagactaaactctgtccttgtttttgtttttttctgatcaggttctggagttaacctgtctcacacgttaggtgagatttaattgattagccttctctttgagatagttgatgaaaggtgcttcatatcttagtaagtttttgttcgtgaatcctgagcacatgcacgtgttgtgttaaagaggcaagaaggaacagtagagcgaatccctgtgaaaagcatgcttttccccatgggtcacctagccagggctctgttggattggtgaacagcatgagagaaaaaaaagcactggacaatttgagctgcgtttggcaattgaggtggtgtttaaaggtgaactttattttactataaaagctttaatactggtattggtgagagcatgagggaaacaggtctgcttaggtgatggtagttagaaagtaactggatgcaacctttttgaaggatatttaagcattatatgtcaaaattaggtatacagccctttgaatagaagttccacttctagaaattgcaaacagatacttgaaaaagtataccaacagacatgtactgggatgtttattgtaactaatagcaaaacaaaacaaaacaaacagcagacaacagccttcctattcactaatggatatgaaattacggataggtaaattatggtatattgacattatacaagcactaaaaaaaggagcttagatctatatgtcctcaaacatatcctccctagatgcatgggcagaggtatttacagaacagtttgtacctacatgtctttgtgtatgtgatgacgtggatgtgtgtgtatataaacatctctatggaaagtgcataagcaatggtagtatctaggcagtgggactagaagttgcggggtggaaaggctattttaagccccagtcatgtttttaaaagacaagaaaaaaaaaaaaaaaggcctgcaactcaacacttgatctgatgaggttatttggttgtattgagggtgctcttgtgtctttcaggagggattctcctctgcactgtgccctctgattgcaccagcacatctcacatggtggcacctgagcctatcagttctacttgtctccgtggtgcaaacacgagagaaggaaactcaatagttttttcaccttttcaatgtcaagttttcttactatatatacatccactgttgtgtctaggtttgttttctgttgttttgctaaatagcttgatttttttcatattattcagttcttcaggaagtactactccttgtgagaaacttgatttttaatttccttctcatacttcataacaatacagccttcattcttattgttgatgcatatttaaatctaaacttctacttaagtgattaggttggtttcttttatactgtttatcacttcatatgtcctaattgtacctgacagatcatttcttaactgtatgttaatcatttctgttggtcttgagctagcagttttgctaatatggcagggtggctttttctctgagatctatcacctgttagtagtatgatgctgaaaatagctctaccactcttgttgtatcacattgcacacctagatacagtctactttcacctcccttgactttccagggttttcttgcttatttactcatattggtgtgattttcttatggtagggtgtttctttaacagcaatttttttccataaaataattcatttcttttgcttattttcactatgggtttttttaaaaagcagcattccagtttttgttgaaagttttttatcccacttctttcatcctaaatgttgataaagataataaatacaggcagcttataatagctatttgaacgtattatcaaataaggtattttcctgttaactacacttctgtatagtttttaagcagaatttcaatcaagaagacactatttttctatatctctttagattactttttgatttttttaaacactgtttatacaagtttttatcaaacttccaacagataatgggtactgcctctcataaatcttccaaagggacaatggaaactgggcccagttgaataaagccatattcatttgttttggaacgcagagttctctgcatgtagattgcatttagcattctgtctagtgtatccatctgtagttttgcttttttcagaataaaaccttgacagtaattttgaacctgttactttatttctttttgcatgtattgctttaaaaaggccgaagtctagtattctcttcccctttttaagttttatgaaatcaaggttaaattgatattagtgccacttaatatttgacacctgctatgcctaatgaacttgaagtagtaaagggagcagcaggggtcagccattcatattatgcaagataactggagaacgagcagactatgattagagctttagactagtgggttctaacctctttataagagcaaattcattatttatatgtgcatatgtgttaccttttcctttttcctctggatttataggtatttgagtttcaagaattttcttgagattatattatagaagtcattaagatggggaatcaatctctagagacataaactggtaattatccagtgtagggaaggaaaggaagatgaggcatggtctggtttgtggacctgggtcttcgagtaagtggctccatgactttggggtgcgctgaatgtaatgtaagaggaaggggatgatggcatatctggcatctcttcctgcacattttttatgatccattattcacactttgatcatctttatctgctgaatgggtaccgcagcttggtatttattaattatcacccaccactctacagaggtaactatttgtcactatgaagaatgccaaagaaaatatttcctcgtaaaatttaactgcttactgtgaatgattcataaatgcctgattaaaaggtctgtgaatagagatttttatgcactgacttagctaaatgctatcttcattgagtggcattgcagtctatatgtcaagttagagtaaaaactgtatttaaaatggaaaaacagaaaagggccaggcaaggtgactcacacctataatcccagcactttgggagcctgaggtagaaggatcactcgagaccagtagattgagactagtctgggcaacataaggagacctcatctatacaaaaaataaaaaatgagccggatgtgctgatgcatgcctgtaatccaagctactggggtgggtgaggtgggaggatcatttgaacctgggagggtcgaggctgccgtgagctgagccgggatctcgccactggactccagcctgggcaacagagtgagaccctgtttcaatcaatcagtaaataaataaatacaatgaaaataaaatgaaaaatggaagcagtgttcttaaagattttgttttttttttgagacggagtctcactctgttacccaggctggtgtgcagtggtgtgatctcggctcactgcaacgtctgcctcctagattcaagcgattctcctgcctcagcctctagagtagctgggattacagatgcccgccaccacgtccagctaattttttgtgttttttagtagagacggggtttcgccacattggaggctggtcttgaactcctaacctcagatgatctacctgccttgaatcccaaagtgctgggattacaggcatgagccacgacgcccagccaagatttttcaaagaacactggaaacttgaataccaaaggcactacatagatactccataaagtcatattaaatttagctttttattgagaagttgctttgtgttgagcactttgagtggtatagcaaagacacataccgcccaaaaggggaagtaggattttttctgttgtttttttctgagacagagtcttgctttgttgcccaggctggagtgcagtggcgcgatctcaactcactgcaagctccacgccattctcctgcctcagcctcccaagtagttgggactacaggcacccggctaatttttttgtatttttagtagagacggggtttcactgtgttagccaggatggtctcgatctcctgacctcgtgatccacccgccttgacctcccaaagtgctgcgattacaggtgtgagccaccgtgcctggcctagtaggatgtttttaaatagatattttggggagagggagttggggggaagaaataaatagatgttttcattaggattttgcagagggccacctgattatttgtatgtctttgtatcatttacggggaaattatatgttgcctatgacttggaagttttcaaggtgagttgctattgtcatttttaaggttgtgatttgttttccttgtcttgccagcctcctgtgattaggtaggttctgcctttggaatgacaaggttcttcctgcatgtttttctcatgtgcgcaatggtttcgtctcccctccacccttagaatttgcaggtctaggtcttccgcctgtgcttcccttcatgctatagcccccatgtgacaggtgctagagactgtgtgacagccataactaaatgccacttgggacttctgcacagcatgtcagatgcacagctcattgtttgcctccaggcctacagttaaccaggaaagatttttgttgtctaattattttataatttcctgagagcagaaaaagtggattttaattaagtaccagatgtcttttaaggtcctaccttctaaaagttttccaaaaagtttttaaaacaatttttctagatttggaatttcattgtggacttgttaatatctctgaagtgtctcatgtcttgagaatcttgcaggactttattctctgcggttcagtccaagtttgcagattttaaactgaatgcttgactagctgatggttatttgacagtgagtgtcaatctttccatagaagtaggatgtactttgagaaaagaagttaaaaaaaaaaaatgatgggtatgggccgggcgtggtggctcaggcctgtaatgccagcactttgggaggctgaggccagtggatcacctgaggtcaggagtttgagaccagcctggccaacatggtgaaaccccatctctactaaaaatacaaaaaattagccgggtatggtggtgtgtgcctgtaatcccagctactcgggaggctgaggcaggagaatcacttgaacccgggaggtggaggttgcagtgggccaagatcatgccattgcactccagcttgggcaacaagagcaaaaactccgtctcaaaaaaaaaaaaaaaaaagatgggattagatatgaaacaaaagcacatcatttatttatttagagacaaggtcttgttctgttgctcaggctggagtgcagtggcgtgacatggttcactgcaaccttgacctcctgggctcaagcgatcctcccgagtagctgggactacaggcgcatgccaccatgcccagctaatttttttattttttgtagagatggtgtttcaccatattgcccaagctggtatcagagttctaagctcaaaagatctgcctgctttcacctcctaaaatgttggaattacaggcgtgagccactgcacctggtcccatttattattttatttttttgagacagagtctctgttgccagactggagtgcagtggcacgatctcagctcaccacaacctctgcctcccaggctcaagcagttctcctgcctcagcctcccaagtagctgggattataggtgtgtgcctccatgccctgctcatttttgtatttttagtagagacagggttttgccatgtcaggctagtcttgaactcctgacctcaggtgatccacctgcctcggcctcccaaagtgccgggagtacaggtgtgaactactgtgccaggcccaaaagtaggcttttgattaaccctttaggagttaagagagtaatatactatttagctaatatactgctaatttatatacatgcatttgtacattatgtaaatttgtaattttcagttgcaagtaagcaaatatgcactattgccataaaacagcaaagcagtcaagtttgtttattaaggagctattgatatttcatcgatagccttctagcttctaaatattttaaagtgcgtaactgaagttggaatttctctcaaaatcttattttttgttttgactatatttccttgctctcaagatggtatcattatttttccctatttcccttcacttttctctctctgaaactgtttctgcagttggatcatttctgactttgactatctgactttgtaaatctgcttttaaaaatattttgttggggatgggggtgtggtacttagatttcttatctttctgataaacctgtcttaaaatgtttctatgagtcttaatttttctttgaaaattttttactctattatttggaagtctggaggaataatacattcagggaaaagccaagttatagtgatgattttcctatttaagtaacatttacttggtttttgcctatgtttggcttgtgacatagaaactctaaatgaagcataacactagagaagaaaaatttcctctcctaaggctagactgatttagtctgctaggtggtaatgaacatgcttgccatttaaccttactcgtaccagttgactctgtaaaattttaaaactgtatgttactctttactcctaagataatgggtctttaaatattcagggtaccatagtaagttgccagatatttttttgcttctgggcaatacatatttattttgaaatggctatttttaaataagtgatacttcccttattcagaagctgtttgacagctttagccaactaatttagttgtaaacctgctaaaagttacatattttattgattggagagtgtctttcttaggacatatttacccttttttttttaaacataaagtaatctcatgaacttcagttatctgatttttctagcctactatagatacattttaaaggatagtagcccagtgtcatctcccaaacatagctaaaggttaagaacaaagagaaactaggaaaagaacctctcaatgcaaggactttagcataacagtatgggaaattttctacagcaaaaaataagtatattccttatttgttcctaagggtatccttgtattttgtagtacagtatagcaactattattcataatgatgacccagcatcaagaaagggtgtagttggctggatgcggtgggtcatacctgtaatcccagcactttgggaggccgaggtgggtggatcacctgaggtcaagagtttgagaccagcctggacaatatggcaaaaccctgtctctactaaaaatacaaaaattagccgggcgtggtggtgtgcacctgtaatcccagctactcaggaggctgaggaaggagaatcgcttgaacccaggaggtggaggtttcagtgagccaagattgtgctaccgcacaccagcctgtgcgatgggagcaagactccatctcaaaaaaaaaagaaaggttgaggccgggtgcggtggctcatgcctataatcccagcattttgggaggccgaggcgggcggatcacgagatcaggagattgagaccatcctggctacggtgaaaccccgtctctaccaaaaatacaaaaaattagcttggcctggtggcgggcgcctgtagtcccagctgcttgggaggctgaggcaggaggatggcgtgaacctgggaggcggagcttgcagtgagcccagatcacacccctacactccagtctgggcaacaaagcaagactccgtctcaaaaaaaaaaaaaaaaaggtgtagcatgtttttttagtattctgcttaagaatgtaggaaaaaaactaacacacacacacactacatttataaactttgaattttagttttgtggcaattcatttaggtaaagtgtgtgtgtgttttttttttttgtttgtttttgtttttggagacaatctcgctctgtaacccaggctgagtacaatggcatgatctcggctcactgcaatctctgcctccctgttcaagcagttctactgtgttagcctcccaagtagctgggattacaggcacgtgccaccatgcccagctaatgtttgcatttttactagaggtggggtttcaccatgttggccaggctggtcttgaactcctgacctcatgatccgcccaccttggcctcccaaagtgctgggattataggcgtgagctaccatgcccggcctatttatttttacattaaaaaaattaagttcctgttgtgtcagctgctgggcctggtacctttggatatacagtatttcatttaattttccacaattctgtgagtgaggtaatgtcccttccctgcatcccctccccctttgtttagagattaagaaacaggctcagatttagccaggtgcggtggcgcatgcctgtaatcccagctatataggaggttgaggcaggagactctcttgaactggggaggcagaggttgcggtgagccaagatggcaccattgcactccagcctgggcaacaagagtgaaactccgtctcaaaaaaaaataaaaaattaaaaaagaggctcagatttaattgatttataagttgactatttttttttttgagagagtcttgctctgtcacccaggctggagggcagtggcacaatctcggctcaccgcaacctccacctcccgggttcaagccattctcctgcctcagcctcccaagtagctgggattacaagcgcccgccaccacgcccagctaatttgttttgtatttttagtagagacggggtttcactattttggccaggctggtctcaaactcctgaccttgtgatccacccgccttggcctcccaaagtgctgggattacaggcgtgagccaccatgcccagcctataagttgacttctttaagtcatgagttttccagctgtttataatatattgccacttggtttatccactgataacctcaaatttagtgttttcaaaagtaaacttactaatagtgtctttcattacaaaactgattcctgctgtcctgtgtttcactttgccattaatagtatcaccgttggctgggcgcagtggctcacgcctgtagtattttgggaggccaaggtaggcggatcacctgaggtcaggagttcaatcccagcctggccaacatggtgaaatacaaaaatctaaaaatacaaaaattagccatgcatggtggcaggcacctgtaatcccagctgcttgggaggctgaggcaggagaatcgcttcaacctgggaggcggaggttgtagggagccgagaccacaccattgcattctagcctgggcaacaagagcaaaactccatctttaaaaaaaatatatatataagtgtgtgtatatatatgtgtatatatacatacatatatatacacacgtatatatacatacatatatacacgtatgtatacatatacacgtgtatatatatacgtgtgtatatatacgtgtgtatgtatacgtgtgtatatatatatgtggtatcactttacctgtctgagaggctaaaattaaggtctcagactggcaacttcattcatgtgttcatcttatttttaaatttatttgtttttaagctacagggtctatgtttgtcacccaggctggagttcagtagtgtcatcatagcttactacagactcaaactcctgggctccagcaatcctcttgcctcagccgtcaaagtagctgggactacaggctcgtaccaccctgcccagctaattttttggtgttttttgtagtgatgggggtctcactatgttgcccatgctggtctctaacttaactcctgggctcatgtgatcctcccctgtcagccttccgattagctaggagtataagcacgtaccaccatacctggctaatgtttaaaaattttgtttttgtggagactgggttttgttatgttgcccaggctggtctcggactcctggcctcaagcaatctttctgcccttgcttcccaaagtgttgggattaaataggtatgaaccactacacccggcctcatgttcatttgtagtctactgtttgctgggtactcttctgtgaacaaaataaacaattcctgctcttacggagcttgcactgcagtaggagataaaagtaaaatacatagtatattgcatggtgggaatgttaggagtaagtggttgtaaataggatatcccagaaggcctcactgagagggagacattggagcacatatactttgtttacacttagaaatttagagcttgaattagaaattagaagattgatttggagatctgcttttttgttttgtcatgaaaattagacattgtagcaacgttggagctttctactggctctgccaggtctgttcagctgtgaaggcctgtgagggctctgtttaatgtcccatgattcatgtggctgttatcttagttgaggtcttgaatatttctttcctactcttttgctttaactctgcttattcccaccttcagccagtcctacacaccacagttgggttatctttgtaaagcacaggtagatgcactgtgcatggaatactgtttccctgtttgccagataaaatccacacttcggagccctccgtaatctggtcttggcctactttctagtattccctagggtccactcatcaaaataaaaatgtattgttctcagtttcctgaatcagttctatactaaatctttgcattaaattccttctcccacctcgacatgtccaaatcacactctgtttaggacattttgtaagtccttaccttccatagcagaccatccctatccctccctccgggctggaagaaatctctcctactctaagctatagtattactttatgcaaactctttctgtacttcttaatgaacagatctcgtgttcccttgctagacttcaaacttctggaaggcagtctctgtgtaagagtagtttttgtggctgggcgtggtggctcatgcctataaccctagcactttgggaggctgaggcgaacggatcacttgaggtcaggagttcaagaccagcctggccaatatggtgaaactccgtctctactgaaaatacaaaaattagccaggtgtggtgccaggcgcctgtaatcccagctactcgggaggccgaggcaggagaatggcttgaacctgggaggcggagattgcagtgagctgagatcaggccactgcactccagccttggcgacagagtgagactccgtctcaaaaaaaaaaaagggtcttgctatgttgcccaggctggtctcaaactcctgggctcaaaacaatcctcccacctcagcctcctgaagtgctaggataacagttgtgagccactgcaatggtccctaaatctttatacatatggatttcatcactgatagcagcccacttcccattgtcttttctcaatgccacttttctttttttctttacttagcaaacctttcccaagataatgctcattttctgaatagcttttatttctgccattcaatttctcttttgaataaaaggcttccccctcttcatttgaagaacattaaaaacccttaaaaattttttcagcttcttatttcaatcaggagcctttctattggacatgaccatttttccttgtagtttaagagctttggttagcatgttgcctagaggctgtttgtcatggatatacagacacatgcttgtcttccttccatgtgattgtatttttcatagacatccttatgaaaccacttgaacttgtttccttcagaatgttagcagagtatgcttctctttcaatgtaaagtctttggtttttttgtttttgtttttgttttgttttgttttttgagacggagtttcattcttgttgcccaggctggagtgcaatggtgtgatctcagctcaccgtaactttggctcaccgtaatctccgcctcccgagtagctgggattacaggcatgtgccacaacgcctggctaatttcgtatttttagtagggacggggtttctccatgctggtcaggctggtctcaaactcccgacctcaggaggtgtgagccacctcacccagccagtctttgctttcttaaatactggatcacttgctattttttgtcttcttcaaactgtcgcacctcaggaaaacttaacattgtttcataaatgttcaagagaggccaggcatgggcctcattaatagtatcacctttagctgggcgtggtggctcactcccataatcccaacactttgggaggctgaggcaggtggatcacaaggtcaggaattcaagaccagcttgaccaacatggtgaaaccccgtctctactaaaaatacaaaaattagccgggtgtggtggtgtgcacctgtaatcccagctactcgggagactgaggcaggagaatcgcttgaacctgggaggccgaggttgtggtgagctgagatcgtgcgactgcactccagcctgggtggcagagcaagactccatctcaaaaaaaaaaaaaaaaaaaagttcaagagagctctagtagctaaattctagttctagttcttgttcttagctctagtagctaagctttatgcctctacaaagctaaacttttgatgataactatgttattaggttttaaagaacttttactgtattatggaaaacttaaatgtaaaacaaaaatagtgagaacagtgtaacaaatcatgtgccgctgggactcgatcattaacataggattcaatcattaacgttgctggccctctactgtttcttctacacctcttctacccacactgggttatttactagcaaatcctagaaacatttttattagtaaatatttccatttatgtctctaaaagagaaggattccttgtaaacatatcccccccaaagcactatttttgtgatacttacatattaatggattaacagacatatcttttttttttttttttttttttttttaccaaaaaacaaaaaaccaggtagtgaaaattgccaagtttcttcagctttcctagtgtgactcatctccaggagagtaggaagcaggtgggtctgaacacagaaatccacacgacttgcttctgccctctgcacagaagcgcgttctttatgccaggacctcattcccttccacacagctcagggagggcactcttttattttatgaacttgttatcagtaaatttaggactcagtggtccctgaatccttggtccttgacctgttattgtcagtccttaaggcccagacatcgcctttggcttcctttctggaaaatttcagaactgtataaaaatcacttgtaaaactctgacagacacattttgccaagaatgtcatttatctcttgacagtttggcatttgcctttaaatattagattgtgtaatcataatggcattccaggaaaataatgtggtaggtggctggcactttaaaaagtgaaatggacttgggttcttgggaatgttaatcattattctacacaaaatggtgataccccttaatagtgaaatgctaagtgggtataaagcagtatttgtgaataagatcaaaaaagatgagtataaaatgtgatttatgggtttatttaatgagtttttaccagaacaatgtctgaaggatattttatatttttaagctgtgaaacagagaaagtaatgaggaatcttctagtgagtcccaccagtctcccagcctgaccagcacatccagaaatcgatcattatttttgttattttaacctgccttcttagtgccttccttgcccttgactttgcagcagagaggagaaagaaactcgtggtctctcccataaatacacgtggtaacagcagtgaagtaattattatatattttgtggcaagtcattcattcagtggtgatggaatggcttatttttaatgcagtgtttttctttggactaaacctaaattcttttttctatctcatttagtgcctgtccattccaaggcagcataaagttagcatagcttctcattttactggtttggtaaaagttttaaaggtttagttcagtttgcttttgggttttcatatgaggtagactatgagaactctttaatttatgatgtgatatataattaaagacaatcccattgtagctggcatgtgggctattactggggatcatgggaaagagaaggcttggaggatcttctttataaaatacacgtaagtatggactgaattccaaacaaaccgcaaaatggaaggaacctcgttttatcgcatccaggtaaaggatagaaaaggtatcttcagttttcccagaagcaacatccacaaggacaactcgtaattttaaatgattaaaagtaattgcagtagatcagtgtcattcatagcaaattagttctgattgatggagaatgctgcatctgtggatttttatgttataaaattaatttaagacttcttttgttaaactcgtttaatcttctgcactactccgttctttcattatccttgtcagttttaagggctggaatatctttgtacaactaaattcagttgacttcttctggatacccaagttgaacagacacatatattagtggagctctggttggaaagaggacaccagtacacactattagtagcctactgcatgtggtttgtgttttttgcctttttttttttttaagagaagttctctctctctcaggctggagtggagtggcacaatcatagctcactgcagcctcaaactcctaggctcaaacaatcttcctgccttaggccttccaaagtgctgggattataggcatgagccagtgcagccagccacctattgtataaatggcttataagtcatttcacctggctaggcatggtggctcacgcctataatcccagcactctgggaagccgaggtgggaggatcacttgagcccaagagttcaagaccagcatgggcaaagagagagaccctgtctctacaaaaactaaaaatattagctgggtgtggtggtgcctgctgtaggcccagctagggggaagtagaggtgggaggatcactgggaggtagagactgcagtgagccgtgatcatgctactgcactgtagcctgaatgacagagtgagaccctatctcaaaaaaaaaaaaaaaaaatagtaattcgttgaaccagtttcttattgataaatgtttagaccgtttccatttttaaacttcaaatattccaggaaacatatatgcagatttatcagaaacacttatttttgtaaactttttattaaagaataacatatatacaaaaagtagagaaattttttttttttttttttgagatggagtcttgctctgtcgcccaggctggaatgcagtggcacattcttggctcactgcaagctccacctcccgtgttcatgccattctcctgcctcagcctcccaagtagctgggactacaggcacccgccaccatgctcggctaattttttgtatttttagtagagacggggtttcaccgtgttaaccaggatggtctcgatctcctgacctcgtgatccacctgcatcggccccccaaagtgttgggattacaggtgtgagccaccgcgcctggccaaagtacagaaatttttattatttttttatttagttttttgagacagagtcacactctgtcacccaggctggactgcagtggtgcaattttggctcactgcaacctctgcctcctgggttcaagcgtttctcctgcttcagcctcccaagttgttgggattataggcgcataccaccatgcctggctaatttttgtagagaaattatttttgtagttcattgatgaaatctgtaaaacccatacattatgtgtatcaattcattcttttttctttttttaagttatatttttttgagacggagtctcactctgttgcccaggctggagtacagtggtgcaatctcagctcactgcaacttctgccttccggattcaagcgattctcctgcttcagcctcctgaatagctgggactacaggcacccgccaccacgcccagctaatttttgtgtttttagtagagatagggtttcgccatgttggccaggctggtcgcaaactcctgatctcaagtgatccgcctgccctggctccccacagtgctgggattacaggcgtgagccactgtgcccagcctatttttcttttttaatgctttgtaattttattttgggtgactatactacagcttattctttttgccattgatgaacgtttggattgtctctaatttttggatgttacaaatagtcctgtgaacattcttaaacatcggtttcggtgaatgtaactatccatatgtattgggcgtatctccgggagtagcgctgacaggcatagggtatgcatatgtgcaggtttagtactgccaacagtttttcaaagtgggtgaaaccatatcacactctcaccagcagtgtctatttttaaaaaaataacttcatataagtgaaatttgaataaaagagtaaattcattttaagttttggaatatagtgctggatttgtcctcagaagtactaattcgtactccactgaacactagattttatccagctctttcgttgttttcattgtttatagtgaagaaatatctttttaaacttctttaatgaattggacttttttatacttcagttttacccatttccgttttcttgacttggatgttctggctttttctttgttggggtatttgtatttttttcttgctgctttgtaataacttatttttaaaatccacatttttgtcttcctagtttatcatttgtcttttacactatggaagtgttttccatgtctgttttctttaagggctgtattgttgatatttaattttattttaactggatttgcctttttttacgtgacacaaggatgctttttttaaaaaagttttaaaacattttaagcatgttatgcttttacttattacattaacgttaactttggaatattttgcaggatgtcagagggtgactggtcagagtaggcatgcatgtgtcatttgaccaagcaagaaataaagccagttttcctatgtggacagtattgaatcattttagtgtgcatgtttctaaggtagtaagttatcgtttagaaaagaattagatcaaattagcctagactgaactatcttatttaaatatctcttgtggatgctcagggctcttgagcaaggactttaccaaaattacacctggcctcttgcagtcagttctgtgtctcattggacacgggcttggagtgccaaatatttaatttcaaatctttaaaaatatttattctctatgagattattaaaactttttaaatgtttctgttttgtattaacagtatataatttgcactgctgatggagaaatatgagaccaatctattgtgttttcctttttaatgttacagtgggatttgagagcttcccaaagcctctgtcacctaaaattcctactgagaatcatttttggattttaccgcaaagcagatacatagaacagattttaaacgagtagtcctctcttctaatatgaattaatttggtttctagaattgaatcttagcaccttaaaggggcaagaatctcaggggtaggtaagttttagaggaagggagcacagccatgttacccctctgtgattagagccctggagcataccaaaccttgaggcaagtctgaagaaggtggagtttggggggcagtgaaaacagatgctatggataagatctgaaaaaatttttttttgttttgttggtcttttgcatttggcagtactgcttgtggcaaggttgtatcattaactgtgttgattattccataagccaaggagacaattgtgggaactctccttagtaaatccctcgttttaggagcatagcatttccagtttaggggaatttgtattttgctgaacatttgaatttgactaaagggaatactgggtttatatgacaggctcattagggatagattgaggaggagagggtagaaagggagagaaaagctaaaattaagcgcctatttttcatgtatattttttattttatttttgagactgagtctcaccctatcacccaggctggagtgcagtgatgtgatctcggctcactgcaacctccacctcccaacttcaagcaattcttttgcctcggcctcctgagtagctgggactacaggcatgcatcaccatgcctgggtaatttttgtattttttagtagagatggggtttcaccatataggccacgctggtctcgaactcctgacctcaggtgatccacccgcctaggcctcccaaactgttgggattacaggcgtgagccgctgcgtctggccagttttttatgtatataggcaaaatgcagtcttacacattttacatgtttaacctgtctaatcctcacagaaatcctatgaaatgctgttttcccaatttgcaaagagaaaacaaagactcagggagtaaactgacattattttggctaggctcaaaaactcagtaaatggcattcctgggatttgaacggccgtctctgaatccaaagctcatgcatatcttcttacaagagtatatattgcctcctcctaaactaccagaattattatgtatattttatcaatgtcatgccaaattttggtaacactttaagtggcatatgcctggggtgttattggtaattctgccagatactgtaaagcctgtgtaatttcctttaccgtccaccttagcatcgagagtaaacatgaggttacgatcctgggaggacttaatgaatttgtagtgaagttttatggaccacaaggaagtaagtacatgtgttggtatgtgttcttctattacagtcttttactctgtttcttaatagaatatcaaagacagatggtagcatgcgtagtttctgaaaagcaagtttagttggactgcagaaccagtgaggaaatctttctcttatcacaatcactttatatacagtcatcccttgatatctgtaggggattggttccaggaccacctcataccaaaatccacagatgctcaagtccctttataagatgacatagaatttgcatgtaacctacacacatcctcccatgtcctttaaatcacatctagattacttgtaatagctaacacaacgcaaatgttatgtaaatagttgttatactgtattttatttatttatttatttattaagtgatggagtctcactctgtcacccaggctggagtgcagtggcacgattgtggcttaccgtaacctccacttcctgggttcaagcaattcttctgcctcagccttcgaagtagctgggactataggtgcctgccaccacgcccagctcatttctgtattttagtagagacagggtttcaccatgttggccaggctggtctcgcactcctgacctcaggtgatccacccgcctcagcctcccaaagtgctgggattacaggcatgagccccaccgcacttgtcctttttggtattttttttgtgttatttttaattgtattgttatttattattgtttggatttttttctctaatatttttgatctgtggttggttgaatccaggggtgtggaacctgcagatatagagggctgactgtagttttctctttatctctatgtgacagtactagacatgaattgtaaattctgggttttgttatggatggccacgtgaatggtttccaggaaatgttttttgttgttttctttttggccttggaggggggatgaatatggggtttattgagataggagggaaagtaacatggctattacttaccaaataattgaatagtgtttagtacttttgaagaatcaagtaaattgcagaatgaatctgcttattttttaactctggatctttccaagaaaagtatcttaatctgaacgtggtacacctattgattgtagtaggtccctgactcttgaaggaattaatttggaaggttttcagaagattaggggataatgtttaatttacactcagatttattttctaatttggagatgtagttctgatgaacatttttacttttatttcagcaccatatgaaggcggagtatggaaagttagagtggacctacctgataaataccctttcaaatctccatctataggtatgttactacttggtttttctccttagagagttttgaaatctaagggggaaaaatcttacatttcaggggaggtaattaatgccagaaatggctgtctaattgaatttttccttttttggctttggttaattaatcagtgacttttggggggaacttctatagtgtgttagaagacgtttaaatatactctttgcataattataatgaccattactttagatttttgtcttttggtgtcagattaaaccagctttaaggccccactgttctttaagctgttagcaggaaaataataaacatatcttaagtctaattttgaatgccagattgcaagaatgaatgttacatagtatgtgttttaatcctatcattttcagaaattctccctagatcctactttgcttttttgttcactccaactctgggtaccttacaattaaatgaccctttgcagtcttcccacctccagtctctttagccccctaaacagcagaagaaagaatagaaacctcagtggggttgtacaaagaggtactttctcctcaccttcatctccttttaccttaatgggtgatgttatttacctgtcacccccattgaggcactcagtgacagatctatctgattgaaggtggacacctttaaatatttggagactgtagaatggtagtaatttagttaatttaagccagcttttttttttttttgcttcactttatacatgtctaaaatattataaaatattgaacaattttaagtaagaacaataaaattgtaatatattgagcattctctgagaatcagactaagcctcatgttcagaattgccagagttcaaacattttgctactgctgtgggctttttttttttttttttttttttgagacggagtctcactctgtcgcccaggctggagtgcagtggcacgatctcgactcactgcaaggtccgcctcctgggttcacgccattcttctgcctcagcctcccgagtagctggcactacaggtgcctgccaccacacccggctaattttttgtatttttagtagagacggggttccactgtgttagccaggatggtcttgatctcctgacctcgtgatccgccagcctcggcctcccaaagtgctggaattacaggcgtgagccattgcgcctggctgctgtgggctgtcttaagaagtaatgcccgatatcctggagtctagaccactccccactacacccccactcctaaccagttgaatcagaaatttctttcttgctataggggcctctaagtttcagcgttgtgaatggtaaagtgggagtggagctgtgaggtgttgagcctttgagacagcccccgagcacatctgacttagcacctgtataggtgtagaaacgtatacgcctgtacaccttctccttttgagagggcttttctgttgtgttgtggttccctgtccccagtttattcatcttctaactttagggtgtttctgtctactcagccatttaaaactcttatgttggttagtgataggactttaaagcctttatagaagtccatgcaagttcattcagatacatttcataaatacctgtttacctaaaggctaaaaactggcatgctaagtctagttttgttaaccccacattcctagtcagaaaggaaacaatagagcttgttgaaactaagagtgaacttatagaaatgcaatttcatatcctgtagaaatgttatttctcagaccttaatgtatttttctagataatatgattatctcatcataactttctaggtaataatgtctaaactttaggcattgcttgtttattaactaatgacacaaaaagcctccacgctttcttaaattaatgatgcaatatgaaatttggttgggacaaatgactaagctaatttaacttcttcataattgtttcttttgcctttctgtgtgctttcaggacttgataatgcctacaaatgtgtatcatcttctgtttggaaagtagatttagctgaaatatttgtacaagctgttcttgtttcctctagaggaaggttgcataagagagtttcaatcagttgtgcggggtgacccattttcaggtcatcaacagtgtaattactgttgagatgtgctttaagcattcagaaaggttgtggctcacttagaaaaggcaaggattcctttttgagttgtgtagatagttgtaaaattatacagaagggcgaggaggtaagatcaacccaatctcaacattctttttaaatcttgcccctgttgtatctgggtaggtgtagtgttcttcctgagccaaattttgagcttttaaacaatcagctgtgcaaatttagatcaaacatctttaatgcttggctcttggaattttgcagtgtctatgtactttgttctattttgtgtgtttgtgtatggatgtgtattttaattgtataaatgacccatatccattagagcaatgtaagaaaatctgtaagccaaagtaaagaaaaatcaaaatgtctcataatcttatcccttaaagggtgtcattatttacattctggaatatgctctttaagacatttctctctgaatatttaaatatatatattcaatataatgtgatatgcttatctttgggacactctccaaatatagttttagagggctgtcagtagttacatgattgcatgagatgtccctttaaaacaatttgcatctataaatgagtgggtattcgaaatagtggcatagctactttttggaaagaaaaggaatataggtagacaccttgggaggttatgaacttattcttatgatgccattattgtttcaaacactttgagctcttttttttggaattttacttctgtttcagtatcataagtgatggcaaatcttgatgctttgaagctggatgtgaatttttgaaatggctaacagtcatttaagcccaaagaataagatgaatggaaaaacgagtaatatcaattggggtataaaaccggccctctaggcactttgaaaagagtaaaagatataaaactcctttaatcaactataacatcgctgaatatttgcataattttccagagagactgctttgagatgaatcatatttgaatctttttctgatttacttgaaaattcagactttcatatttttcattcagaaacattagttcctagagtgcttagcaatactgctgggtgttactgtgtaggagttaggagagtgtgattggtcagtggactggttatcagggtagagaagttctggccctggttctccttgaccatgagagagatatgcagctgacccattgttttctctgctagaaaatgagatactagaattaaacagattctgcatgtttgatatgaccagtgtattaaaactcggggtacctggcatcctgctggacatgacgaaggctacagaagatctttactggttaggagagaagaagaatgtaaataaaatactacgtgtacttaatggcatggttccattgttttttaggagaggtgtgagtcagcacctcaatttagaagagagagcgtaaggaagacataagtttctacaagagagattgtcttcacaaaagcttcagagttgttgaggtgtgcatgaggactttagagatactcattcagaaccccaagtaatccccagttcatgaagattttgttttatgcaaagaaattgctgcagagactgccatagctcacacttctcgaggttcacagtttttagcctttgatacttgtgctcagctgttaagtgaaagctttcaccaaacagacttgcagttacagtgtgggtgaaataaagatgaatgatctcatagaagagggtaatacagagtaatttttaataaaaaaaaataagcagaggatacaaaatggttttatgtctaatccaaaagaatgcagattaaaacgaaagtacagtatatgatttgtcaaactggcagataaaacagtgttggaaaaggtattatgatacagccagtctaccactatgtattgcttggtaaatattttatatccttcaaataattttatttaaaaagttaaaaattatctaaagaaatatttagaaatgtgcactgtcaaaagaatacgtaaattttagtgttataatacttaaaagtcagaagcaacctaaatgacccagtcggtgataaagtagctaagtgatagtgcatcttagtggataaaatgttttacccattagtcatgttttaacacctctttgaagggacacacaggaaaatgttttttatatagtacaactctaattttttcctatacatttcacatttgaatgccaaactattgatgttatccatagctgttcagttaaaggagactaaaaacatacttttctgtaatttccaaatagtctacaatgtttgcttttattataaaagtaaatatttttaatcatattgcaaatgtatgtcttttgactgtcctgtctgtatcattgtctgagtctacactttgctgtcttttgctctagaaagccatcaggcttggccagaattccctgtggtagcttgctcaggacctgcctaacccacgtgtttcccagcagcctcccttcttttttcctttaaattttaattatgtgtgtgtataagtgcacacactgttttccttcctttgttttctgcttagagtttagagtttagtccatctcagatactgtctttacgcgcaactttcttcacttctttcttccccctttttctcttctcttgggtggttacctcaagtacttctcacctttttcttttctgcctgactcttccacttcccccttccgttgttgcatttttctcttcatatgaactgaaaaatgcccctctttagagctaataatcataatggggatacttttgataagcctaagccaagggaaaaaaaatataaaagtcttctaataaaagatacagggccgggtgtggtggctcacgccagtaatcccaacactttgggaggccgaggcgggtggatcatgacctcaggagattgagaccatcctggctaacacagtgaaaccccgtctctactaaaaatacaaaaaattagctgggcgtggtggcgggcacctgtagtcccagctactcaggaggctgaggcaggagaatggcgtgaacctaggaggcgtagcctgcagggagccaagatcgtgccactgcactccagcctgggcaacagagcgagactctgtctcaaaaaaaaaaaaaaaattatatatataaaaaaaattaaattcagggcttatagccactaaagatcttgcaacatccagaagttctcttctggatctattatattctccttcatatcatatctactttacttaaacactagcattccagataaaattaagatgtcattttatcttacatttaaatgattattggctactattaacagaattgtatcctaatttcagatagaactatagaatattttagaatcttttgtaaataactttaagagcagcctaggaaccctgtcatcatttatacttcttaaaaattagaaaactgtgttataaggtacaggtaacaagttgagaaaccaatttgtgaaatgctaccgatctatatctacatattttcagtgaggaggaccctctactaggagcaggctgtatgcattgcctctgggttgcaatttgatgataccaaagctgggaaggtaagagaaatggttgagaacaggattctggagggactgctgaatggtttgctgaatgttggtagaatggtcaggtacaaaaccagcaagctcgtgctgccatagaacttgatgtgaggccgagcgcagtggctcatcctgtaatcccagcattttggggaggccgaagtgggcacatcactggagacaaggggtttgagaccaccctgagcaatatggagaaaccccatctctaaaaaaaaaaatacaaaaattagctgggcatggtggtgtatacctttagttccagctactcgggaggctgaggtgggagaatcacttgagcccaggaggcagaggttgcagtgtgctgagatagcatcactgcactccagcctgggtgacagagtgaaaccggtctcaagaaattaaaaaaaaaaaaaaaaaaaagaatttgatgttagtggcatgaagcaagaacttgccaaacccatttgagtaaatggagacaaaatgaaaaagtcatgggcaatacaatagttaaaatactctgagctggctgggcgtggtggctcatgcctgtaatcccagcactttgggaggctgaggcgggtggatcacgaggtcaggagatcgagaccatcctggctaacacagtgaaatgctgtctctactaaaaaatacaaaaaattagctgggcatggtggtgggcgcctgtattcccagctacttgggaggctaaggcaggagaatggcatgaacccgggaggcggagcttgcatgagccaagatcgcgccacggcactccagcctgggcaacagagcgagactcttgtctcaaaaaaaaaaaaaaaactctgagctatattaatggcctttaaaattgggtcaaactatcaggatggtttaggttgccctgttccactagactggacagcctgtcagagttcctcttaaatctcccagtctggcatatactctgataaccagtgtgccataattctttttttttttttttttttttttttttgagacggagtgttgctctgtcacctaggccagagtgcagtggcagcaccattgcagctaactgcaacctctgcctcccgggttcaagcaattctcctgcctcagcctcctgagtagctgggattacaggcatgctccatcatgccctgctaatttttgtgttttttagtagagacggggtttcaccatgttggccaggctggtcttaaatgcctgacctcaggtgatccacccaccttggcctcccacagtgctgagattacaggcgtgagccaccgcgcccagccaatatatatatatatttttttactcatgcaagtgataaagggaactgcattaatctttttcattgtcagaataatagactgttcaggcattatacattttttatttcactctggccagaaatgacctcacactatttttggagtggaggtttataatatggcatgactaaactacctatagaacttagaatacttaccattttatcttatgtcttcctagatggaatcattctagagttactccctcaagaactagcatgagtaacttcattgagcagtatttaagcagggatgggccagtatttgcagtagagaggagtttgtcattcacaagaggtttcaggttagtcatttaacaaaggcctacttgtaccactgtattttcacaaataaaatgaattctgtgactgggcacgatgactcatgcccgtaataccagcacgttgggaggccgaggcaggaggttcacttgaggccaggagttcgagaccagcctcaccaatatggtgaaaccccatgtctactaaaaatatatatatataaaaagtagccgggcatggtggcgcgtgcctgtaatcccagctactcgagagacggaggaaggagaattacttgaacccaggaggcagaggttgcagtgagctgagatggcgctgctacactccagcctgggcgacaagagtgagactccgtctcaaataaaatgaattttggggctgaggaggcaaaattccattcagatcacctatgtacttctctaataaccgtggttatgactttagtcctgtcccaaacagttacataatggctactctgtagtgatctatatcttttttttttttttttgatacagagtcttgttctgttgtgcaggctggagtgcaatggcacaatctcagcttactgcaacctctgccccccgggttcaagtgattctcctgcctcagtctcccgaatagctgggattacaggcatgtgccaacacgccaagctaatttttgtattgtaggagagatggggtttcaccatgttgcccaggctggtgtcgaactcctgacctcaggtgatctgcctgccttggcctcccaaagtgctgggattacaggcgtgagccaacgtgcctggccaatgataagtatcttttgaattccagtagagagaaacaaggttctagtaagtaaggaaggttttgtaaaaaaataaatagagataatgctatgagaatataagccattgttaaaagctcttttactggtgttctgaaaataacatttttcaaaaattatgtctggcagctgaggctttggctgtggcctacatcatccttccaatcagtttcacaaagttattggatacctactgcgagctgggcgttattctgggtgctgtagatacagaagtgaacaaattgctctcttaatactttatgttcttttggagtgcgaagataaagcaaaatttaaaacttctgatagctttatgcagagaattaatggatagaataggtaccttggatcagatattcaggaagggtctgacaaagtaaatttaagctgagacttaaaaagattaaaaacaaaacaaaacaaaaaccagccctgatcctccaaaatcaggggtaagagctttccaggcagaagaaattttgagtacaaaggccccagcctggaaaactgggtaaaatgtgaggtgtgtgacacacgggccaagtggcaggcagggttgagttcacagaccgctttgtaggccaggttaaaggctcgactttcattttaaatgtaatagaaagattacatagttttcagcaggggagtgaaaggtctgattttgtttttttaatgatcattctactgctgtggggcaagacacagtgacgggatagaagcacagttataaaagcttttgtagccggagatgctggtggcttggacaaggctgccaaggtcaagaaactttgttctagacatacaccgatctgaagacatgtggctccattaaggaaatcatccaagctggactgcagtggcataatcgtggctcactgcagcttggacctcctggactccaggcatgggccaccacgcttggctaatttttttgcattttttgtagccatgggtttcaccatgttgctctggctggtcttgaactcctatactcaagcgatctgcccacattggcctcccaatgtgctgggacagcaggtgtgagccaccatgcctggcctgtttttaatttttaaatggaagattctgaaggattttaaagtgcttattgtagagagatgtttagaaaagggagagcttggtgatgctggagttgggaagagaattgcaggagcaccaccatcgagaaggaaggagggagcaggatcagaacccagaggcctggtgtttgagaagaggggaacatgtgtgcaagctgttgaggcagggagaaagagtatgtgtgcagggaggagtttagaaatttttatggaaaatgaagaatcctgccaattggctttcatcttctcaaagaaaagggacaaggctatttagtgaaagaactagaggagagagttaggggaacaaagggagagaaagaaagtagatttgcaggattgtggtaaaatgtaacagtcatgggagactgggggagcgacccactagagaaaggggaagggaagattgtaggtgatgctgagtccaagaaaggctgttgagcatgtttagataaactggtatatatttgtttacttatgtctctcctccctgccagctcagtagatgtgaactccatgaaggcagcccctgggtctgttttgctaccaccacccctgtcctcccaaatactcactactcagggcctgatacagtgccctttctgcagaagaatattcgtgtgagtgaatgaatgcctacctactggtaccctcaagtccaagttgagcaaatgtgaatgatgcttcctgtggtagctttgctagatgggcattttggaggggagaggacaggggatttgcagaggattgcttgagagtgaggatggtgatggctcttaaatcttaagctgagtaagaagccagtgaagataagagggctggtagttgggaagaaaatgggagaatctgtggattacagttaacaggtgaaagaattaatgattcctggggtgggaagcttttggcaaggacaggggattggtaggataggagatgtctaaatttgtgattgtggaggtaaatatgtaattgtggagggaatgacaaaggtcagggtatgtcctggggagcatgaagtggaatggaatagaaggtcactgaggagaagcttaagaaacaagccgggcacggtggctcacgtctgtaatcccagcactttgggaggccgaggcaggcggatcacctgaggttaggagttcaagaccagcctgaccaacatagagaaaccccgtctctatactaaaaatacaaaattagctgggcatggtggcacatgcctgtaatcccagctactcaggagactgaggcaggagaatcacttgaaccccggaggcagaagttgcagtgagccgagatcgcgccattgcactccagcctgggcaacaagaatgaaactctgtctccaaaaaaaaaaaaaaaaaagagagagagagagacccgggtgtcaggagtatggtctgtattgtcaccaaaaatgacaggagttggggcagagagcaacttgggggccaagccaggtgctgaagttctcagtgagagaagccagtggtcaaatgggcccttttaatgtgaaacctgctgtgagcaggctgtaatgtctaaattcatttaccttcatcttgttattagccagagtaaaaatagtacagttagctttcccaccccattccccaggctgccacctctaaggataaccctgcttttgcatatgcttgttactatcagaggacttgtccatttctttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacagtccatttctttcttgaagttgacttatgccagttttaattctgcctttgacagctcattattatataatcttttcatttgctatttaaaacttccatcacacttgctgcctaggttagttcctactctgtattgggtgacctctagcttttgagctggttattctgacatctttttggcattaaatctatttctttccctttaggatttggtgtcataatgaaaacaagtatttttggcttcctttttctttaaactgaaattcttttgaaaacaacaaaagcaatgtcttagttctttttagaaacctgttcacagtttgagatttgcttatattcctggtgttggtgaaaactgtgttgttagtggaagtttagagattatgacatccaatttgcctgattttaaggatggaaaaaaatgaggctgagatgtatgactacgcactagttgcagagtccatcttctggcttccagtttagtgtgtgtgtgcttgttttttaactataccaaatgcagtcaggatgttttttttttttaatctaatttttgcttgcacatcaagaaaggatggtcttcttttttttttttttttttggttttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtaggatggtcttcttaataataaatatggggcacatgttctcaggacctcctggggctgtgtcacacaaataataaatattaaaaataaaaattataattgtattttccatttctagtgtgacagagttatgggaagcatatgtaaatcataatatcctctcatgttcttcacacttgtaagagcattaagagatggacacatagggtaaatattaatcagttttaggatgaagacagtaagatgaaattacttgttcatttaacttattaagctaattctaacattactgcatgcttactgtatgccagttactgttcaaatgctttacatatattaactcatttaatcttcacgattaatgatgtgtagataccattatttaacctagttttaggaataagggaacagaaaggcaaagagatgaagtagattgccccagaggctcacacagtggcatttaggcattctgactggagcctggtcctttttaaaaaatgtattgttacatcagttacacacatttttggggtacatgtgctattttggtacatatatgcaatacgtaatgatcaaaacagggtaattgggatatctgtcacctcaaacatttatcttttggagcctgatcttttaactacaactctaagagtggtagagaattgtagttgggtcttgtgagttcaagtccaatgtattctgtactgtattgtctctgaccatgaaaataagtactgcctgaacccaacagtgtggttatatgaacgacccagcgatcgaaagataaactatgaaaacaaaacagaagttagtctcccaaaaatgaaaccaaaggaaagtaggccagaggttttgataatccactaggttggtagaagggttatgctattgaaggataacacttcaccttttcttagttataaatgaccttttcttatccatctagcccattcctcagactctatattaccagagagaaaggaagaaacagaaaagaggaccccttgttgagtttagatctcctgaacacacacaggatcagttcagaagttcccatgacacagggcattgagagtgagctccttgcctggttcctcacccaagaagagacaggcccaggtccatctctcctgagtaggaaaggctcagatttctgaagagatttctacccgggcacaggctgcctcaggtggggcctggctgtctgaggttagatgaaaatctatcagattgtggactcctgcacatagctggccaatgtctgtcactagtggagctggcagcacccccccgcccttactcaattggaacacccctactctggtcaccctgtgtgctaggaacagagatccaagttattacccttaaataatttatagtctgagatactgcaagggaagatgagattcagtctttaataagaatattttaaacaattatacctactgaaaaaatagaattaatcagtttggttgtgaacagtctactttatgtgggcagttgttctgaagatagacgatcagaatgacttaatgtattcacttaactgttttctcacaggaattcataagcttataatgcaattgcatcagccacagctgtctgaaccaccttagcctaggcttattttatccctgggatgtagctgctgttttggcctttggtgatcttcacccgtttaccgtagggtggatttaccttgattcacaagtcgtttgtctaacctctccttttgtcaagataattctgacaggtgaaatttctggtgattggcccaaagtatttcatctacccacaaatttgatcattaatatcctctcaaataaagggaacaaagatggaaaaataggtgaagcttggcctcatttatttacatattgaccccaatgtcagaagttactcagaagtgtgtgcaactctgtatagaccccttcctgggactggacacagaggctgaaataaaaaccagtttttcagcatgacttagcacaatgttatttattttcactgcctattagcctatgggtcatgagatttgttattctagagcagttgagtattggagtggaacaagcaaaagcaaggcatatttttctgttgtaatctgtactttttattttttaagatatataataatagttttacattaagtgtgatttggattccttctccagaattataaattacctaattcccttctgctaaaagacgcaggacagagaagggtaagcattttagctggacatttattcctgttgtacgatcctccccatcccctttaacgagtgctagaactacgccagagaataactgtccaaaaaacttaaggagttctgattttaatctggtcaaatcactgaaatatgttgttagaaaatgtctggtagtggccgggcacggtggctcactcctgtaatcccagcactttggtaggctgaggtgggtggatcacgaggtcaggagatcaagacgatcctggctaacatggtgaaaccccatctctactaaaaatacaaaaaaattagctgggtgtggtggtgggcacctgtagtcccagctacttgagaggctgaggcaggagaatagcttgaacccgtgaggtggaggctgcagtgagccgagatcgccactgcactccagcctgagtgatagagtgagattctgtctcaaaaaaaaaaaaaaaaaaagaaagaaaagaaaaagaaaatgcctggtagtgaataaaatcttaaatcatgaagattaaaaataacctgctacttctacttatgttgccataaaagcagttttcaaaatatgttctcttaaaatatcttgaaaatagttcctggtctaatggaaacaagtgttgggaaaattcccttgttgcagacatattcattaatgtgatgatagcattgccaaaaggaaggagaacatgccagggccaactcaacacagtcctgagaacattccttttccgaatttctggcccgttctttctctgtctcccccctccttgtccaggagttccattgttggcatcattatccagaatgtaaatggctttgccagaaacactgcccacagcttgtctaagaacaaatgtcaaggagatatgcttttttccatgtatttgctttggatatttttctaacaattaagcctgagggccaggtgcagtggctcacgcctgtaattccccacacttttggaggctgaggtgggtggatcacttgaggtcaggagttcaagaccagcctggccaacatggtgaaaccctatctctacgaaaaaatacaaaaattagctggttgtggtaatcccagctacttgggaggctgaggcaggagaatctcttgaacccaggaggcggaggttgcagtgagcaaggtgctgcaccaccacactcctgcctgggtgacgaagtgaccttatctcaaaaaaaaaaaaaaacacctagtattggaagagatcattttagtttagaaagtagaaagtttcttgatagagttggtctggttgtgttcatccctcaaaggcaaggttataaactgtttctgcctactttagaagagtcagagggtttgttttgtggctctttatggtattttatcatgttggtggttttgtattctctagaaaatttctgtacctaaaaatgctgccttacagaattaatttcctttaaggacttaactcttggatatttccccataattcctctgttctcagagtgcttgccattgttattaaatgctagatttttagagctgatagggccttcagaaatagagtaagagtggagatttgggagatcatatagttcaactatttgtcttcgtaggtaaagaaacagaccccacaaggtgaagtgacttgcccagggcctgcagttgattagttgaggctagaacccatgtccctgtttagtactttgctttgtggtgtgattctgccctctgtactagtgctcagatggtgttctgtacttagcaggggcactggagactgagctccaaaccatttattactaaagcgtatgtttaccaagtcctttttggttctgttatttattcctgtactcaactaagccaaatctagatttaattgaaaactgtatagacactgttaattccaagtgtgctctccaggtcatgtccaatgagggaggcaccttagtctttcagagacgttttgataaacatttaaagcttaccatagttatttgcttgacttaacacctttaaatgccccgtggcctcagatcgttgaagcataatgccctgtaggattcccattttgttttgcttgagatctgccattccccagcactcaggtgctgtgagctgattgagctgttccccaactagcctattttaggacacaagccatttgttaagccaagtatgtgaatatgtcactgttcaggcactagtctcagtggcccccccatctcccttgaataaaagccagtgtccttaaaagggccccaaatgctgatcacctctgtgacatcacttctcattttctgcccctttttcaaatcccttcagtttcaggaaaaaacttcagagcatcaggcaagctcctaatgtgctttgcacttggctgttccctctatagtgaccttctcctctccttttggtaccaggtggctcctctttcacctccttcaaagcaagtcactttctcaggaagtcccttcctgaccatctcatttaaaattgccaccccgccccaacctttccatttctgttttcctcctttgctgtgtttttctccataatgctggtgaccttctaatgtaggacttattttttctaaagacctctccttacaggtatttccccttaagtcctgtgtctttgagtattggttttagtttaaatgaaaacttcccagtgcttctcatctgtagccagcattgggaacctttgccatagacgttgcttcattaggtgttagttttgagagttctcacagaggcaggattttaagtatcaagaacgtatttttaattcttaatagtagcttcaggcaatatttttcatatagtaggaccattctcttgcattaaaccacatagtggctcagcattgttccccactcatcagaaagcttccctgcagtagtgatagcagcatactcctatatataactgatcttgaggaccacgtaccttataacctgaggttcctctgattttagggggagggtaatgaatttgtattatttgaacaagagtgttaagatacgagatttcaaataaaatggttggttttactggctttttcttaaaatagttcagcactagttaatgcttgtgtaattcagtctattttagaatgtttgatactatgtataactttttttggaaacggagtctagctctggcttccaggctggagtgcagtggcatgatctcggctcactgcagccacctcccaggttcaagcaattctcctgcctcagcctcctgagtagctgggactacaggtgggcgccacatgcccggctaatttttgtattttcgttacagatggggtttcaccatgttggccaggctggtctcaaactcctgacatcaagtaatccgtccgtcttagcatcccaaagtgttgggattacgggcgagagccactgtggccagctgatactatgataactttttatttcggagtttttttaagctcaactattaaaattacacattgtagaaatgtcagagagccaaaagtgcaagtagaaataatgggagaatcttgcaaacatgacaaccatccacacctgttttcttctagccttttcccattgctgtgatcctagttctggttcaggtgtggtgaggtggtgatgagatttgaaaagtgcagcggagaaaatactaccaccactaagaattctacactgttaacatttgtacttactttcagtttcttatttatgtgcatatgttttaaacagagcaaataatatagaagcacattgtccctttttaaaaggaatatattaatagtgttaaagtctttttttttttttaaagacagtctcactccgtcacccaggctggagtgcagtggcgtgatcttggctcactgcaagctccgcctcctgggttcaagtgattctctacctcggtctcccgagtagctgggactacaggcacacgccaccacactcagctaattttttatttctttttactagagacagggtttcaccatgttggccaggctggtcttgaactcctgacctcaggtgatccacccaccttggcctcccaaagtgctgggattacatgcatgagccaccgtgcctggccagataaagtcatttttaaccactgtttcctcttctgttcccttttcctatcatgaccctggccctgtgccctaactgaaacaattacttttgcaaatttggtatatgttggttcagtacagttttcctatacttgttaccatggagaattggtagttgtttgttttagtttatttaaataacctcagcctgtaaatataacatcctgcaacttaaaaaaaaaaaacaaaactcagctttagatgtatacaagttgatacacatggatctacttcattacccttggctgtataggactcaggtagatggatgtactcccctttatccaaccctatcccattgacagggttgaatttggctgttggcttttataaataatattgcaacaaatactctcatggggcatctgggacatgtgtattagtatttttctaaagttaatgtagaatgttttttaccctaatttttctcctcttaataccaagacatgaacatttcccattattaaaatgtcttcataaaccacatgcttcttaaatctagactttgaaacatctttaatttccttaatgaaaaattaatattggacacaaagattttttttcatcagagtaacttaaacatcacataggccctcttgattgtagtagatagaacattatgctgtttcaacacagagcatttaaaaacaaaagttaaaagtgtgagtgactagagtggtctaagactggactacttggacttggtattcttatcccctgttttctacttcaggggaagtttctcaggtttttggagacaatctctgtagcgcctcacttgaggctcctcctccagtgccatttctctgcatctttcctgactcttcccgttttactccgcctactgtatcaatactttattcagattgcaggtatttattggtgtctcttgtcccactgccacagtgacctcctcaagaatagtgaactgtcttatttttataccctatccaagcacaatgcctgcggtgtaggtgctgaccaaatatgttctgaatgaatgagagagagagagactgtggggatgggggtgatggaggatgggggtcggagatagtggtggtgatactcaccttaataaggaacttcagatattgaaagtgtggaacagaatgagtcctaaaaggaaatgaagtgataaggatgacaaaatgacacctttgacaatggatctctgctttagaatattgccatttgcatatatactgactgactgaataactggttttattaatttctccttgaagttcaaatggccatatagctattaaagtgtgtacttggtttgctaggaaaaattttaaaaacttaaacctccaacagatatagccaacttagagtattttttttaactccttgcttggttgccccaattttaatcaaaactgggtttccctgaatgagtagactaatgttaaaggaaatattttggtcactgcttttaggaaatcctttgtggtttgaagtggtattcctttagcatttcaacagtttcattcatgttccgtgcacagtgcagccaagtgataccagtaagtgagcgtcagaaggagaagttgaaatgcagaacctccagatttagagcttgaacaacaaaacttctgggagagtgaagtttcttaacttttatcatgacactggctatgaaccatttagtagtataatttatctttgagcagtaccttcatagctcagaaaacagttgctttaatgattgttttgtataagaagctgcatttctcccagtttgctcatttgttaatagaatgctgatgtattccaaataattggagctatcaggagaatataatgtttatcagtaatgaaagatctaaggttgaaagtagtgatttataagtattatcaccttttcccaatactgaaattgtttccagtactgaaatacttttattgttctctggatactttttgctgctaattaacatctctttttacaggattcatgaataaaattttccatcccaacattgatgaagcgtaagtaactattttaaaatgtttcaattttagcagcaactgctcatgattagtgtttctctgtgttataaaaagcctcggttatctttttggaccttatcaggaggtaggactgtatgaatggtcatgtaaatgatagaatccaaaggatatgaggttctcaatcacttagttcacattctgctgttgtaccacttatttttttccattgtcgtgactgggtccttcatttttcttgttatccagcaaacagtagtaatattccacatctcacttctctttttgtagacacagttcagagatctgttttcagcctacagatagactattttcagatcttataatattttctcaattcttgatagatagtaaggcaaaatgactatagtttcatttcagttaatgaatcttatttatccccttctttccttctaatattttattaatgatactttaaaatattccagcatatcctgttttatacttctagtgctgtttagaatatattattgtttgggatgcaattttaatttgtcatggcactaagttttactgtctctcacaaacatacctaacaggtttttctgcactctgtgtgagtaggttgtatatatacatacatcatgccccttagtcctttaatattaatattttattgtatcagttatcctaacaaggatattctcttatctatccacagtatatagttgtcagattcaggaatttaacgttaatgcaatacttatttaatctactgccatattccagtaacttactttttagcacttttttctttcaataaaggatccagtctagaatcacacattacatttagttgtcatgtttctttaaactgctttaatcaggattagttcctcagcctgcctttatcttttataaaattcactttttaaaataacatagaccagttattttatagattgttcctcaatttgtgtttgtctgatgtttcctgatcattagattcagggcatgaacacacttaaggccagaaaactacaaagtaagatggtgtccttcttggggtatcacattcagagacacacaaggtctgtctgccccttgtgttctcagcacctggttcaggtgttgtctggtttctccattgcatagttactattttcccctttcagtctgtaaggtgacacttcaagacctggtactattctgttcctcatcatacttttccccaattgggattctttttttcacagatctattagaagtatttctcttgataagtaaaaattagttgccagatacatgcaactaactttctaatttttaaaaacatgccattctttccatctgtttcaggtcaggaactgtgtgtctagatgtaattaatcaaacttggacagctctctatggtgagtttggccatggaatattttttggagatgttgagacattgcctaaaaaaatgttgtttggcttttcttttctggtttaagatgttttgttggtaatgggaagggatttttgagggaccgactgggaaagtttgatcagtggaaaaaatgttttctcttaagtacaaatatatcagtttagctgtggaagtttaaaatgattttttgagattccaaacttaaggtatagtgatacatgtgcacacacatgagtacatgcgcacacacatgaatacatgtgcaaacattttatatgtatgtattagcacataatatatacatattttggttttggaaaaaactaaaactacttaggaatgtccctctgaaatgagagagcaatgatatagtaagaggttttaggggatcatcttttcaaagaccaaaacctccttatgaaggaagagtaatttagccttaccttcagtgctgaaattgacaccccatctcttacagggaatcaacaaatgaattgcccagctctgcaaaatgctatgctgaatatcccagagagttataaagagcatcaggcctttcctccttatcacctggttggggagctgaaaatatgttaaaatacagtcatctcttggtatctgcaggggatcagttcccagaccacctgcagataccaaaattcatgcttactcaagtcccacagtcatccctgtgaaacccactgacatggagggctagctgtatttattgaaaaccacatgtgaatggacccatgcagttcaaactgtgtgtggacccatgttgttcaagggtcagttgtgtatttgaagttaattagggatacaacaaataaatctgtttttccctccacatgtccaaatctcaggcttcatagagtctacctactccagtgctcctaccccgtatacttccgctgattctccagctggaagtaatctctggataccattacattttatagctccttttttatggtccacttttactttctactgtgtatttgttgtttatgcctatttttttgtgctactagattatttcctatcttaagggctatcgggtgtgtgtctgattcatctgtaaggcccaggactcttatcacagtgcccttcaccagtatgggttgaaagaatgaatggtacaggtaaccattgctgagaggcacaagaaaagaagggaaagctcagttgaggctgagcttaaccagggatggctgcttcttgttgaacttgtacgaccttttagtggtctgaggtaggtaagacttcttagtccagccacaatctgcaagttacttttgccagatatccttgaactagattggtaaatgagaatcacagagaaaggttggtcaccagcagaacacagttaatccctgcctccacctgattgtgccgttcaaaaattattttctctacctgggatattcccccctgatctttgtgtggttagcaccttcttcactcatctcacatattacttcctcagagcagtttcctttcccagctactccatctgaaatcacacccctccatagcacagcacccagttgtatatatattttttaattttaaaattattttttaatacatagaaacagagttgcactctgttgcccaggctggaatgcagtggtgcgataatagctcactgcagccttgagctcctaggctcgaacagtcctcccatctcagcctccccagtagctgggactataggtgcatactaccatgcctggctagtaccccgttttcaataagcttctaaaactggtatttgtatattatttatcttatccccttggattgtaagcaccatgagtgaggactttgtcttgttctcgtctctctctctctatacacacgcacacgcacacgtgactgtaacagtgcctggtgcacaataagggttcgactatttgttgtcttaatgagtgaattaatcatgtccagaactgtttaacaagagagttttaggggagatgatggcatatagttgaggcaacaagaaagaacatacactccgagcttgattaaatggattccttttaagatggtttttttggtaaaaatgtctcatggcaggctgcctggaatatctgatgtaatgatgtgttttcttaaactacattcacatcttaaaaatgtacatatcaaaatactgcaatctggttccaattacaatgaagtaaattgatgtttagttttgctaaagcttttaccattgaccagaaaagctttgtgaaagatgtttgctgactgtcaagtacttcatgtctcagaacaggttttttaaaaaaataacagtttcactgaattataattcacagacatgcaaatcacccatttaaagtgtgtaattcagtagtttttaatacattcagttatatgcagccatcaccacagtcaattttagaacattttcatcacctcaaaaataaatgtgtaccctttaactattcgccctaggcaaccacgaatctgctttttgtttctgtggatttgtcttttctggacacttcttagaaacgtaattatataatatgtggtcttttgtgactgttttttttttcactttgcataatgttttcaaggttgatccgtgttgcatgtatcggaatttcttatggctgaataatatttcattgtgtagataaaccacattatttgtcagataatagacatttgggttattgctgtcttttggctattatgagtgttataaatatttgtgcacaagtatttgtgtagacatgtttgcatttctcttgggtatatacctaggagtgaaattgctggataatatgtttaactatttgaggactgatagactactttgtaaagtggccaacatgagtaagttttcatcacatttataaaatgttagtgtacttacattagcttgcaaagcatttaataagcagcaagagttaaaccacgttggtccaagtgaactgaaagcagacttctgtgttacatgtgtatgagttactgaacatgttccataatacaggagtgtgagcacactaacaggtaagtgcaggaaaacaagaagaaatattttcagagtatagtcaaaagtacactgagcatgggagaattgttttgacattttgctcaaaactatttctgaagaaaattcaacatttctttcacggaaagttttaggaacaggtaaatacaattatataaagtactggtagaatatgttcgttcagatgaccttgaagtgttttttcagacttatctgaacttgagatctgaactgaatttttattagaaactgttaaagcctctggcattgaaggttagttcataattggtgagttctgaatcacttcatttcctgcagtggttcctgagagaatcttagttcaaaggactgcccccgccaacccctgccccgccaaaaaaaaaaaaaaaaaaaaaactaacactaaataactaataggagaaagttggcgtgtcaacataaatattcaactgaaaagcaaaaggctaagcctggcacctaaaacttgtttcaacactttcctctgctgtagattcgatgagggagcagggagtggattgtgaaatttcctgccatttaccttgccccaggacatgtactgttctgtgggtatacatatttgtagcgtaacaacaattcacagttgaaatttcagatgtatgttaatcatagcctgatattaaacaacattcatgttagcagtaaatttagtcctctgtcccctcacacccttccccgccattgatttctggtaagccagttgactcattgcttctgttcttatcctgttttctctttgccaagtgtatgtgcaatttgtttattcagagttcaaaattggtataattgtggtttactcacccagtaatttttaattttgtattatttaaccttacaagagagctaattatagtgaggaatcggattaattttgtaagatgcttgccatcagtatgaagttatcaagtatgaagttatctattgttattgttatgacattaaacagaaagtagcagatgaccaaagtgattttggcttcctgcatgatagcatctttttttttgcatcccttcctgctcttccagacagcagtgacagaagctctgagaaacataaaatgtagccaaggggatctggatttccatttcaaaacaaattaattttaaggactgataggagagttcattaagccacaggtagctttttaagcactcttctattttccagttttcctttttttctccaaaatatattttatctgtagttggcttatcaccctgcactcctgggggcccaggtgccttcactgcgatacagctttaatctctctctcatcccacccttctggaccaggcatgcttgatccctgcaaatgtgtttctctctccagctttcattttactcattctttgactgccttcgtaaattatttatatgatggattaagttgtaggctgggcacggtggctcatgcctgtaatcccagcactttgggaggacaaggcaggcggatcaccttaggtcgggagttcgagaccagccataaccaacatggagaaaccccatctttattaaaaatacaaaattagccaggcgtggtggcgcatacctgtaattccagctactcggacagctgaggcaggagaattgcttgaacccgggaggcggaggttgcagtgagcccagattgcaccattgcactccagcctgggcaataagagcaaaactccatctcaaaaaaacaaacaaaaaaaaaagttgtggagaagtgaggtggaagacaattttcttatgaaattgggcagtttacattttcactcttagggttgctagccagtggactagatacttctactcttattttgctggagagaaaaatcaacatttgggaaaagtcttcccctagagttatctggggagttagtaacaggcaaataaaattgactacaacagaaggaatacttcaaggactttgagattaggcaagagatacaaatttttttttttttttgagacggagtctcgctctgtcgcccaggctggagtgcagtggcacgatctcagttcactgcgagctccgcctcccgggttcacgccattctcctgcctcagcctcccgagtagctgggactacaggcacctaaaatttattttaccaggcatttagaaatttaaaatacaaatttaacacttatcccatccccttttcagttagatagtctgtgaatcttcccaaataattcagattttggcagaaggtatatcttaaaataatgctttatgctggattagtgcatgctgtttcctaaacattttagtgtaactacacagataagaaatacatgtatgtgtctgcatggatgattaattggccaactactatttgaacagcttgagaacttcagtattgatctgtccatgttgaatcacaaacgtcatcctgcctttggaacagctggatgtcattatttgtagatagaggccaagtagagcaattctgtccagtactattgggataatgtcacctgttgtacataataaagaaatgtgctcagttgtggatttgcgcttcaacagtgcttagctagctccgtaaccaaccttctttatctgtctgcttggaaatcttcagatgaggtgtatgtggctcaggagtctaactagttatatacataaaaatggagtcttgctggctttgaacaacttagtggacattcattaaaaataccacactcactggtggtcagctttaaaaccatggggtggtccaggctttttggatcgtgggacatgagccagccagggtatggctctgaaagacagccacagctatgctctactttcgtaggggctctgattttagggcttgtttcattcttgattatatgtaaatgtaaccttgatttgttttatcttcattcacttacgattactgagttataaagtcttcccagcgtatggacacttggcttgtaattgcaggaagttacctcttgttattcttttctgatattaacaactaaattattgtctagtaattacaagcttgaatagcgagttttagtatgacagcaagactatccagctagctaattacacattaactgccctcatttctggaaggttaataacaaatcctattaccatgttttagcttacaagctcttaaggtaagcagggttataaggtttgaacgaggatgaattacctctaaaaaacacccaaatagacgagaattgttttgagattgacaatgcaacaagagcagtgtttttgatgaacaagagcttgttttcttcattgtgatctatgcagtagcacttattttcttctgcaactctctgaagtttaaatatgttggggggaaaggggctacaattaggcaatgaatgggaaattaccttttaagcgggtttggaatgctttaaaaacagtctatgtcctgtaactacacacctcagtttggtggcctggtagcctggccctgagcagaatgtggctggttttcccagtttcagcaccctgcatccatctgtccatctatcttttctcttctcttttctcttctttctttctttctctctctctcctttctctctctctgtccctccccccatcccccttccctctctctctctttctctctctctctctttcttttttgagacagagtcttactctgtcgcccaggctggagtgcagtggcgcaatctcggctcactgtaacctctgccacctgggttcaagcagttctcctgcctcagcctcccaagtagctgggattacaggcgcctgccaccgcacctggctaattttgtggttttagtagagatagcatttcaccatcttggccatgctggtcttgaactcctgacctcatgatccacctgcctcggcctcccaaagtactgggattacaggcgtgtgccaccacgccaggccagcgccctgcatctttcatattgccctttcccacacagcacaggaacacctgtttctagctttgaatacttaaaaaccaaaatgctactactgagatttaaatgtatttatcatgtatgttgcaaacattctttgagtgtttgaattcctactaattgttatttttttctttttttttgagacaaggtcttgccctgtcacccaggctggagtgcagcgtggctcactgcagcctcaaccttctgggctcaagtgatcctcctgtctcagcctctcaaatagcagagactacaggcatgcaccaccacatcaggctaattttttatttatactagagatgggggtgtcactatgttgtccaggctggtctcgaacccctgggctcaagtgatctgcccacctgggcctcccaaagtgctaggattacagtcatgggccactgcacccagccaccttttttgagaggtgggaggagggaagagtttggtgtgttttttaagcatcccacttcttttcggaggtgttttcacctgtttttgtttttttattttgttttgttttgttgcctgcatggccctcttcattaagactttatcttttaaagatccccatgggctaatatgagaagatatgtgaatctgctgagcttagactttttatatattttctccacacatgagaccctctcagtcaagtaattgtatgaattctttaatataccttttagtatttggtggcgggttatattatcttaattgcagctagttagccttcagtaaactaggtgcagcattgtgagccctgtggccagttgggcctgagccacagcactgcaggaagtctggtgggttgcttcagctctccacctgtgtgccctcaaaacaggtggagaaatgggctttttgtcactgaagttgagttcaaattaattattttattattttattttattttatttgagatggagtcttgctctgtcactcaggctggagtgcagtggtgcaatcttggctcactgcaacctctgcctcctgggttcaagcgattctcctgcctcagcctcccaagtagctgggattaccggcgcccaccaccaaacccgactaatttttgtatatttagtagagacaggatttcaccatgttggccaggttggtcttgaacccctgacttcaagtgatctgcccgcctcagcctcccaaagtgctgggattacaggcgtgagccactgcgcccggctcaaattagttattttagagaatattacttttaatctcaaaactgtttctttgaattctgcctgcctatccgattggttttactgaagttttccttgaggggctgtctgtcatcttttagggccctctgcaagtttttttcaaaaataacaactgcttagttgtgtgcagtgtaggactctttataggtttttgactactcttcttttcttgtagaatttcactgtcttttaatgtttacagactgcaagcaggataaaattaaaaattcaaccattattaatattgctgctttgtaggagctggtaaaggagtagaaggtaaagatctattaattatagtgtctaatacacccttgaggaaaatctgttaactccaaattattaagtacctaaagaaatctggagatcttaatttatttgccctatttcaggccttaccaaaaaaaaaaaaaaaaagctacctggtttttgtgcatatagtagatacccaccaccaccaccaaaaataattgtggaatgaatgagatttcatggttggctttattttgggcacatattgtaaaattcatgacttgcgtggcagttcatgacgaattcaatacagttcctaaagtcaaccaatggaattttgaaaggtcaacagctgcttttctctagtagtcaaggatgtgaataacttgggtgaaattcccaggagtttcaactataatgaccaaaagttcaggggaaagagatctatgtaagtcacagagggaatcatcagttctagacaacaattgacttgtgatttttgtccatgttttcctctaggtgtgaacaggatttttctttcctttcctgtcagccctgttccttattgaattacagaacagataaataccttagacagtagtgactatccctgtgattttcggcttggaaagccaggagtcctcctccagagggagagggatgatgaaagaagtttggatagcatgcttctggaggatgcagaattttgattggcaaataatcattgtacatattcatggggtacatagtgatgtgttttttgttttttgtttttgtttgagacagagtcttgctctgtcgtccaggctggagtgcagcagcgtgatcttggcttaccgcagcctccacctcccgagttcaagcagttctccaggttgcagaattttgattgagggcaagaggaacttattgtttgtgggaaatgacctaagtgattgttttaaggaaactttctctgattacaaaggcgagagtatagagcctttaaggccatttagtagatggctgccctgatccagggctggaatgatatattggttttgacatagttacatgccaggggaaataaaagaaaaactagagacatttctgggaaactgagtgagtacatggaagaaaggaagaacacctagccagattccttccagaggcttggagcctgagagccagggcgttagagtcaacctactcccttcattaggtgaagggaatgggttttcaggaaaataatcttagacatgtaaagtttgataagactacaagactagacatatgaaggaccagttatatggatttggtagttaccaacatagacttcttatttttctttctttcttttttatttaaagagactgggcctcagctgggcatggtagctcacgcctgtaatcccagcactgggaggccaaggcgaagaggatcacttgagccttggagtttgggactagcttgggcaacatagaacttgtctctggaaaaaaaaaaagagagactgggtctcactgtgtcatccaggctggagtgtagtagttgtgatcatagctcactgtaacttcaaactcctgggctctagtgatcctccctccttagcctcctgagtaactgggattacaggtacaagccaccacacccagtagacttattcctttaaaattgtaggatggccaggcgcggtggctcatgcctgtaatcccagcactttgggagtctgaggtggatggatcaccctgagatcaggagttcgagaccagcctggccaacatggcaaaacgctgtctctactaaaaatacaaaaaattagctgggcgtgcacctgtaatccagctactctagagcttgaagcaggagaattgcttgaacccaaaaggcagaggttccagtgagctgagattgtgccactacactccagcctggggagatagagcgagactccagcctggggagatagagcgagactccgtctcaaaaaaaaataataataataataataataattataggatgacggcttcccggggtaacagtgtacaaagctaattcttaaaatgcaaatgccacagaatttgagccgctgtgcaggatgctgatgtctttcccgataagttttttgttatttgtttttaacaggatgttgggcttctgggggacaggtagtagaaggagaaaggggatggggtaagtgggattgagaacggaagaatggctttgatggttcttggcacttggcaccacttggtggtggtttctgagttacagcatgtatttttcagtattaagtccgaaaaacaaatgaagaatatttaggtaaaagtctccaaaatgactgcctgtgtgctaattgtggttcccagtgaggcagagcatgtcaaggtttgggtatccacaggattttaacctgcagaaagcagtgtatattacatttttttttgagtggggggtggtagagagagggtcttgctttgtcacccaggctggtatgcagtggcatcacaacatactgcagcctcgacccatccacctgcccctgacttgagcaatcctctcacctcggcaactactgagcacctactctcctgagtagttggaaccacaggcacatgccaccatgcccaattattattattattattattattattattttgtagagaccggatctccctatgttgcccaggctgttattgaactcctgggctcaggccgtcttcctgccttggcctcccaaagtgctaggattacagacatgaaccaccttgcccagcttgaaattttccatttatttcaaaggaaatagaggaaaaagaaataacttgtggtcactggttcataaatagccaagaataaaacatgagatgtgtgattcatcccctcttgtgttttctccttcaagccctgcaccatttcattgtgagtcacctggaatagggcaattttactttaagaattggtacatttttttcagtgtaactctttttaattaatacatattctttaagggatacaggtagctgaaatgtctaccctttgaggatgtcatatttgtattaatagtttagttctctggtgcaatttgaagtatatcttatagtcacttttagtaatgtgtgttacttccctgtaaggaatagcaatgttatacttctccttttgcagtgaagaaattgagatgtagaaaggaagagacctgcccaaggtcaaagagcaaggcagtggaaagcctgagattagacttgtggtcttttagatttttcatctgttgttcaccactgaggagccagctttctgtttgctggagacagttcagcctaatggaattttctctgccagatgtccacattgtgttaggtgatgattctaaccatcctctaatacccattctcctccaaagtggccctttagttcccctccagaacagatctgcttttgactgcctgtggtttggcacacctctgcctagagataacagtggtaacagcagtgtgcagaaaagaaagtgggaagggtcagggaatgtcactaaaccagagtcgagctgttagaggtgaacattttcttgcaaaaaagaacctacgagcaaatggccctttccttcccgtctattctttggggataggggatcatgggccaggtagtatttcctgtgcattttgcacacagatgtctgtatcacacacatacagatcccatccagtcctaaaccagaagccctggggtaggtatgaagctgcaaccttaggatgctaagcaagtttttggaaaaactccacaggtaattgtgatggacaagcaggacctagacttagcccagaaccactgctctagactaagtgatgctacttttgatgataagttgtttatgatttgggagtctcactccattgcccaggctggagtgcagtggtacaatctcagctcactacaacctctgcctcccaggttcaagcaattctcctgcctcagcctcccaagtagctgggattacaggtgcccaccaccacgcctggctaattttttgtatttttagtagagacagggttttgccacgttggccaggctggtgtgaaactcctgacctcaggcagtccacctgcctcggcctcccaaagtgctaggattacaggcatgagccactgtgcccagcctgtttttaaatagtaaatatgaatataaattatatgcctaaactgagatatgagtgttataattttaacattaatgtaagatcagactgaagagtcagtgctaatgaaccacattttggttctaattgagtctaaggcaaaagtaagagctgtttgctcatcataaaccatatactcaggaatcttgggacttcctttaaaagttaagacaggcggaaatggggtcggctgactgtactctacaggtttaggtcaactgtatctggctctcttcctttaaaaaaattgaaggttaatgtttttagataaagatctttgaactgacacatttttatcgttattattatcgacacatttttatcgttttatcattaacaaaaatctagggaaaaagtgttctttatttttctacagatgagtatctttattttattcttgatttatagttttagtcttctctgccagtgtatttatcttgaaagaagactttctgcacatctgcacatttgagagatgctcctttcagaagcacccttaggagtaatcactgtgttagccacttgcaggaaggccttattgctttaagatggcagagccatcacatcctggcctcccgaagttgtcatcttcacccaaaactgggcctcatgtgtttccttttctgctcttctgttttacaggtgtgactcagcacttctgtaaaatggatcaaaaatgtgttaatgcaggaagacggtagatacaggaaggaagaaccaataattaagggttcttttatttgtttggaacaaattcataggcaaagccttttattggtagcttgaggaaacttaaaagtagtaggaaagggtataaaatctctttctgggacacgctaaactcctagttttataacacgttgtctgtgatatttctctagccctgaagcacttctgaacattacttcagaacataaaacctatgctttgtttttaaaggttttcgttgttatgtaatagcatccagctgctaatccttttgagcagcacctgtaataataatatggcaggaggagccttccgttcgctgtgtgcaggtgtctgcgggttacctcctgcggtggagctgcatgaaaacaagcacaccgtctctgtgaatagccacagaaacatctgaacgtcctttgcttagcatgcttctttgcacttgtgagggattctttggggaggagggtgatcatctctgatccatggatttagcttccctgccagcgatggtatgcgattttgacccagagacatggggagcttgtgccttcgtgaaatttgcggcagcggcagtgtgtgttttatccattaacagaggcagcatagtggatgagctcaggtttgagttcctgatccatacttaagctctgtgtgcctcaatttctccatctgtaaaatggtgcctacctcattgactgtagtgaaattaagagtgtatatgcagaccatggaagagttccttgcttgtagtaagcactatgtaagcattaacctgccattactgttaatattactgttaatgggccgggcgcagtggctcactcctgtaattccagcactttgggaggccgaggcgggcagatcacgaggtcaggagatcgagaccatcctggctaacacggtgaaaccccttctctgctaaaaatacaaaaaaattagctggatgtggcggcgtgtgcctgtagtcctagctgctggggagactgaggcaggagaatggcgtgaacccaggaggcggagcttgcagtgagtggagatcacactactgcaccccagcctggttgacagcaagactccgtctcaaaaaaaaaaaaaaaaaaaaattactgttaatgtaactattgtttaacttttccctgctatgggatcacattcaattgtaaaactactgttttttgtttttatttttgtttttttgagatagagttttgctcttgttgcacaggctgcggtgcaatggcgcagtctgggctcactgcaaactccacctcctgggttcaagcaattctcctgcctcagcctcccaagtagctgggattacaggcacctgccaccacacccagctaatttttgtatttttagtagaaacgggatttcaccgtgttggccaagctggtctcaaactcctgacctcaggtgatctgcccatctcagcctcccaaagtgttgggattacagttgtaagccactgcgtctggcctgtaaaactgaatttgcttaccttttggcattttctaccactgccttaataactcacccacccaaggataaagataagaaaataaaaacattttcagacttttcatgttttattggatatttcaaacatatgccaaaatagaaaggacatatttacaggaaaatgttatttttattttatttatttatttgagacagggttccactcacttgcccaggctggagtactgtggtgcaatcttggctcactgcaacctccacctccccaggttcaagcaattctgcctcagcctcccaagtagctgggactacaggcacgcgccatcacacccagctaattttttgtattttttagtagggacagggttttgccatgttggccaggctggtctcgaactcctggccttatgtgatccacccaccttggcctaccaaagtgctgggattacaggtgtgagccaaaaatgttgatttttaaaggcaaaagaaatgtcatttgaaatgtgaaaagtagaagttacacatctattgccttgaggtagctttttaaaatgtttgtcttatgcatacacactgtacatagttgtaattctagaaaacataccattttatggcctttctctacccagcattcaagtataagcatttttttcattgaaaacaaatagttttcaatggttttgtaccataataattgtttccctttttaaaaaaattgtagataaaacattggtgaaaatcttactgcagatagtttgggggttatataggaaggtgatttttgttttgcttttttgattaggagtgtcaggatttctttcgtggtacatgagaaccttactataaagtggctctttaggaccgttctgaagtcagccttatgaaggtgaaatagactctgatgaaatcaccccaagtctgtggcttttgttgtaaggcagagctgctctgtgtcaatacctggtgtgtgagaacaggacgtggtagctgtcatgggaccctctagcccatcattctctagacctgcactgtccaatacaggatctactagccatgtgtggttatttaaatttaattagaattaaataaactgaaaattaatttccttattcacactggccatattttgagtgctcagtagccacttatggctagtggctattggtttaggtgagcacatataaaacatttttatcactgcagaaagttcggttgagtaacacagctctagattagtctctaactgctcagcttcttaaccttacagtgataagagccacctcttataggtaagattttctagagcaaagttgggcagaccttgggtacttgtttttgtatatgtagttttataggaatacagccacatcgatttgttgacctatactttggctgcttttgtgttacagtggcagagctgagttttgagtagttatgacagagaccatatgtggcctgcaaagcctaaaagtatttgaccctttacaaaaaggtttgcctaccgcttttatctagatcagggtttcttaacctcagcactgctgacattttggtctagataatcctttgttgtggggctgtcctgtgcattgtggtgtttagcagcttccctggccttcacccaccggatgccagtagcaccgcttagatatgacaaccaaaaatgtctctagacattgccaaattccatggggagcaaaatcacccttggctgagaaccacaaatctcaagcaatgtggcttggcaaagcattcatctgtaatactgcaaaggagcgcccattgttaaaagcaaaattggttgaaagagctgactaaattaatgagtagttttttatgctacttagtatacttcagcattgtctccagaaacaggaatgttttatataaaacatgacaaagcagctggagtggggcagagacatggaagcattctcatgtccttccatttctcaggggtgctgcagttcactgaggagcagagtgtggaagttacagcatatctgagctatggggtgtgtgggttgtgttatacccaggttctcagggcctgcttttctaaaacgctgggtaactgcaggtgtttgttgtttgctaactgtgtgtagatatcatctgtgtatgcctggcaagaaaggagttaataaatgtcacgtctataatcccagcacttggggaggccaagatggaaggatctcttgagtccaggagttcaagaccagcctgggcagcataaggagaccctgtctctatttaaaaaaaaaaaaattagctgggtatggtggcacatgcctatagtccaatttacttggaagactgaggctgggaggttggcttgagcccaagagtttgaagttgcagtgaggtatgatcacacctatgcactccaacttgggcaacagagtgagatcctctctcaaaaaaaaaacttttttaaataaataaatgcagtagattggtgcttatctgtcttatgaatatttgtagtcttatgtggtccatatagattcctatcctcattacccagaataattgaaaaattggttatatttacctccattagaagttgcaagaattgaattaaatgtcaagtcctataaaattgtgttcaaggctgagcgcagtggttcacacctgtaatcccagcactttggaaggccaaggctggcaggtcacttgaggttaggagtttgagaccatcctgaccaacatggtgaaaccccgtctctactaaaaatacaaaaattagccaggcatggtggcaggtgcctgtagtgccagctacttgggaggctgaggcaggagaatcgcttgaacatggaggcagaggtttcagtgagtcaggattgcaccactgcactccagcctgggcaatagagcaagactctgtctcaaaaaaaaaaacaaacaaaaaaaccccacaaaaactgtcttcaattcttttaagacccagcatctgaatacctttcagagtggggggttttgtaagctgtagaaaatggctgtgtgaaatagccatataaatagagtgaaatagaattgggaaaattgtccttcaaagtgaatgtcaggtatatctttatctcgttcttcaaattaaaattaaaatgtttaaattggtattgaaatgaatgtgtaatacaagtcacatgtaatagagcacactcgtatggagaatcatccccgtgtgaatatctaagaaggtaagcagcttgactactgaatgcaagtgaattttaggtgaacttgcatttcccatgtgtgacatgtttgtttggtttttcagatcttaccaatatatttgagtccttcctgcctcagttattggcctatcctaaccccatagatcctctcaatggtgacgctgcagccatgtacctccaccgaccagaagaatacaagcagaaaattaaaggtaagaggatgggtagtttaacctggagacaaaagaacttaaatctgttgggcttcagtcattaaaagtccttcttaaattacttagttcctaatactttttcttaggcctaaaaagagacagctgtgggctgaagtagtgctcaccaacctcgggtggcagtagcaccagtttgctcatcctttgcgatttagaatcctattttcccatccttaaaacagtttacgtgctgatgggatatgagtttcatttaaatgaagataagtttgcgactggccgtggtggctcacgcctgtaatcccagcactttggtagcccgaggcaggcggatcacaaggtcaggagatcgagaccagcctggccaacatggtgaaaccccatctctactaaaaatacaaaaattagcctggtgtggtggcacgcgcctgtagtcccagctactcgggaggctgaggcaagagaatcgcctgaaccaggaagcagaggttgcagtgagcctagactgtgccattgtactccagcctgggtgacagagcaagattctgtctttaaaaaagaaaaaaaatctaaagctccacctgggttcattggattttccattttacctctgtgtatgtttcagaactttcatagtgaaaagtctagatacatgaagctccaccaagaagcaaaggaattcaaagtttgtgaaatatacctgctgcttttaaccaatggcaggcattagtatctagccagtttttcacatgatgggcctatctgcatagcagtccagaatgtttgcttcctcaaaatgtgtggcctctctgaggtacatttgcaagaggtggcagtagaagtaatttaccagagcttgaatgtgcaggtcttcactctgaaatgtgcaggtatgaggcaaacagggactattcatgaaacaatagcttttcttctatttgttttctaattcttcttccaaggtctctatagggtattgtttggagctgttgttgagataaagcagaaataaatttactataattaattagatctcaagtgctttgcaaattaatatctaatttatgtagcaaaatatatagctaagcaaacatgtatttgaagaaaaaggcagtcagtttcagccagataaagtgctgttatgagactatattaaaattttgacataggaatcacttagcaatgtctgcaaaccacagatatcttggagcagagtatatttctctagttcacatatgcattctgtctcaacaatttagcagtagccctgtttcagtacatgtctgctatagtcccatttacaaaaagaaccgagcctacatttatcttagaatggctcactccagcgtacggacccctagccttcggaaatgttcatgttggctatcattttgtcttccttagtaatctcagaaaatcatggccatcagacctgagctcacccccacttcctactgtgccttgatatcttctcccttccctcctgcatcttttctttgttcctaactataggaaataaataagagacacccttcctcatttctcaaactcactcccaccaccaatctgtgatcttgttcccccaaccccctgccccctcccaatgcagtcttcctcctccaccccatcagaggtctccctgtttcaggagcagtgatctgctcctgtgggctctcttaggagtcatgctgtttattccttttcattttcaaacttcttgcgtcctcaccttaaactcctctagtttttttcccctcctctgcttaatctgtgccctcatttcttcccaatcctttggactcttctcaagtcccattttgctggacctttctgcaagtgttacattttaccctcatctttctggaaacttctcattccatttcctaaatgtggtcattcacttaggactcggtccctgggctccctctcttcctttgtcatccctgaggagctgtttcacctctcacagcttcagtcagtcccctccagggagatgatttctgaatgtgtgtctaggcctggcctctctcccaagctgctgctggacatttccatttgtgtggcagtcaccaccaacccaacacagctaacacagtcagtgttcatatttagttggcgctgtattatagtacatgtttgaaaaagtgtttaaatattggatagcccgtagcactgggcaccattggagctgtctaaagctgtcacttccctgctcaaaaccctttgctgggtgacatctttgcctgccattcagggctctctgatactgagtggaatctacatctttgcccttactccttttttttttttttttttttttttttttttttgagacggagtcttgccctgtcgcctaggctggagtgcagtggtgcgatctcggcccactgcagcctctgcctcccgggttcaagtgattctccttcctcagcctcccgagtagctgggattacaggcatgtgccaccacatccagctagttttttgtatttttgtagagatggggtttcaccatgttggccaggctggtctcgaagtcctaacctcaggtgatatacccgccttggcctcccaaagtgctgggtttacaggcatgagccgctgcacctggccatagttctctcttaaggttgtgtttaaacatcccagccacttactttcaacaaaacaaagcctttccctggagtggcctctcctatgccatagctggcaggacttgggggtcagtgtggctgggactgcctcggccgtttttcgtccgtaactgcttccctctggtgacactcagcagctccttttatcttcctctgtttcctcctcctcattggtgaccttgctcttcctttctctctctcaaaggccttgtcctagtaagtacttaatatacatttgtttccttgaatacattaaagagggctgatagtatcaaattctagtgtcaaaaaaaggtcaatatttatcttctacaaaggaagacgcaaaatagtcaacccattagaggttaaaaataaaattgttaaagtttgaataaatatttctcaattaaggtaaattcctacctaatcatgggctactttaatctcatcaaaatcattagcataaaattttgttataatgaatttgaagggctctaagtctcaagtctgcaaaccttttctgtaaaggaccacattggccagatgtggcctttatcacacattctgtttattattttttaagacagtttttaaaatataaaaacattcttagctaggccctgtgctagttattcaaatctggtaggcccatttggccattcagcttatcttcctattgcagtgagtccccgcaactctataggaggaaaaacaaagccacaagggtgtgtttttgtgtggcttgcattttgaataggtttctgtcatgtcttttcctattgtgtggaggctgttcacttgaaaacagtatgcacttagagtttttaggaacaagtttgtttattcagcagttcttaaaagccgtttcagcagtcttattcagcctagggttccaccaaggctgtagcagcggaaatctaccttcaggtaaattatacatggaaaaaccactcagagccgagtggtgtctccgtatagcagcttagtcctgagcagattgagcgatggtttttgccagctgcttcaaaaacctgacaggcaggatctgtttagactaaaatcgattcctaaaataatagacctggactgactgtaattatgtaactgcagatctaaaaatgatgaaggatttccttataaattactatggaatcatgactggtcctatactatctgggagatgaaagtaaaaagaaagcgtggggctcccatttccctggtccctgaagagttcttggggtgctgcagcacacacattcccctgcaagctgagcctgctgtgttgctcttcccaatacccctttcctcagggggcaaaatgcagaaaccctgtcccaaagaagtctccctatgggattctccttagctgtagtgatcatgattactgtcatctttgtcccccctggtgttcaaggtaagtttgaacctccgcagccttgccagctttttggggtcgccaaagcacatgcctgcccactcactgcccttgttgtctttctcccaccccgtgcagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagagtgtgtgtatgtgtgcacatgtgtgagagtgtgagcgagagtgtgtgtgtgtccatctaagtctgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccactt

SEQ ID NO: 17525 - DNA, 42574 bp, Human
ttttctggctatttggaaccactgtcaagtttgtattggggtcaggtggtattgcagaagaaaataaggtgtttaggttttaggtcaggcgagagttgaagaggttttaagttcttgagaacacaggctaagggagaagaaggaggaatggagggtggaaggttgcccatagtgaaggaggcaagcccagagaaaagagagggcagagacacagggggggtcggtacttgacaccaaggtgaaggatcaaggcaggtgtccctgtggtgatcagacacctctgaaatgtgggtgaataatcaggcaggcatccctgcagtgattaaacaccaagggaagactgtcttctcgagtccgtgaccagtgccggagttttgggttcacggataaaacacatctcctctgtctctatcagaaaaggaaaggaactgaaattaagggaagggatagattgaagggtggtgccaaaattgaaaggagaaagaggttgagagatagtgagagaggttggagaagagagtaaaaagaagctgcttacccaatttaaaattggtgagatgttcctggagctggttggtctgaggacccgaggttgtaggtggatctttctcacagagcaaagagcaggaggacaggtgactgtcttatcagttaaggcaggaaccggccattttcacttcttttgtgattcttcagttgcttcagcattttcacttcttttgtgattcttcagttgcttcaggccatctggatgtatatgtgcaggcttgggctcagaggcctgacatgcgtgtgttttgtgtttttctggataggcatgcattcctatggaggaggtaagcagggggaagggagctcacattcatcagacacctagtatgtgtaggaaccttctgcatccctggaaggatggatgaccccacatgtgaaacctctcgtgtggttctttttggaattaactaccattgctgaaaagggcctacataaaatatcaaattttaacatgctggaatttttctttattttttttctccttcaaacatttgtagctctttatatgtggtatttcctctgtgtcagaagggaaagagggtgccctttggggaagttctcttccagactcctagaagagaatctgatttaccttaaatgcacaaacaaggccttgccatgtcactggccaaccgcagacaaactacttcagtcacagaaataatttggacacttttgctttttaaggaaaagatgatttccctggatttttttcctgtgaggacgaggcattccaaaaccccagcggggtcaggcacagttcgccaactttatgttttggggggcagcgcatttgcttcccgaagtgagttgcgaaaccgttttctagcgcgcacggggctttcatctcttccgtgcatgcgaacggctttccgagatgccccctttatgggcttggccatcgctacttttgttacaaattaacgtctgggactcggactgctgccaataggaaactcccgcgattcgctgcctagttcgccgccctcacaagactggactctgcacaggccatccatgcccgctggtgcacctcgctctcttgcacgcttaacccgcggggacgcccccgacctcccacctcagccctcgccacagttagtcccgcccttccgcgcagactccgtggagtcctgtcacgctctccgcgcgctgcggcagccgggagattgtgaagggcacctccggcagccaattaacacccgcatactgggcgggaccacgcttgggcaggcggagggggtcgaccgaaggcggggacttttgagtgacaaggatgatggccaaccgtcggaggcccttctactgcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagaggtgagttggggatgagcggcttggggcgcagggagcgtgggccgggtttgggggttcactggcatgacctgtctttcgcggcccggagtccgcatacctacgcctaggcgcgccccccgagttcgctcacctgcgcgtgtacgcctgggcgcgcttccgagtccgcacacctgcgcgtgcaagcctgggcgccccccaccgccccaagtccgcacacctgcgcgctcacacctgggagcgctccccgagtccgcacacctgctagtgtacacctgggcgctctcctcgagtccgcacacctgcgcgtgcacacctgggagcgctccctgagtccgcacacctgcgcgtgtacacctgggagcgctccccgaatccgtacacctgcgcgtgcacacctgggagcgccctgcgcggcggcatcctcgctaggtggtgctggagcagccttccggggatagcgcgcagccatgcgggggatttaaatgatccctttctcccttgagtttgaatagaagggtgtccttccaggaccggcggcattcccgcagtggccggctggagaccacccaccccgagagctgcggatcccgccggaggggaccccaagtgcggaggtcgggtgtggtccgggcctgcgcttcccgcggcagccactggccgaccttgcggtccacacccactcgcgttcgcgttcacctggaagaggctcggtgttaattaaccttttccagtcacgccttggcagccaggtgccgtgcttgactcctgagaccgcggtgtgtggctggagcaagaacacagaggccaggcagagcagcggacgttctgcgtgggactcgcccctaacagctttggaaggtgtaataggaaacgttggttaacttgaagacattcctttgataagattctttgcattcggttataatttttgccgcacacgctaaggggcgcttttggtgattgtcttagatcctctggaagtgttttactacttttgggggagtctcaatcataaatcttaacgcatgctcacgccccctcccaataatgagaaggtttagtgatgggaattttttacatagtcggggagcaggggacaaaaatagatgcctggtctgagctggatcacagtttatatcagaggactttgtttttgcagaaaatgttaaaatcaaaaggcctgttttaaaaaatgaggctgggccaagcacggtggctcacacatgtaatcccagcactttgggaggctgaggcgggtggatcacttgagtctaggagttcgagaccagcttgaccaacatggcgaaaccccatctctaaccaaaataccaaaattagccaggcctggcggggcacgcctgtagtcccagctactcgggaggctgagacaggagaatcccttaaacctgggaggcagaggttgcagtgagccgaaatcgcaccactttgctccagcctgggggacagagtgagactctgtctctaaataaataaataaaattaaataataaggctggagttgatgtttattggtaaggtatttcactctggagcagtgcccgaagataaagtcatgttaccatttagtaaggaggggtttatgttgggaaatcagagctgacctgtcctctccctcctgcccggctgcagatcttgtcatataacatcaattctcattaactctaaatgtggaattttaagatacagtgtgtgctttgtctatttgtgcttatagaagaagtagcataagagaatattaggatattttatattatgaagcattttcttcttttcttgtcttctcctaaagcgagttttttcaaccctggcactgttgacattttgggccagccgatctttgttgtggcgtctgtcctgggcattgtaggatattgagccacctccctgagttctacccactagatgaccggtaccaccacctcccctatttttttttttttttttttttgagacagagttttgctcttgtggcccaggctggagtgcaatggtgtgatctcgactcactgcaacctctgcctcctgggttcaaccaattctcctgcctcagcctcccaagtagctgggattacaggcgcacaccatcacgcccagctaatttttgtatttttaatagagacagggtttcaacatgttggccaagttggtctcgaactgctgatctcaggtgatccacccaccttagcctcccaaagtgctgggattacaggcgtgagccactgctcccagccctacctcccctatttatagcaacccaaaatgtctccagatattgccagaggtcccctagggcacataatctctccaacttgagaattactaaggttactgtgcatgactttaggggtagattttcagagacgataatagggaagtgaagattattgttaaaatgtactcaaaactatttactttcacatttcattcctgtgagtcaggaaaggagggattgtgcaaaaaattttccgagaaaaactgagagatgagagcaagctcttgagtgggtaaattagctgaaaacaaatttctttattttttcttactcaaagtttttgtggagaatgcatctcaaataaaatgaacaagagggtggctgacccctggaacggctaggaggatggcgtgagtgaggaggctggggtctgggagaaacacaaggagttagtttggttttggtcctgttgactttaagaggttggagggatcttcaggcattgcgagaactgcatgcgtttctgcctccactgtctgccaacatgtggttctgggaacaagcaaggccacttagcctttcactggattgtgtctgacctctgggcacctcccgattcgacctcttatggacgtgtttttccatttgccgtctttattatttgctttgactttctgtgaccatctcttgcttattgcatgtcctggtcattggcttcccagcccccggcaaagcctctgggagcctctctctgggttctatctgagactctagccaggattccttgcaggtgacttcctgtgctcctggggttatatctccaataagctcactcgctcagagctcttcagcacactgccctgccaggtagtttgttatgaggctagtctgtttgtctgaaacgtacttttaaaacagaaatgagtgcagaatgtctctgtctctcttccccgcttgcccgatcctctttcctgtcttctattgttgaaaggctccagaatttcatgaagcctttgtgtgttaactaacaaatattttatctcacctaatttacctaaataggaaagatttatcttctccttctaactctcaaatgaactttcagtcattatgggctagacctttgtttactgtgagatcccccatccgtatggacaggatttctcatggctgagtatttccccttctttcagaatgtcctagatttatgtgcatgtccgtgttcatgttgagaaggtgtgtggtgagatggtggagggatcctgctctgctggcaggtacaagccaagaacacaggttgaagctcacaggtgcagcatgtgctccgacctcctgaaataatggccactaaagctgtttttgttgtttaggcggaggggtagaaacctaagagggaagactggcttattattaatggcagtcgacatagcagcaggtgcttagttactgtctgatacttaaaagattttgagctttattgcctacatattttgaactagatttttttttcaatcctgagttctagtttttgagtttatatttgtgaaattgagtctttgcttgatcatagaactttaagggacagttatttgaaatgaaaacttaggcatttaggaccagggggagaaatgtttgcatttccctttctgtgatttgggcagcagcatctattcagtttttaaaagagctgtggaggggagagagaaaggtatcctgtaattaacaacacttccattagctgttgcttttggttcaagtcagtgggtgtttgattcgtgaaatagatactgtcctggaaaattttataaagcagaatgtctttttgtgaagttgtctcctctccctttacatcataaaaatggaaacttgcttctgtagaacattttctagtgttcctgggattctgatagtcttggacctgagccttaaatgttctttacagcattctgcctcatagaagctattggctcctgactcactttgatttttggagtcttaaaagtgtcctttctagcaggttttattgtagggacttgctctttgttattttccattgaacatggctgcctatgttgcgtagaccagtggttctaaggcttgggaatcgaggaagagagtatgggtgctgaaattcattgcccttaattttgaaaaacatagaacacgtatctttacccttgttaaagctaccatatttagggctaaaatactaaatgcctttgctttttgcaagaaaatttgatagtattctgaatctcatgctactaaaggctgcagttggcaaatatgcctttgatgcatgtaaaatgggaacattattattatttaatatataccgttaggtaaataaaacttagaaattacagagtctgtagaagggaaatataaagttattgttggtagtgttggtggcttaggcatcttgggtaaagtggtagtaaaaccacatcttagaaggccacctggggaatgtgaacccgtgaggcttttgtatatttctatatatatctctatattttttggtaacctgttgctacttttgaaaagaggttccaagaggcaactttgttttgaaacagtaaagaaaacagtaaagaaacagcaaattaacttttgctttttgattatcttaaaggttgatgaaaattgtaaataaggaagggaaaacacatgcaagccggctttggtcaatcaaggaataaataacatgcacaattttactgaatgtgaatgtctggtattctgaaaagtcctcctggtgaagatggctgataagtgcctttgtagttgagtggagtctgaacaaccctgtcccgctgggcattcatgggaaagcactgggctggggttaggaaaactagacctggtcttagacatatcatggaggtgaccttgggcaagtcaggtatttctttcagtcactttccttgttctgaagtgggaactattctgtcactgccatctgcattgggagaaatgatatatgtgagaacactggaaaaaatatgtagagaaggcatttaagtgactatattttgattgaattaaaattttaaaataaattgtttttatgtggaaggtccatttagtaggaacatatctcaggaattatagtgttaactagtaaacaaaatgactcaaaatacaaatattcacatgaaatataattgttcaggaatgtgtgctttgcaagattggaaatcatcccatttcaggagcttttaaacatacaactttattgtgtaaggggaaaataatacatgatcatgttaaggaagtggacagtgtggaaaactgcaaagaagaaactcaaagctgcctggagctctgctccccgaaggtggccagcttgagcagtttgcacactcactactacaacaccttgctcgtggatgtgctttacatccatggaaatgtgctctgcatgctgctctgtaatctccctttttccccactaaactaggtgttgagggaccagtcctgaatttcagtaactcctgttcccaggctgcctccttattgtatagagggatcctaatatacggaatcctctttccttccatgtttttaggttcccacctgcaattacctccttatggtagatctttgtaagtgggattcttgggtgaaaggatgtacacttctacttttttttttttttttttttttgagatggggtcttgctgtgttgcccaggccgtggtgtgatctcagctcactgcagccttgacctcctgggctcaaccagtcctccctctggaatagctgggaccacaggcatgagccaccatgcccagctaatttttgtattttttgtagaaatgtagtctcttgttgcccaggctggtctcgaactcctaggctcaagtgatctgccccctttggcctcccagagtgctgggattacaggcatgagccactctaaattttgatggatgttaccagagcaccctggggtggcacaccagtgtgtgcatttctcggttcttaggagtggaggaacttggttgcgcctcattcacctcccttcctgaatttggctgtgtacttctgttaaaaagggaaatgtatggaataattttttatcccctttagcttataaattctcttaaaagtgaagctgtggcaagtaataccttgtctattctatgaaagaatttcattgtctgaaggctcaaagcatcagaaaagtgaccggaggcagcagctgactacatgggaaactgagtagcaggctcagagccatttctggagtctcaagagtgtcctttctagcaggttttgttgtagggacttgctctttgttattttcctttgaacatggctgcctacattgcatagaccagtgctttccaaggcttggggatagaggaacagagtatgggtgttgaaattcattgcccttaattctgaaaaacagaacattttaatcaagtgtgcttcctttcctattacccttggacctagttttcttgggaacatagtcttgagtgtatatagtaactgggtatctgtgccttttactgagttccaacatggggaccgggagggtgagctgaagattgggtggggacagctccgttcttgctgttgaatagaatctggcctgtgctgcctgttggcttagagctgacggctctgtggatgatggcaagaagttactttcttacatccgtagaattctgtctctagcaggcccatgccaaaatgatggcatctgaaccagcactgacgctggggaggctctggagggggcgagggataagggatgtggacctaagggaagggatggggtgattaacagcctctaggctcagttaagggtcctctctgcctggctggtgggcacgggagcctgtctgaaatggaatcacttgaactcttctgtagttgagggcctggggagtgtcagtttgcagcttgtttctttcactgcctgctattgtttgttcttggcagacctattcattaagctttgtgcagctgtgtccagaattagccaggtcacaaaatatatccagacttctttccctcgtcttcctcagaaagtgttaattaagtaaatgccattcattaatcgtccccaagtaaatgctattctttaatcctcccctccccaacaatccctagtgagctaataagaaaagtgatagcagtggacgttggctgaatgtttatggacattcagtatgtgctagggagtgtgccaagtgctttttgcacataaaaccttctttgcgtttgtgcttttaatctctcttttttttttttttttttttggagatggagtttcactgttgttgcccaggctggagtgcaatggtgcaatctcggctcactgcaaccttccacctcccaagttcaagcgattctcttgcctcagcctcccaagtagctgggattacaggcatgcaccaccaggctgactaattttgtattttcattagagatgaggtttcaccatgttggtcaggttggtctcaaacccctgacctcaagtgatccactcgcctcggcctcccaaagtgctaagattacaggtgtgagccactgcgcccggcctgtgcttttaatcttcaaaacaaccctatggggtcagtggtgattgtgtcctcccttttaaaggtaagacggtatgtcttagggagattttgcagcttgctcagcaagtcccacagacgataaggagcaaagccagggcttcagtccaggctgcgggcgctgcgacccagtgtcttcagtgctgagtctgttgctgaggcttgagatccaaggagtattgatgagaacctagcgtagctttaaaagcaaaagtgcatcccactgatacagagttgctgtcatttgctggagaccttgatcactggagagttctctggaggaaccagggagaaagcaaagggaatttgtgatgcaaatatctgaacaaagccaaaacccttggaaagttaatggacaaaaatatgcctttctttccatctgttgtcagtttactatgttgccttctaggaggtgaaggaaacagccattcctgtttcttgtagaggaatttttaaatagagggagtcggggtggagtcttcacggcctcagtttgtttgtgacccagatgctgctctcacctggcaggggctgaatcatcggtgtggttttggttcggaaagagattgtttgcacgtgtagtgggtatgtgtgaggaggcatgtgttgtttggtgaaaggcatcttaaatgactgccctgggaaggattgtttaaatggaaatccgaggaggttcctgctctgataaatccctcagtgggtcccgctcatctctcgccctccccttccgggtccatatcccctctgcatgtgccacgaggttggttgcagggtggttagaatatctttctcctccaagctgagagcagatgccctggtgtggcctctcttgtatctttgccacctctcatggtggccactgggcagtcagttctcaggatttcattggttccatcaaatgggtggtggttttatgagttttcagcttgagtaataaatgctatttatggcattgaaaagtgtgatttctaggagaagcacacaaaaaaaacttgatcttttggaaacagattgtcctttttctgttcagttcctttcaatggcttcctgttgcatttagaataaaattgtatctctttgccctggtttggaaagctctgaatgatctggtccttacctacctcccccacctcagcaaataacactgtgtcctccctgctaatgcccacacctgatcacattgaccctttctctttgtttctcaaacaagccaaacttgtttttaccttgaaacctttgccctggtttcccctgtgtcaggcttggccctgttcaggtctcagcatggtgtcccatcccgttttgtgcctctgctagcagttagaccctcccggctgtgatatgctgctttttccacgcgatgagggctcctgcctgcccgcctgctgtgcacctggcccatgtccggtgccaggaagtcactcttccggggatggaagaggagagcctggtggaggaacagatacgagcccctgctctgtgactatcttatttttttccccctttttccatacacagtgcatactagtgtgatcccttcttactctgtggcccttgtccggtgccagaaagtaacttcccaggatggaagaggagagcctggtggagaaacagacacaagtccctgctctgtgactatcttattttaccccctttttccacacacggcacatgctagtgtgatctcttcttactctgtaggccttggcctgggattttgtccctgaggattgcacagttagaaactagtgggactgtattgtgaaagtctggattgtgacatagtctcagagcatggaacacaagaatggcatcgagggaggctcccaggcagtcagtagaagggaagaggagaattaaaggtgaggggagcactttggtctgcattttccagtctcttcctgcccagagcccgggcctccacctgtgcctgagatcctgttccccttcccactcacagacattccctaagccacccgatgttccccagtataaaccaggcccctccaggccacaccctgctgggttattctcatcagtgttcctgctgttttctcctttcctgcaaaacacacacacacacacacacaccctcctctcctgcaaaaacacacatattcccttctcccctgaaacacacacatacacacacacacacacacacacacagcctcccttgactcttctgccccctccaggatttcctcatttttctgctcccctgaatagtagaagcctctgaaagggttgttaagcctggtctccaatccacctcctccattcccttttaaaccacacctgttcaccacagcttctcttgccaaggtctcccagggtgccttgtgtcagctctcagttctccaacacagtggctcagcagactctgacatagatgctcaccctcctgggttgccatcctctcctggttccctcctccctccacctcctgtctccttttcccacttctcttctgtccgacctccttattggagggcccccctggggcctgggcttttccgctttggcaggctcacacagtagcatggctttaatgtgctaatgaatcctggattgtcacatcctggccagaaagacctctgtcctgaactggctcttgtatccctgaggctacatcacagttagatgtccagtaggcttctcaccctaacgtgggaaacacacctgctccctctgcatgtccccatctcagcagatggcagttccattctcccagctgctcaggccaaaagcctgggggttgtgctcctctcttctcttgctctcatacccacatccagtccaccaggacattctgtgggcctaactttcataatgtcagaatctcaccaattttttaccatgtctactgctgctcccctggttggagcctccatcttctctcgcgtggtcccctcctgcccccgacagcatattctcaccataatagagtgacattttaaagtcagatggggtcagtccgtatactctgtttaaacccttcaagggctgattacactgccccattttaagacttaggatatggctgcagttgtcaggaaagtgtagttctggcagagggacacatacgtatgtccatgtagcagaatagagaggccagagatagactcgcacaaagatttccacctcattgttgacagagatggaaaagcaagtcgatagaggaaggatagccttttcagcacataattctggaacaactggacatcaataaccaaaaacataaaccttgactgaaacctcacaccttatgccaattaactcagaatggatcatagatctaaatataaaatgtaaaactttttttttttttttttgagacagggtcttactctgtcactcaggctggagtgcaatggcatgatcacggttcactgcagcctccaccacctggactcaggtgattctccaacctcagcctcccaagtagcgaggactacaggtgtgcaccaccatgcctggctaatttccctttttttttttttttgtagagacagggttttgccgtgttgcccagctgccagctggtctcaaacttctgaggctcaagtggtctacctgccttggcctcccaaagtgccaggattacaggcatgagccactgcacctggccgacatgtgaaactttttaaggtgacttaggattaggcaaagaattcttagatgtagtagaaatgtgatccattttcaattctttgcactggaaggttattccccccaaataacatatggttccctgcctcacctcctttgagtactcactcactatcacctcaacactatcacctgaccaccgtatttaagcctggatattaccccagccccctgcactgctgagcccagttatgctgctgagtttttccctgtagcatgtattaccttgtaacatacggtataatgtactcatttattagtttttgcttctctgtgtccttccactagaaatgtatgctctgtgaatgcaggactttttctcttttattcactgataaatccagtttttagaacaatgctggcacatagaaaggactaaatagttatttattgattgaataagaattaaaagtttataaatataaaatactagaaagctgatgtggaatggctgctgggtgacattgaataattttctgataccttattttatttctcctttgtctcacctgcatatttcaacccagtttattatgattaaacatgaaagagaggcctagttatttggcattgagaggaaaaaaaacaaaagagagagatgggcacatgccactgtcaatcctgctttctttccacctctgggctgagcgtaggctattctattatctcttttgttttttatttatttttatttattatttatttatttttgagacggagtctcactctgtcgcccaggctggagtgcagtggcacgatctcaactcactgcaacttctgcctcccgggttcaagcagttctccctgcctcagcttcctgagtagctgggattacaggtggctgacaccatgcctggctaatttttgtattttttagtagagacagagttttgccttgttggccaggctgatctcaaactcctgacctcaggtgatccgcctgccttggcctcccagagtgctggggttataggcgtgagccaccgcgcccggccttgtctcatcttttggccattccagcttaagatagatcgtagttagagtaacagcctctcttaggtcatcactcatctaccactgggcccccagttttggtggcttgcatattcctctgaggacatcgggttgcattgggttacaaagcaggaggtaagctgtggcagctctgggcctggcaggactggtgccacagtgccctcctgctcttgtccctcagaagcaggcctgtccctggtccttccctgtaccccaaggtcatcatgtcagaattggtggcttatgtactcttcagagattagaggaagaattagcacacctgctttattttatccaatgagacaagtgtagtaatggtagaagttgaaatactggtcagggcatagtgaccaaaatttggttaccagtacgttttagaccaaacatttactaattcagttctaaaagtaattaagaagaattttgtttctctttttcaagaagaggaaattctaacagcattctgcaggatgattgccagctcacaggctgtgcataagacctgtctgcccttggcctaactaacctttaagaaccatctcatgtagaaatgtctattatttttatcataggatgtttctgtgaatgtgtgccatttggttctgtgattcaggagaatccagccagttgattaaatccagagataacttttgaagatgaaggagaggtggtgagaagggggtcccttgggtttggtgctggaattggccttcagcaatttacaaaggccaggaactgtgccagggactatacatagtctctgtggcaatataaaatggggatgaggaagaaggaaaagtgaactgatctttctcgaacatctcttacttgccacggagtctgctaattaattcacttaatcctgcagatgggtagctgccagatagactgtgcctgagggactcaggaatcatctggacttagacccctgttagcagatctcagcgaagtggctctcctctcagtacacacagtggtcaggagacttggcgtggagtcaggcggcctgcgttcattccccagggcctcccctaactggctccgtcacctctgtctgtaaagtggggatagtaatggtaatgcctgcctcttgggcttatgagctttagaagggtccacacaagtgctcagaatacttccctatacacagtgagcatttattagatgttacccactgatattcatcattatttgtccctagactttttccctggctgctagagtggaaaggagagaaattgaaggcatttgttcaggctgtgaaatgcagagatcttcggcagaaactccaggtgctctcttccagtctgggctttctgggttaatttctcactggagacccaagccctcacctgagccatataaagttacccctgtatcctccatgacaccgttgtgttctgcctcagggcctctatgtgtctgtgtcccgggcttgggatgcctccccttgctcacctggcgagctcctgctgaaatgttcacacagagtctaagcgttgcctcctgagtgacccctcctgggccttttctctgcctcacactcctgggagagttaatccctccatcttttgtgccatgactcctgcacctgatgctcgccacatttagctatctgtttacatgtcagtttccttactagactctaacttcttgagggtggggccatgactttgccattttggtagcaacagagcatggcttggcattcatcagatgtttgaatgagtttgtgggtcccataggcaagctgggtgactgccagaggggcctctttagtttcatgccatgaccttctaggtgaaatgggaagtaattccatcaaggcttatggggatacagtgagagggtggatatgaagccccgagttggtgccccatgcagatgctggcccctccacagagtccagaatggagcaggacagaagtctgatgaactcaaaccaactttgaggccatcaccctttcccgtcttagaaaaacagcatccagaaatgataggaaatgtttggtcagggcatcttgttatcttattctaaatcttgcatcaattgttcattctccaaactcttttgaattgttttcattttgggcttaactattgcagataagctctttaaattaaaggttgtttttgcctacttgttgtttatggacaatctctgtactccaccttttttggtatgttaagcatttggaatgaaagatcctgtttaaaactccagaatggatggacttcagtcacttagcattgcatttaggtgaaaagggttttttgttatggttgtctttctcgaacttctcttacttgccaaggagtctactaattaattatatgacttaatcctgcagatgggtagctgccaaacagactgtgcctgagggacacgggaatcatctcgacttagacgcctgttaaagtggctctcctcttagtacatacagtggttaggagacctggtgtggagtcaggcggcctgcgttcattcccctgggttcggttcatttttgcttggttaagcaaaccctccgaaggcatgactttgacctgctgcagattgtcatattgtagtgtcgttttgcatacgcttttgactgtttaatagtgacaaccttgtagtcaagtggaaccctgacagaagggtgtgtgtgtgtgtgtgtgtgtgtgtgtgtgtgtgctgaatcttttgtacttcgtaagacccagaaaggcagggcagatgacaaaatttcttgaggtttagaagtctgtgaagttttctcccaaattctcaaaagggaaatttatgaagaaactttatttttaagacatctttttatatttaaagatactttgttcagaaatgtaaaaatggtcactttatttgcatgttcagaaaaaaaggtggggggaactgaactctcaaagtcagaaagcagggttcccgtcccacctccctcgtgagctatcagtgtggcactgggcttcattcctctgcgtcccattttctctgtctgaaaatttaggatgttgagtctctgaaggtcctttgcacctctaagcctctgggatttttcaccttcaccctaccgtttggagtcaagatctccaggtcagttgcctggttttgatgccaggctcacagaggaggtggaggatagtgggctgtgcaggaagctgagggagttaagtattaaggctggagcttgtgttgggtcgagggggagaaatggggttggagacgcctctgggctgggtcagatcccggtgccgcgctggtgttggggtatctggtctgcgcaccgccgggtcctccctggccaccctactgtgtggcgacggctcctccagcatgttcttcaagcctctccttttcagcttcttcatctttatttatctgctctattgatccacatcctaactattctaaaggggctgaggttattttttaatagctcccgcttttccagactctgctgtgttcaggcaacaattcggatgccccttcatgttcctcttgttgcttgctgcatgtcaaaccctgattggtaggaagcttctcgaggctcggactgtgtattcgtgagtttcagatgcttctgcatgtttacacaggtcacttttcttgactaaatgattgatgtagtaattaggattaggctcaggagatcctctaataactggcttaagcgggacaggagtttatttgccctaaagaagtgatctttgccaccagagctgtgtgataactgcatcccgctcccttctcggcctgtcctggggacagcctcatcctggtgctcggaggcggtatctcaactccaggcagcaggatgaaggaagacagggcacagaggatccaccactccagaaggaagacttctggaagattcttccattccatgagccagagtttaaccacatgagatatgtagctgcaaggaggctgggaagtatctgtaacatctttctttgttggccattcccagctcagagttttaagtattagggaggaaaggagaaacagacattggagcaatgaacaattccacccccgtccccctcacctgatttgttcagcgaagggtacctcctgtgctgcacaggtgttgacgctctcttcgagaagttccagaggcatttgatttagctgcagaaattctccaccgtaggtttttgaggagggtacaagaaatggtcaaaacagtacttgaggatgagatcccagcagcaatatatgcaagggacaaaagtggggtaaggattggagtgaggaagaccagctggcggctgcagccagaggccctccctggtttcctttacaggaacggaagcctctgctgtcaattgagccagactattaacctttgactttgagattttataacttgtttctgcaaggccactaaaatgtagcaaatttaggagttaagggcaacgttagacaaaaatattattctgtatcaagcttaagacaatctcatttgacctagttatttgaagaatatagctggcaaagacaattccaaaaatatagtgtatacccatttttactttctgggtagagtatctaaggaactataaaatggccctagaaacaacaggaatgaagaatgggcctggtaattgttttcacccagtgaccagcttctgaataagtaacagttatagactgcaaatttaaacctagagtgactgattttacccacagcattttctttctccttacgattattgccttcacactaagaatttattatttattgaaatcatctgtatcaagtagcatcaaatttattttatcttgccagtttttatagatccacttttagtgtacactcttaagtagaaaatagaattttcttgcagttttaaaaatcctttatactgtggaatctctaataatacatttatttagcatttctctttggcctcattctaaaaagaagtggaaacatcgctcgttgtgtatattttctcatttttggcctcaacatacaaacccatcccaagatcatgtctttattgattgtacttattttacagctgactgtgacatattcgcactattgtgctattataaatcaccttctgctattttactctgctattcattttttcttgtatgggaaagtggactccttattttcatttcagccacgtgtgcactctctcgctgttacttattactgaagtagggagcatttgggaactggagaatggcgtgcaaatgaagaaggccttctagggattggctgtgccatgtgaacagtcctgggcgtgccatccatggagcatgccaatattgcccagaagttttgggtcagcttcttttttgtgtgaccttggtggaaaccactgagctccatggtattaagtgggccacgtgtcttctcagcgaggttcttacgtaggtatgaaggaaggaagcctgttgtgatccccgggggagctgtgagtgtagagctggctctgaaagccttggcatctctcctgcaggaagaatcccaggagcaggtgaatcccacctgcattgagcattttttcagtttaaagcaaatccttactgctagagtatatttagaaagaggcagggccagggccgtggctaggccagcttcgtaggtgatgagctctgtgttggccatcagccttaagtgtgttgatttttcacagcaggtcactcagcagtgtttatctgaaaatactggcttggtgctattaattaaggatgaaatgaaaagcttgtttctgtgttagcattgtctaaaggactgtaaatagtgcttaattcattatggatatttggtgcccagtgaagaataatttaccaagtttgtaagaacagtattttcttcctttttaaactcttttatttcttaggaaaccagggctgtacctcttagatcattgaatagtgcagaggtgcaggaagtgccgtttattgggatgactggtgttgggcagaggggtgaccttaccctccagtcagtcactcagcacacaggggcttcttcccttgactgtcttcctagcaaagatgacctcgtctttccttgaagatattgataccattcagctaacacttcattttctgccatatttgtgttcctttcatttttgtgtgtacgtatttggtggaccgttgaccttgataaatcctcagctttacaagtacaattacaactgtgtttctcacattacatgaagtgtaactgaaaaggttcagacaacagatttttaatgatagtaaaaacaaggactaaagccataaaacactcttgttttgttttgttttgtttttgcaatggagtctcgcttttgtcgcccaggctggagtgcagtggcgtgatctcagctcactgcaacctctgcctcccgggttcaagcaattctcctgcctcagcctcccaagtagctgaggatacaggcgcccaccactacacctggctaatatttttgtatttttagtagagacgggggtttcaccatgttggccaggctggtcttgaactcctgacctcaggtgatctgcccacctcggcctcccaaagtactgggattacaggcgtgaggcactgtgcccggccgccataaaactcttaatttatattaaattagtgtaaataagagaaactctgcttgcaagtgttctttgccttgtcattatccagacaggaacttcttcactttacctcttgttagaaataccagaattgttagaaatagataattggtaccacgaggaaccgtcagcgtggagacaaaagatctctcagcaaagcaatctttactttctgcagaaagggtgctcaatggcagatggaacaatgacgagagcacacctgaacaaaggaaaagcagacatatttatcccttacacatttgggtcgtccttactgctgtgtcctgcatccattggctggagcaggaccacacactcttaaactgatacccagtttgctaatcgcctaaaactttcctaaataggtaagtgcaaagaagaacaaaaaagttgcttaggaaaggtttaaggaagcaataacaattccaaatgagaaaggggcataggctgtgagctggaacgtgtctgtgagcatgtccaacagttacataggatagggcttagcaaagagttattagcacaaagcaaggaggcttgaagaaagttagtctttaaaataatcttttatttctaacacttatgatttattctttaacaagaaggggagctttaaagaggaaactttttactttctacatctctttatgccttagggttggcaagatggtgaaacaggtcaggcttgatcctaaaacctgccacagagtcataggagactcatttggtccttggccatcttcagcttttatgttggcctctccttgcatgagtcagttgacagtagcgtattatgccagagtagttttgtttgtggcaaactcttgttctggagatagtttgcacacaaggtaactacagttaatgttaatgtattgtgtagttgaagattgctgggaaaatacatcttaagtgatctcaccgcacacacagacacacacacacacacacacacacgataagtacatgaggtgatggatatggtgattagcttgattgaatcatttcacaatgtatatgtgtatcaaagcatcacactggattccttacagataaacaatttttatttcttaagtataccttgataaatctggggaacatttttaaaaattaaaaaagataaggtgagaatcatcaaactgcactgtgggatgagggctggagagtcagagaggtacccgtggtagctatggggctcgttcattcctgccctcagggaaagtcactcaaatccacacttcagtgatatctcagctgctgtgagtttaggacccattgggtcatctgtagacagtcagaactacgaggctgtctcagggaaggccagaagtctcttctgtgctatttctttatccccaaatgaactgtatgcttcttcaagattggatcacattgatttctcatgtacttttttctgtcccacacaatgccttgcacatagtagacagtaaaatattttgatgaactgaatcagacagcagttaagtacaaaatcatgtgatctgaatgggaagaactgttagagctccggaaaagtagagtgctatgaactggaggagttggaatgagagggaaagttcccatcagccactgaactggttatatataatagttacaaaaccaatgtgtaagaatgatctgtgcttatctcatttatttatctaatgaatacttatgggtattgaactaagagttagagaaacagtgatgaacgagacagatccatgaatcttagaaacaaattgatatgaaatgtcgctgtcactaggtgtgctccagggagtcctctaggacctccctcgataccaaaccccgaaggtgctcaagtccctgatgtagaaggatgtagtatttgcatataacctatatgcatcctcctgaatattttaaatctagattacttataatacctaatgtaaatgttagataagcagttatactgtatagtttagaaaatattgacaagaaaagaagcctgctcatgttcagtacagaagcagttttttttcctggatattttccatccatggttggttgaatctatgggtaaggaacccatggatatgagagctgacaataattgtaggtagtgacaagtactgagagggaaatacagcagtaaaggataaaggcaatagtgtggggacacaggcagcctgctttcattaattatttaacttaatgaatgatggggtcttgctctgttgcctaggctggagtgcactgatgcagtcatagctcactgcgacattgaacttcttgcctcaagcaatccgcccacattggtctcccaaagtgttgggattacaggcgtcagccaccacacccaggcaggctgctttagatggggaaatcaggggagggctctgaggtgttaacgtttgagcagagcataagtgaggtgatggatgaaatcttgtaaaggtctgggacaccagcatcccaagcagaaggcagatgttgggttctgagatggggaccgagtgtggccagcttgagggcctgccagaggctgtgcggccatgaccatgagcaagggccttgtaggacatggcaaatactggatgtttgttaacagcagtgggaacgtgttactgttagaatatcactgaaggcatctgtttcatctctgaaactcccctactttatcttctacctctgcatcaccattactgccacccctctagactacgcaagcatgatcctttcccagggtaccataatcagcttctaaaagtcttcatggcatggcgatctcaggggaactgatgctagggaggatgggagaccagctcagtgacaattgctgttgtccctgggtggtagcaggggaagtggtgagaggtggttagattctcagtctgttttgaaggttgccaactggattggctgatggaatagatgaagaaagaaagaggaataaaacttgactcctaggcttttggctgcagcaactgggtgtgtggtggcagcatttcccatgaatgaaagactggaaggagtgtattttgggggggaaagtgagacatgccatttggtcctgttacgctggagtgtgcattagctatggagtggaagtactgagtagctgctgtgtgtgggagggacctggggctcttccactgctttccttggctgacagatgattctctaagtggggagacttgataagatcatcaggagagccaacgcagatggaggaggggtgaggaccagggactgagccccagggcgctcctgtgtttagacacgtagacgatcaggagactgtggtggccgagaaggttggatgaacacaagcgcagcctgttcccctggaagtcaaataaagaaggcaattcaaggagaagagaaccactgtgcaaaattctgctgcgaacttttatgtgtgagctgtataaagccatggagcgacaggagctgggagccgacattactgtttacaatgcaggggtgtactgtgtcttcctgaaagtcacttagtattgggtaggggtgtggcagttaatgtcttctgaatttagactgtgccgaccttcaatcttttaaagcatatttcctgtttattttcccatagctaacctttatagatgcaaaaagcaaaagccatttccagttattgtattggtattccctgggttgtatctggggattctcatatgctgtcgagaacaaggtatatttgggtaacttacaaagtggagatttcgcaaaagcctgtgggaggcattaggagctacaagatatgtgggcacgatgagtgagttccagtaagtggtttagccctaaacctggtctctctgcctgacacctgttctcagcatttggccccatcttccattcagttgtgcaaaccaaacattggctccagtggcacttcctgtctctcccaccatccttaccgtccggaagccctctcgtccactctgcctcacaccatgcacacccttgcacctgcagctgcccccaccctaccctctggagtggctgcagagaacagccttccctcaccctctcttgcccttttgtctgctgtccactctgaagcctgggttatattttaaaattaaatctgatcgcgttacctcccccacttagatccttaccatggcctctctcattgctcacaggacaaagatcagaatccttggagaggcgcaaaagcagcacacggcctggccctttctcctaccctggggccctgtgaggccttctctcccaggtcctgaattcgctgttccccgcccctgcaacaccttccccagacacctcttggcccttgttgactgcagctcccaccttgtggtacagctcagcagggcccgtcctgacccctttgtgtgggtgacattcctgtgtcatattcttcatggcactaaactctttcacctgaggacatttcctttcacttgcagtggcatggtcatagttattcatgtttcatctctccggctgtgaactccccgaggcgggagccgtcgctatcttggctccgactgtggctgccacgtggagacgttcatgtgtgtttgttgggtgaattaactcaagtgcataataacaaaaacaaatggaaatcttcctctggaaagacggaagaccgttagggtcagctcacgtggaaacagctttgcatctccatgcccatccccacttctgggtcctccttactgacccgcgacatcctctccccacctttctccctctctctgggcactacagctggtcacttcccacacatggtcgcatgagtagaggcttagcaaggagtgcgttatggaggacagatttctgctactgacttcgccgaagtggatccacagcttccatttggctcaggctctttgggagaatttcacttcttttgttacctctaatcttacctatgtgtaaccacacattttggtctttttcttaaatcttttagataatcatcagataagtttacttacctgttattctactactttctgccttgccttttcttcaggccacccccaagtgctataacctgcccaaaggttaggacataacaccgctgccacacgtttatctctgggcataaccacgatggcataaacaccagcattcccaatttttctttgtctcttcggaatgctgacaggcaaagaagagcattttctttagtctccaaatgtgtggctcacgcctgtaatcccaacactttgtgaggccgaggcaggtggattacctgaggtcaggagttcaagaccagcctgaccaatctggtgaaatcccgtctctactaaaaatacaaaaattagccgggtgtggtggcaggagcctgtagtcccagctactccagaggctgagacaggagaattgcttgaacctgggaggcggaggttgcagtgagctgaaattgcgtcactgcactccagcctgggtgacacagcgagactccgtctcaaaaaaaaaaaaagtgatgtgtgcttattaaaattgctgcatgtatttactaacaagagtgagaagattgacaagtttcaaaacatgatttagattcagtttacttggccaagtgtctctctctctctctccgtaatacatatatttcaaggaaaatattagatattacaaaaagccaccctcatcttttactgtcttatcaagatgagttattttttccaaaatatcaatttttaggatttgattttcctaccaattattaagatagacctttaggatggagtgaaaatattttagtatcagttagtttattctaagctatgttttttttttttttagttttttaaatctttaaaattttacatgagttatcagtgaaaccaatataatccaagatgtttctctctctctctttttttttttgttagaaaattgccccacaaatggtttaggcaaggtaaaaaccagaggtcgataggtagattcatacatacctatcccttgttgctgttcttggtcaaaaattaaggtgaggagttgccctgttgtacttctgtttcagattaagactgtcgaattaccccatgaaattgaatgtgtattttctccattttagcactgtaaagatcagaattctgtatctaaaaacttgtctaagtctgcaattctttataaagggccaagtccatgtttttaacctcactcgaagttgtcctttgaacatcggctgtccctggcaaataatgattgactctgggcgatttgtctccactgacatatccttaacaggaatcaaaagttacggcagctcctgagttcagcggtccctacgcgagtaacagcagtctgtgagtttacatagttgtgggtcctggctgagtcattttatatctcaccatgtggcttctctctactcagtaggtgagtggaagtgtccaaccttaagcagacttttctggaatcaacaaaaccatgtttttattgctgcagccttggcgaggaatccagaagtttcgggttggctttgaggtagccattctgttgtctgcacatctaacgtgcattcccatgcctgtttaaggtggacttttaataatctaaatggccccagtagaagacatttcagtaaattggggaatgcctatacaatgtaacagcatgtagccatgtcaaagtcccgttgaggaagaatacttagtgactgacatggtttgcacctgttccctccaaacctcatgttgaaatgtggcctccagggttggaggtgggcctagcaggaatgtttaggtcatgggggcagatcccttatgaatggctttgtgtcgtcctcacagtagtgagtgacttctcactttgttagttcaggcagagttggttgtttaaagagcctgggaccacctcctctctcgccatgagatgtgtgggctcccccgggccttccactgtgcgtaaaagcttcccgaggcctcaccagaggccgagcagatgatggtgccgtgcttgtacaggctgcagaactgagagccaaagtaacccctgttttctttgtaaatgatccagtctcaggtatttcttcatagcagtacaaaacagactaacatagagacactggaaagtgtttaataaaaatgctgggtaatagttactgagcataaacgatgtgccagacacatatgttcatagatttcatcctcaaaaactacatgcgtgttttcccaagttcacagagtgagtggtaaccactaggcacctctgcctctgtaccatgtatcacctcctttttattttctaaaacaatgcataggataaccatcacagtttctatccaacattacatacacatacgtgtgtgtgtatgtctggctctctggaggcaagatgatgggtgattttaatttttttctttgtgcttcccagtttttctgcagcatagatggataaatgttataaaaagaaaaaaaaagagtggatgtccttagcactaggtatgtttagaccaagtaggaagagaaacagtttcaaatcagaataatgatccaccttcctacaatgtgatgtgccctgatgtcttcattactgggagaaattaaggactgaccacagtcgactctgcaagggagaccggtttttgtgcagttgttggacacttgcaggtgacttgctcaaggtcaggatgaatctaaaataacattcaagctcagttaaagaagtttttttttttcctacaaaagtacgtatttaggatgctttgcccaagctccgctttcttttttattactctgagagctgcttcccttgcctgagaatccccagacctccttacctctgtcctgtgactaatccccacttgtcaatcatcttggagaaaaaatttccctccctgcatcatgaccatccttgtttcacatattaaagcagctgaaagcactaaaactcttttattccacaagaggctcttcccgcctctccccagtgtggagttgaacccctgcctccgtgcctccattgtgtcctggcagcactgtgtcctggtggcagcatcttcagcaagttacttgttttgttttgtttttacctaccagaaagtgagttctgcaaaggcagggactcatctatctgacagtctgtgctgcccgtgcattgccggcacgcagggtgctttccagagggaagtgacacacatgtgcctcttgtgaatcgtcatctcaggcatgccagctcttgaggccacacttagactaagatgtcagagaagtcagtctcaggtgcaggagtcaagaaaaaatagattgggtagagaataagagcaattttgagagcctgatggaaaaaccaagcagacattaccaaaggatgaaggacacgagcctcatgcttttactaagctgtatgagtgacatggggaagcaacttatgttattagtgaaaggttctttctctctctctttttttttttttgagacagagtctcactttgttgcctaggctggagtgcagtggcgcaatctcagctcactgcaacctcggcctcctgcattcaagcgattctcaagactcagcctcctgaatagctgggactacaggtgcccgccaccacggctggctaatttttgtattttttgtagagacggggtttcgccatgtaggccagtttggtctcgaactcctgaactcaagtgatctgcctaggattacaggcgtgagctacggtgcccggccgggaaaggttgtttttaaatttttttttacttttatctttttgagggtctccccctgttacccaggctggagtgcagtggtgcagtcactgctcactgaagcctcagccccttgagcttgtgccatcctcccacctcagcctctcatgtagctgggactgcaggggcatgccaccgtgcccagctaattttttaaaattgtattttatagttatggggtctcacaatgttgcccaggttggctttgaacttgggcccaagtgattctgctgcctaggcctattgtacttgcatgatggaaatggaatataaaggcctgtgttgttttaatccacatttatggacaagttagtctcctgttgtcatctgtgtcttctgaaggagtcacctgtttggttaaataaattctggccgttttctcttaattcatttgcctgaaaaaaaaatttttattctacctctcctttgaacagcatcctggtggggaagaagttttaagggaacaagctggaggtgacgctactgagaactttgaggatgtcgggcactctacagatgccagggaaatgtccaaaacattcatcattggggagctccatccagtaagtacattttgggggccctttcttatttgtatttaaggctatcagatgaccttaccctagtctgtaagcttgcatgtatacacattttaaaaggagtaaagcaaaaacaactcctgattttaggacaccattttttgttataaataaattgaccaaaaatgtctttgcatttcactgttgcttttttttttttttttttgagacaggtcttactctgtcacccaggctggagtgcagtggcacgatcatggctccctgcagcctcaacctcctgggctcaagccatcctcctgcctcagcctcttggtagctgggactacaggcacacacctccacgcctgataaatttcatagtttttgtagagacggggtttcaccgtgttgcccaggctggtctcaaactcctggactcaagcgatccacccacctcggcctctcaaagtgttgggattacaggcgtgagcccccacacctggcctggttgcattgtttactggcacttcgttttagtcagcaggctccaccccacagccatgcactggggagtctgctcagtcctagaaattccatggggcagcacgttttacaaggtggggagaatcaacccagcattgctttctttccttttctgaccaaaatatttttattaagaaccccacttctactttcattaggccaaggatattttagttctaaaaaatgatttaaaaaatataaaaacggagctatgtgaaatgaataagctctgccttctgtagaactagcacattgtccatattctactcactgtaccccagaccttcgagaatatcagctctggaccaattcattgaccaacttttgggaaaacactggcctaatttggcttttcttttctttttttttttttttgagacagagtcttgctctgttgcccaggctggagtgcagtggcgcgatctcggcccactgcaacctccacctcctgggttcaagcaattctcctgccttagcctcccaagtatctgggattacaggcacaggccaccatgcctggccaattgttttgtatttttagtagagatggggtttcgccatgttggccaggttggccttgtactcctgacctcaggtaatccacctacctaggcctcccagagtgctaggattacaggtgtgagtcaccgcacctagtcctaatttggcttttctataaacactgtgctgtgttacggttttagacccctctgtggcagttgtaaatgaccatgttaaatgttactagtctgtcaacctaagttatcaggaaaatcgctgaaaacttggaaagaagttgccgagcgctctgagcttctggagtggatcctggggccgcacactcagctgccctgtccacctctgggagtgcctggctccgtcctgccttcccacttgtggtgcatggttagcagcccgccagaaggggacaaagacctgctaggagcccgctctgctctcgtaagaaaaaaatggagaggcaaatagcctcattctaagtgagcaaactgagaaactcttaaagaatataggaaaagtcttatcgtataccactgatgatccctgtaatgactgtgaatgaagaagaggttacattaggttctttgtagaaggctcgaaagtaggaaatccatttgagaacaacttcattgagttgggaggtttgtttgattttgtttttggtggtaggagatatgtactttgagggagtaagcttcattcatctgacaagtttatttgccccgatattttcatcccatacttcacaaaggcaaagtgtcttagggtcatcagggaggcctgccgttacacatgcctgatcccatccttgtttccagctgtgggtcaggtttcaggccctgactgtggcacttctgcttcacctgcccactgggcttccccctggccagcctttaaacacactgtatttttgacagcttcagcctgaagttgaaatagtttatgactctaaaactgggagactgcagggcttaactgaagatatcatacacgtaagagatacatgcacaatctcaaatggaatttgagaggacagaagggaagaatcagtcttcagctcctccctgaattacgtgtcgcaatctgagtctaataaatgtgtgtgcacatcagcatgtacagagagctgtcatgggtgctgttcgaaactttggaactctagatagaaaatatctcttggcacttaatctgctactaatttttgctgttaaatcagatggatcaaactttgtgtttaatagctaaatgttgaatctgaaatggtaattactgaattataattttaaaaagtctcaaagtcagcattttggaagtggtactttcatagatttttaaattccataatgtgccttatcttttcattgcaggatgacagaccaaagttaaacaagcctccggtaagtgtgaccatctcaagtatctctggatgttctcgttgtatttaatacttgtcaaactgaaggcagagggtttttatttacctgactgatgccagcacaggtctttctagataaatgaatatgtaacctactggctcagcaagtattttttatttacggaaacctgtcagtatgatttgttaggatggcgtgtgtgtaatttttttaaggctgtcagtaaactacttttttcatcataattatcaatatataccatttgaagagctactttttatggtagcacgtgcttctgatctaaaagatttgacacaagccttattttcagagaacttaaaatctgaatggatagtggttttattacttaaatctttaagggtgtgtctcatgtcttcttcatctttaagtctcttgggcatagtaggtgttcaataaatacttgtcagatgaatttaatgaaattaaataatacccttttgacttacttttccttgggaaaggaaaataactctggcaatactagttttatgttctgattcactagcctttctctctgaactgaccatctcacttatatttgaagataaatgtagggtgagaatggaagagcacagcctaagttcctgaaaagtacaagtaggcaaaatagtttctagtgtctaattaaaggactacaggggaaagttttgcttaaatcaaatgacaaaaaagaaagtataatttttcgttttggtgtaaattcttggtttcattagagaaagtgcaacagcaagaccccactgagcttgtgtcgagaactggtgagctgattttttgagctgttgctgccaagacatcatctttaatctacaaaaggatcaaagcagttaatccaataatataagcataaaggccacatttacctcaacatccctgatagtacaataaaagtcttgtgtaatactatttagtacaaagcaattttttttatattctctccttattcaagaaagacttaagttcaatgtgaatgatatgagtacttccaggagataaaaagttgacttcagaatttcaatggcctctgtgacaattgcttagaatccttgctgtgagttcatttgactttagcatcttttttgaggctactttttggacagctgaaattctgtgttgcataaagtttttcctttttctctgaagtctcttaagggaagaatatatattttttttatcatgtgttcagcatgttaatcattttggtataagtcatttagctatagcaaaacaaaggtttaagattcattagatgaacttagatgaccgcagggccagccgtctcgctaaccataaagactacaagcagaaaacacttgtaggtgtaagattgtacatgtgtctcctgccataactactttcagtttaaaggacaaagactttcttccttatttgcttttagaacacgtgtattacagcctatactctgttggattaattgcccattactatttattgttcttattttctattttaaagtggcagttactttgatactgagaatattttgggaacagagcaagtttatgtggtaaattctgggactttagcttttagtatcaaagaaagctttcctgacaacattgaggcacagccctttgtgcgttaagacatggcttacttcattccagcattagcagttgatacttgatcagcttgttagatgtagaaggtctcactgaagtttgagaatcacactaactttttaaagtagatttttgtttgtttgtttttgagacggaattttgctcttgtcacccaggctggagtgcaatggcgtgatctcggctcactgcaacatccacctgctgggttcaagcaattctcctgcctcagcctcccgagtagctgggattacaggtgcctgccaccatgcccagctaatttttgtatttttagtagagatggggtttcaccattgttggccaggcttgtcttgaactcctgacctcaggcattcgcctgcttcagcctcccaaaatgccgagattacaggtgtgagccacggcacccagcctaaagtagatgtttttactctcttcagagattttacagattaactaacttctgagtattttttaaacaactcttctttattgtgactttgcttcagtgagagcagaaccggaagaatgtgggacaagaacttgctggcctttttgagaggccataagcagatgaaatgaaaggaaatacatgagcatttttctggatgtatctttcttgtgcttttggtttagtggaagtaaagagtgtccttagggatttcttttgtcatgtgtctgtataaccatcggccgatctccaggttgaagaatgtacactgtggtctaaagttttgagatgttgcctgcttaaaatatctagttgaatagtgaaataaaatgcagtaaagattattagcttgaacctgccctaaggaaagcatagtgttaagttaccaaattaagatatttgtagacttagaaatcatgcattttaatctaacataaatgtttctatcacatttgcttacatagagaatattagtcgtagcaataccccttcttggttatagttttgaaagcattcttgtagaagttatttggtcctcacagtgtctccatgttagacctgccaagggaggtaggtacattgcagctgggaagtgttaagcacccggctcacagacgtgctccagaaccatctagcacccatctcaggctggtcagttgcagtcccttaagcttctcctctaggttctgggcttgccgtgttagacatcactctgtcagtattttaagggagataggcttcccactaaagtttacgttagatgaacttataaatgagatgactctgattcacaaaagcttgttgggctttgcatgcttttcataatttatggagcttactgtaatttacactgattcacatgacttttataagtcattatgcatgacatacttattttacttttttgagacggggtctcactctgttgcccaggctgcaatgcagtggcatggatctggactcactgcaccatccacctcccggggtcaagcaatcctcccacctcagcctcccgagtagctggaccataggcacacagcactgtgcccagctaatttttgtatttttctgtagagacagggtttcaccatgttgcccagactggtctcgaactgctggactcaagcaacccgccaatctcggcctcccaaagtgctgggattacaggcctgagccaccatgcccagactttgacacactgatttaattgttaacctctttttactgaagttgaacctcgaagtcatggagtgaacaggtggcagagccaatcataaaaaccatattctttctccttgttcattgctgacattctttgatagtcacgtccctaaacccaagtgaggccctcagagcactgaccactaaagaccaattacttttccatcaaagtgcaaagtggtaattcaaacttcctttaactgtcaagcatcctgggctacagagccaagaagataatcaacaatcaaaaggtgatacgattatttcaagttcccctctttagagttcatggctgttgctgatgatgctggtgccagagtagtgttttaaccttagcgctctcccatggtaaccacaaaggcagcaggagggcaggtgggaggttccagagttgtcagcacgttggtgaaatgcctgccctcattttaacgacgccgtggatgtttgtgtttgccttccgttggctgtttcaaacttaactttctagtttgacaatcatattttaccttcagtgattcttttgtttcagaactgattgtgtcctctaatagctaactaatatttttgtatattttgattatttctagtaatttttgttaattttattcatatatacacaatttggaaaatcctcttgctgtagttatgaatactttttatagatgctaagattttaaaattgctggaatagataataaatttgcaattttatttttaaatgacttaccttttttcccctactgtgtcaggaaccttaaaggcggtgtttcaaggttggtgggtctcataactgctttgcttgcttttccctgaaaggggtctgtcttttcacgggagtttctctaacgtgctttgcagagtgatgcttgccttactgcaggccgctgattgttttgctaatgctttttatctttgctttgggaaactgcagatctgaagctgtcttatttatggcaacttctgtttgaggccctaatgcttatgttggtgtggaacatcaaaagaatgcttcttaacccattttcaagccccaaaaagttgatatttcactagaccttagcttttcagctgttggagaagtatgcgtttttccagaaccattgtccattcactttagtgctactcaaaagagctgctcccagaaagctctggaggataaaaacagggcttccttatctggggatttgctgttaggctgacagtgaccagctggtgacaagtgtgacgccgggcacagcagtcctgtgaggctggtctggtgtcttgctggttccgtctggtcagaattaaagcagccccccgggaaagttggcctagaatgtagaacttaaaatggcagtcctcttttttctttttggttcacatatatttaatgtaatttaggtacacttttttacatctgtcagatttgaatgaaataactgatgtttttattgaacattgtgttcatgcttttgaagaattaaactgctttttctaaaggtgacgtgggattgtgtgtatgtgaacatgaatgtctgttttcagtttctgcattatttagatgcctagcgtgtgcaagatattttatgtagcatattaattttgaatgtttttaaattattgaggttatgtccttaagtaaatataatgattaaaatgttttactctggaagaaaacaaagttaggcattttagtgaaaagaagtttataattttccctttcgacatcttctgaagaatgcattgcataaaatattgtgttcttattttcaaacaggattttagtcaatgaaataagttcagcattcccttgaacttactttactttttcctctcgtgtttcaggaaactcttatcactactattgattctagttccaggtatgtggtagctttcttttaaagcagtagtgggtgggagggctcatgggtccaggttggacaaggtgcgtcccccaccttctgggttcctgggcctgacactgtgctgtctcagcaaccttctgctgaaggccagactgttcagagcactcagcctcaaactttcaggtagccgactgtgaacactgtccacagccacgtgatctagctggctggctgcatccaccccaaggaacaaacagaacaattgcatttccttttcccccagggcagcatcttaggcggccagtcccacagcacctccctggctcatccaagcagacatttccttcctttcaatccatgtctgtttcttaaactctagtgattacatttccctaaacatgggtcagttttcctttgtcatttttattagctttaaagttgaagctggtaatctatgtgtagcacgactcaattgttctaggcaccagatttgtttatgatagtccaagtgcacattaacatctttggcagctctaccatattgacttcagtagtagccacttttttggacccaagctcaaaaccacacatttgtatttcatcctgtcaaatttaactgcctcagtccgttggtgttctggaatattccctgcctgcaggcagtatttcaccttactcttcattaacaagccagtttctttctaaagtgaaattgaaaaaccccaccaaaccccactaagacaaaagttacacttgtaattcttatgaaagtttcacttgtaatccttatgaaaggattatacttgtagtccctatgaaacacatatgtataccaagtctatttctaaagcctacacattaatttccatttttctaagaaattaagtcaaagatcaaaatctaaagattcaaatctaatttaaagattcaaatagaggccaggcgcggtggctcacgcctgtaatcccagcactttgggaggccgaggcaggtggatcacgaggtcaggagatcgagaccatcctggctaacacagtgaaaccctgtctctactaaaaatacaaaaaaattagccgggcatggtggcgggcgcctgtagttccagctactcgggaggctgaggcaggagaatggtgtgaacccaggaggcggagcttgcagtgagccaagatcgtgccactgcactccagcctgagcaacagagcaagactctgtatcaaaaaaaaaaaaaagattcaaatagaaattatagctcatccctcctttgtccctgatttgatttgtaatctgtaatttatagatcgaaattctatgcatcaggactgtaaatttaggcttttttttttttttttttggtgaatttagacctgtggaccacacaccaagtagtctggccattctgtttcttaaccctttaaatccacttcagcacaggtagtaaagattagattttccaaacctaagcttaaagctgtggtgttaatggcagtgttaatcatcacagggcccatactcttcaactttacagctggtggggcattcattttttggtttgtttatttttgttagtttgtttttgagacagtctcgctctatcacacaggctggagtgcagtggcgtgatctcggctcactgcaacctctgcctcccaggttcaagcgattctcctgccccagcctcccaagtagctgggattacaattagctactgccaccacgcccagctactttttgtattttttggtagaaggtttttactatgttggccaggctggtctcaaacttctgacctcaagtgatccgtctgccttggcctcccaaagtgctgggattacaggcgtgagccactgagcccagccaagtggggcatgagttttctcataaagccagcagggcagagtgattcctagtatagcagggcatgtgttacactcatgtcacttttagcaaatccacgttgccttttcagcaaaattcattacagagttaagaaaaacatgccctggtaattttctgttagaaggagcaaagattttgagtccaccacagtgcacatcatgtcagcatcattgctttttgtgtctttctagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaccgtgtttgcctgtttggtgtataattgtctttaatgtttagaatctggttatttagaggattccttcaatgtgttactcatccagacccacagaggccatatgactggaggtgcgggaaataggtttgagtgtctcctttcacatcgtcacatctcattgagtaaccatgtattgtatgcttccgatatagtttctttttttcaaggaaattaagaaaggccagaaattatagtttaaggatttctaataattgttctacttgaaatagatcttaaaaagaaagtagcggctgggcatcgtggctcacacctgtaagcccagcactttgggaggctgaggtgggtggatcacttgaggtcaggagttcaagaccagcctgaccaacatggtgaaaccctgtctctactaaaaatacaaaattagcagggcatagtggcgcatgcctgtaatcccggctacttgggaggctgaggcaggagaattgcttgaacccaggaggcagaggttgtagtgagctgagatcgcgccgttgaactccagctgggcaacaagagtgaaactctgtctcaaaaaaaaaagaaagtagcctacagggcctataagagagacttcttatcttcactgattgaaaaacatcagcaacttaaaaacacatgaaccatgagagggcatcgcaactgtccattctctcagcttacacgtatcattgcaaaggcactcacagcttcataggttctaaagttttaagaattcctcattcagagagtagaattgtttgtaaactcttctaaggaaaggctggttttctaatttgtaaggagattgtgggacattggaatctgatctttgaagaaatttagcggctagtgtcaagctctgaagagttctggtgtggctctgtctcctcctgggggctctaaggggctgattcagtcatcttacttcccatttattattctctgccttatgtgttattcttttaaatgtggaaacttgaaagctgaatttgttagaacccagtacatgtgtcattggctgtgactgcatttgcactggcatgagctgacaaaccacgaggttcttcagaagtgaccgcgtgcagtggaaaggaattgtgttgttcttacagagtacaacctttataatcaaataggatgcaccgcctttgccttctttagtcactgaaagttgacaagtagtttctatttcaaaataaattacaacacttgttaagggacctatgtaaatatttcaatatttttggttgtgatttttagctataaagcttcacattttagtagtttttaaaacattgctcctaaatcaactatgaagtgaatcgaagtgggtcagtcgtaccttagatgacattaaagggttaacttgtaaatcatttttaagatgttgagtaatagcatctgtatatcgttaagaaacataacagttgaactttgacatttttatcagtgactcagcaatttgctgctgtggctggcaatgtttcttcatgtgttttgggaacaacatgtggagtaaaggagagtttacttcctaattttaacatttacagtttgtgcagccagactctcaaggaaagatatttgacacttttttctctattgctttcccttcagagaggtgagagacttcagaggctgccctttcttttcatctgctgcttgtgaaaggaaaacatcttgggcccccagaatcactaaggaaaactcaagctggaaactgcttagggccaacctgcctcccattctactcagtcaagcctctgctcactgagagagaggcatatctgattgcttcctttggaaaggctaatcagaaactcagaagaatgcaaccctttgtgtctcacctctctgtgacctggaagctccctcctgctttgagtcttcctgcctttgcttcaaggtgtcccgcctttccaaacagaaccaatgtacttcttacatatattgatcaatgtctcatgtctccctaaa

SEQ ID NO: 17526 - DNA, 50536 bp, Human
ccggggcttcaagacaagactgggcaacatggcgaaagccagtgtctacaaaaaaaaaatacaaaaaaattagccaggcatggtggcacacacctgtggtcccagctactcaggaggccaaggtgggttgatcatctaaacctggggaggtcgaggctgcagtgagtgagtcatgattgtgccactgcactccagcctggctgacagagtgacacctcgtctcaaaaaaaaaaaaaaaaaaaaagactgggtgcggtggcccacgcctgtaatcccagcactttgggaggccgaggcgggtggatcacgaggtcaggagatcgagaccatcctggctaacacggtgaaaccccgtctctactaaaaaatacaaaaaaaaaaaattagccaggcgtggtggcgggcgcctgtagtcccagctacttgggaggctgaggcaggagaatggcgtgaacccgggatgcggagcttgcagtgagccgagatcgcgccactgcactccagcctgggagacagagcgagactccgtctcaaaacaaacaaacaaacaaacaaaaaacacaaatacttagatattttacatgagaattacatttatctatcagatactctaccatgccagatttccttacaattacgaaaaatagcaaacacatattgtttgtaaatgcaacacaaaaacgttaatgctctggtttctatctgccttgtcattccgttatttgactccattttcgaggttagaaactcactgtaaggtggccgggcgaggtggctcacaccagtaatcccagcacttttggaggccaaggagggtggatcacctgaggtcaggagctcgagaccagcctggccaacatgatggaactccatctctactaaaaatacaaagaaaattagccgggcgtggtggcaggcgcctgtaatcccagctattcgggaggctgaggcaggagaatcacgtgaacccaggaggttagagcttgcagtgagccgagatcgcgccactaaaacaaacaaactcactgtaaggaaacaatgtaacccaaggcatttggggtgaccttcacgttgcctgagggtgccgagggaccagagatgctggccatggactaaggtctgggtattctcaggcagcagggacaaggtgggcttttttcctggttgctaaacccacgtcaaagtcgagctcagggactggagctcaagaaacccaccgcccattctccagtccgaccggggacctgcatgcacctctgccgtgctgccctgagtcctccaatcctccacactcttcctctgttatgtacacgtctccacccaggcctgcaaaagtcccagcttcctcgcaggggcagggacccgcacgccggcccagggcttggcacgcggggatgctgaaacagggccaggcctggtttccagccgatcgtcagagtcccaaggcccagcaaccttcctcacaaaggcctcgttaagaggcgaggaaacaagagccgggagaggggcgcggaacggcgggcgggacgaacgaccagctccgcgcctccggccagctgcgtcgagccaggggcaccgcggctgttgtgcggctggaaatctaggaatgggaaggttcggggcctgctcggctccggaggcagctggcgggtcgtccctggcggcgttggagcggtcagtggcagccgggcacgggcgaccgggtcgcccgggtcgccctcagaccgtgactcccgaaaagccttgcgggcggggcgcgcccgcgccgtctcttgccggaaggtgcgagttagtgcgctcgattgtgggcgggggcggaaagaggcgcgttttaaagtggtaacagatggttttcttatccaataggattaaaaaatttgtccttacccggccgaccgcggaagtagagtaggcgggcggccaatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggtaagtcagggccttgcagatgcgaggtttaggcagcttcgcggcctacagaggcctcggcccgcgcctcttgggggagccgcgctgcgcggcttgacccagccgaggctttgcagcccgggacctcgagccagctctggtcgctcgcactaccgtccgcgcgggcgcaccgagcccggcttggcgcgggcaacagaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcggttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttcttgaattactacctttgtaaggaccttttgtaaacattgtttttctaatcttcatgaaatcttaatgccatacgtaaactatttctttttatataatgtatgcacatctgtgctttgtacataaaatgagtaagatttttcactctcctcaagatcaaagtagcgtatttttgaggtctcctgtatgccaacctttctgcttggaatacagcagtaaacagtcgtggtcctcctgtagctgggtgaggatggagggaataagagataactcattttattgtgttttgcaaatactgccttttttttttgcaaggtgaaggtttatagcaaggattcatcgagcaagtctgtaaatgccagccatttttccaacagcatgtgctcactttgtgtctcttgtgtcacgtttgggtaattcacaatatttcacacttttttttttttttttttttgaggtggaatctcactctgtcacccaggatgcagtgcactggcgtgttctcggtctcactgtaacctctgccatctgggctcaagtgattctcctgcctcagcctccggagtagctgggattacaggcatgtactaccacacccagttaatttttgtatttttagtggagacggggtttcaccatattggccaggctggtctcgaacgcctgacctcaagtgatccgcctgcctcggcctcccaaagtgctgggattacaggcatgagccaccatgcccagccccaaaccttttcattgttacatctgttatagtgacctgtgatcaatgttttgggttaccatgaatagcactcatataagacagtgaacttaattggtaaaagttgggtgtgtactaacagctccactgactggcagttcccagtctctctcctcaggcctctcaattccttgagacacaatattgaaattaggccagtcagtgaccctacagtgtccaggcaaaaggagcagtcagttgaatctctcttactttaagtcaagttaagaaatgtttatccttagtgagaaaggcgtatcaaaagttgagataggccaaaagctaggcctcttgtgctgaatgacagttagccaagttgtgaatgcagaggaagagttcttgaaattaaaatgctactccaatgaatacatgaatgataagccaaacagccttattgctgatagggagaaagttttagtggtctggatagaagatcaaaccatccatgacattcccttaagcgaaagcctaatccggagcaaggtactaactctcttcaattctgtgaagagtgaggaagctgcagaagaaaagtttgaaactggcagaggttagttcatgaggtttaagggaagaagccacctctgtaatgtaaaagtgtaaggtgaggcagtaagtgttgatgaagaagctgcagcaagttatgcagaacatatagctaaaataattgatgaaggtggccacactaaacaacagactttcaatgtaaatgaaacagccttatatggaaaaaaaaatactatctaggactttcatagctagagaaaggtcaatgcctggcttcaaaggacagtctgattctcttgttaggggctagtgtggccagtgacttaagttgtaactagtgctcatttaccattctgaaaatcctagggcccttaagaagtatgcaaaaatctactgtgtgctgatcattgaaacaggaaagcctgtatagtagcatatctgtttacagtatgttttactgaatattttaagcccactattgagatctacagctcagaaaaaaagatttctttcaaaatattactgctcattgagaatgtgcttagtcaccaaagaggtctcatggagatgagtaagattaatgttaacatctgttctgcagcccatggatcaaggagtaatttcaactctcaaatcttacttaagaaatgcatcttgaggctgagcacggtggctcatgcctgtactcgcagcacttcgggaggccaaagctggtggatcgcttgagctcaggagttagagaccagccggggcagcatagtgagaccaccccctccactgccagtctcttaaaaaaaaaaaaaaaaaagggcggcagggggaaagaaagaaatgcattttgtaaggctacagctacatagattgtgattcttctgatgggtatcaacaatgtaaattaaaaacctcctgaaaggatatactattctagataccattaagaatatttgtctccaggcacggtggctcacccgtgtaatcccagcactttgggaggcgaagtgggcggatcacaaggtcaggagatcgagaccatcctggctaacatggtgaaaccccatctctactaaaaatacaaaaacttagccggtcttggcagcgggcacctgtagtcccagctactcgggaggctgaggcaggagaatggtgtgaacccgggaagaggagcttgcagtgagccgagatagcaccactgcactccagcctgggcaacagagcgagactccatctcaaaaaagaaaaaaaaaaagaatatttgtgattcatgggaggaggtcaaaatatcaacatcagcagttcacggtggctcacgcctgtaatcccagcactttgggaggctggggcaggcagatcacctgaggtcaggagttcgagaccagcctgcccaacatggtgaaaccccgtctctaccaacaaaatacaaaaattagccaggcatggtggcacgctcctgtagtcccagctacttgaggggctgaggtaggttaatcgcttgggcccaggaggtggaggctgcagtgagccgagattgtgcctctgcactacagcctgggcaacagtgagattccgtcttaaaaaaaaaaatcaattaacacaacaagaacttggaaaaagttgattctgaccctcatgggtgactttgaggggttctagacttcaatggaaaaagtaactgtagatgtggtggaaatagcaagagaactagaattagaagtagagcctggccgggcctggtggctcacgcctgtaatctcagcactttgggaggcctaggcgggtggattacgaggtcaggagttcacaaccagcctggccagatggtgaaaccccgtctctactaaaaatacaaaaaattagcagggcgtggtggcgcacgcctgtaatcctagctactctggaagctgaggcagagaattgcttaaacctggaggggcagaggttgtggtgagccgagatcacactactgcactccagcctgggcgacagagcgagactctgtctagaaaaaaaaaagtagagcctgaaggctgggcctgatggatcacctgaggtcaggagttggagaccagcctggccaacatgataaaaccttgtctctactaaaaatacaaaaattagctgggcgtggtagtgggattgttactgcatagtaatcccggccactccagaggctgaggcaggagaattgcttgaacccaggaagcagaggttgcagtgagccaagatcgggccactgcactcaagcgtggacaatagagtgagactttgtctcaaaaaaataaaagggccaggcaaggtggctcacacctgtaatcccagcactttgggaggccaaggcaggcggatcacgaggtcaggagattgaaaccatcctggctaacacggtgaaacaccgtctctactaaaaacacacaaaaaaattagccaggtgtggtggcacgcacctgtaatcgcagctactcaggaggctgaggcaggagaatcgcttgaacccaggaggcagaggttgcagcgagccgaaatcacgccattgcactccatccagcctggttgacagaacgagactctgtctcaaaaaaaaaaaaaaaaaaagtagaacctgaagatgtgactgaattgctgcaatttttaaataaaacttgaacacatggagagttgcttcctgtggacaggcaaagaaagtggtttcttgaggtggaatttactgctgaaggtgcagtgaacattgttgagattataacaaaggatttagaatattttataaacttagttaataaaacagtggcaggatttgaaaggattgactccaattttgaaagaagttccactgtgggtaaaatgctgtcacacagcattgcacgctacagagaaatctttcatgaaaggaagagacaactgatgcagcaaacttcattttaagaaattgtcacagttggcccagtgcggtggctcacgcctgtaatcccagcactttaggaggccgaggcaggcggatcacctcaggttgggacttccagaccagcctggccaacatggagaaaccccgtctcgactaaaaatacaaaaaaattagctgggcgtggtggggcatgcctgtaatcccagctactcgggaagctgagacaggagaattgcttgaaccagggaggcagaggttgcggtgagccaagattgcgccgttgtactccagcctgggcaacaagagtgaaactccatctcaaaaaaagaaaaagaaaaactgtcacagctgccccaaccttcattagccactgccctgatccatgagcagccatcatcagggcaagacccttcaccagcaaaaatattacaactttgtgaagactcaaatgatcgttagcattttttatttattttttaagagaatatctccctgttgccccagttggagtgcattggtgcgatcgtaactcactgcagcttccaacttctgggttcaagagatcctctcacctcagcctcccaagtagctggggctacaggcgcacgccaccgcacctggctttttgtttgtttgtttgtttgtttttgagatgtagtctcactctgccgcccaggctggtgtgcagtggcgcgatctcggctcattgcaagctccgcctcccaggttcacgccattctcctgcctcagcctcccgggtagctgggactacaggcacgtgccaccatgcccagctaattttttgtatttttagtagagatagggtttcaccgtgtttgccaggatggtctcgatctcctgacctcaagatccacccgcctcagcctcccaaagtgctgggattacaggcgtgagccacctcgcctggcccacacctggctaatttttaacaaagttttgtagactgggtcttgcccttttgtccaggctggtctcagactccagactcatgatttaatatctatggttgagtgattccctacttcttactctcttacagaaccactctataagatagttgttgtagttagccccattttactcttcctgaggcactgggagatcagggtcacttgcccaaggtcacacaattagtaagcagagctcgaaacttcaccccacccctgactcctacctttgttccttttgttaggctttgttatgtcatctgctttttttgtgtggtgggaaagcacatggccaatgtttctagaaacttcaaatagtaaaaacaaaatagtatctttatttttgctttcaccgcagaggagtctgataattatcctcaagaaaatttattgattctcagtgactgtattgtattcctcaaagttatttttcctaagttttctcctctcaccagctaagggaagttgtcctagggcctaggcatttccctgtctgccacacctcacctcttactttagccaaactactgctaaattctgctcctaaatatggcagcattctgtgttacctgcactaaaatttgcttcccttgtaagtaccttcttgatgtcttccagtgttggttctcgcctcctactcttgcaagttgaaaagttgaaaatgcctcaggtagaaatgttctctcctattctcccatcatgatcatctgtgtttttttgttttttgtttgttttttgagacggagtcttgctctgtcacccaggctggagtacagtggcacgatctcagcactgcaacctctgcctcccgggttcaagcaattctcctgcctcagcctcctaaggacctgggattacaggcatgtgccaccacggctggctaattttttgtatctttactagagatggggtttcaccatgttggccagcctgtctcgaactcctgaccttgtgatccacccacctcggcctcccaaagtgctgggattacaggtgtgagccaccacgtccagcccttttctttctttcttttttttttttttttaatttaagagaaggttgtcttcctatgtttcccgggcaggagtgcagtggctatttgcaggtgcaattatatagcacagtacagcctaaaacttttttttttttttaaagacagaatcttgttctttctcaactcacttcaacctccacctcctgggttcaagtgattcacctgtctcagcctcccgagtagctgggattacaggtgggcagcaccacgtctagctcatttttgtatttttattagagacagggtttcactatgttggccagcctggtcttgaactcctgacttcaggtgatctgcccgcctcagcctcccaaagtgctgggattataagcatgagccaccatgccctgcctacagcctcaaactttaagctaaattaatcctcttgcctcagtgtcccaagtaaatgggaatacaggtgctgatatggtttggctgtgtccccacccaaatctcacattgaattcctacatgttgtgggagggacccagtgggaggcaattgaatcttgggggcaggtctttcccatgctgttctcatgatggtgaataagtctcaagagatctgatgctttaggtcgggggcggtggctgatgcctgtaatcccagcactttgggaggccaaggcgggcggatcacgaggttaggagttcaagatgagtgtggccaacatagtgaaaccctgtctctactaaaaatacaaaaattagctggacatggtggtacatgcctgtagttccagctacttgggaggctgaggcaggagaattgcttgaacccaggaggtggagattacagtgagccgagatcatgccactgcactccagcttggacaacagagtagacttaatctaaaaaaacaaaagagatctgatgcttttataagggggagtttccctacacaagctctctttgcctgctgccatctatgtaaggcatgacttacttgcttctccttgccttccgccatgattgtgaagcctccccggccatttggaactggcttttgtaaacttcttgcttttgtaaattgcccagtctcaggtatgtctttattagcatcgtgaaaacatactggtacagtaagttggtaccagtagagtgcgatgctgctgaaaagatacctgaaaatttggaaacagctttgcaactgggtagcaggcagggattggaacagtttggagggctcagaagaagacaggaaaatgtgggaaagtttggaactcgctagagacttgttgaatggctttgaccaaaatgttgataaggatatggacaatgaaatccaggctgagatggtctcagatggagatgaggaacttgttgggaactggagcaagggtcactcctgttatgtttcagcaaagagactagccgcattttgcccctgccctagagatttgtggaactttgaacttgagaaagatgatttagggtatctggcagaataaatttctaagcagcaaagcattcaagagatgacttgggtacagttaaaggcattcagttttataagggaagcagagcataaaagtttggaaaatttgcagcctcctgtcaatgtgctagaaaataaaattccattttctgaggggaaattaaagccagctgcagagatttgcataagtaacagggagccaaacgttaatccccaagacagtggggggaaatgtctccagggcatgtcacaggccttcatggcagcccctcccatcataggcccagatgcccaggaggaaaatatggtttcctgggctgggcccagggttcccctgctgtgtgcagcctaggggcctggtgccctgcgttccagccgtctcagctgtggccaaaaggggccaacatagagtagaactcaggccgtggtttcagaaggtgcaggccccaaaccttggcagcttccacatggtgttgagcctgcgagtgcgcagaagtcaacaatgagggtttgggaacctccactagatttcagaggatgcatggaaacacctggatgcccaggcagaagtttgctgcaggggcgggacactcatggagaacctccgctagggcagtgtggaagggaaatgtggggttggagcccccaagcagagtccctactggagcaccacctggtagagctgtgggaagagggccactgtcctccacaccccagaatgatagatccactgacagcttgccctgtacacctggaaaagctgcagacactcaacaccacccagtgaaaacagccgggagggaggctgtactctgcaaagccacaggggtggagctgcctaaggccatgggaactcacctcttggatcagcgtgacctggatgtgagacatggagtcaaaggagatcattttggagctttgagatttggactgctctgctggatttcggacttgcatggggcctgtagcccctttgttttggccaatttctcccatttggaatggctgtatttacccaatgcctgcacccccgttgtatctaagaagtaactaaattgcttttgatttacaggctcataggtggaagggacttgccttgtctcggatgagactttggacttttgagttaatgctgaaatgagttaagactttgggactgtgggaaggcatgatttattttaaaatgtgaggacataagatttgggaggggccaggggtggaatgatatggtttggctgtgtcccccacccagatctcatcttgaatttccacatgtgggagggacccggtgggaggtaattgaatcatgggggcaggtctttcccatgttctggtgatggtgaataagtctcatgagatctgatagttttataagggggagtttccgtgcacaagctctctttgcctgccgccatccacgtaagacgggacttactcctccttgccttccaccttgattgtgaggcttccccagccatgtggaactgttaagttcattaaacctctttcttttgtaaattggccagtctcaagtatgtctgtctcagcagcgtgaaaacggactaatacaggtgcacacggctgtactgtcccccgtcctgcttttaaggctttctttgtttcctaattgtgactgtttttacttgcaatgtaaaggcttcatttcccccatctctgaaattatttttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccacctcggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggtaaagtatcacagttacttgtatttcttaaccatttctcatgtgtagagctttactaccattttcactagattgttttgtgtgtgtgtgtcactgacaacatttttcagtgttgtgccctaattccatttttcctcacaaatggtgggtttttgcatagcaagatgcttttttattttttttaaggaacacatatgtccgtaactgcaaatgaacccagaaaagtgaggacgagttgggaggggaggttggtatgatataaagactttgacctatgttctgtaggcaatgcttgtgattatttgggagcaatacttgcaatattcttggatattttggagcctggtgattcttagcattaccttgtggcgcttttcagttccttggacctcctcctcctgctctcttctgcctttctgtctccttcagagcattcctgttgtgcgtgcctgcttttatcttccctgggagccagtgatttttttgacttgcatgtgtgtttttgtgtttttttaaagacagagtctcgctctatcaccgaggcaggagtgcagtggcatggtcagggctcactgcagcttcaacctcccagtctcaagcgagcctcccacctcagcctcccaagtagctgggactacagtcgtacaccactatgcccggctaagtttttgtatttttttgtagagacaggatttccccatgttgcccaggctgggacactgatttgttagtctactttctaggtaaagtgttgaaggagagttgaagagggcctagattagggcttctgggtgctggatttctccaccaagatgcaagcccctagagagttgagtttggctagccctttggtgacagcttgtattgtcccttagcccacagatgcatctgactaagagtagaagaacatgtctctctttaggagcccggagccagagacagtgctgtttgagattaggccccctctggtgtgcccttcgagaattcccattgtggggcactgctcagttgctcccatctggtatgggtcaaataatcagatttgtgagtgtctcacaaccatccctgtaccccagccaaccctgggttctgaatacagtagaggcagctaagctgctagctggtctccagcaggctctgtgctcagtggccatcaacaccaggtagcttggcaagcctgcctcctgtgctgactgtgggccctggggaagtgtcgaggatgttgacggcctctagcatctgaggtacatctgcccctcggcctccggaggagtggatccttaggtttccttcattatcttaccctttctcctggctcccagaaattaccttgtttttatatgaggccccaaagcctaggccatcttggctgatagatgtgaaagccctttgctcctttcaggcccctggggattttggttgtagcctgattgctggtggcagcttaatcggggccataagataattttatggaagacctggttacttggcatctgaacaagcctcattgcctctctgagcatagtctgctgctttctgctttgatcaaattcattcctcttgtccctgcaaaccttcaggggaggccaatgttcaaggcccctgagccttaggaataaataactctgggtgagaactgcctgtcattggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagccaaggtgggcagatcacttgaggtcaggagttggagaccagcctggccaacatggcaaagccccatctctactaaaaatacaaaaattagctgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggctcacctccacctcttgggttcgagcgattctcctgcctcaggttcccgagtagctgggattacaggcgcccaccaccacacccagctaattgttgtatttttagtagggggtgggtttcaccatattgttcaggctggtctcgaactcctggcctcaggtgatcccccccgccccgcctcggcctcccaaagtgctgggattacaggtgtgagccaccatgcctgacccaggtctcttattttcagtgggtaattgtatcagactctgcctcccaggtggggtttgagggttctgtgtacctggtgtaggcctgggctaaacagaagagcttctcgttagagcatctccctgtggactggctgcagagttacgatatcattctggttctgctgtgctccccactgccccttttcagctgactctttgctcataggaatacagtggtatgagatagggtcatagaatttggttccagtctaacactcttcctgtttcctgcccgcctgtatgtctctatccattagcagactcctttatgtatgatagagacacatgcacatatgcatacacggacagtccctgacttacagtgtttcatttagaatttttcaacttatgatttattgggagttagccccattgtacgtcaaggagcatctgcacatcgtatacatatataccatgaatacacataattatatgtcacactcctgctagagtggggggggtcaatatctgaagtgcttataatagctttattgggggggacctctaagaaaaacagaataattacttagaccttaaataataaatctataagaatgaagaaagccccaaagcccttccagcttccatcctgtcagtcacctctctgtcctatactctgccactaccccgagcctcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccacccacatacattgtttcttaattaactcctcctgtcacttgaggccccattcagcactgcttcctctagacagcccggcttgatcctcagcgcgtttgggctgggactgcgactcctttgctgctgcttccacttgcttaggtcaccagcgtcccacttccgtgtttgagctcactggccgcctttcagttccccagcctgtgcattgcagctgttcactgcttcctcctccttgaagaaggaggttttgtctgagtgacggctccaggttctcctagctttgtttcttttaaattctcttttacagattctatctacctgcctccccaagttttcacacattctgaaatctctacgtccatccgagttctcactcttgagtttccagctaccttgggccctttctccctgggtgtctcacaccctgcttttctaaaactacactcagcacctgtttctgttctcccttccctcattgggttttatggcctcattcttgcagagtaagaagctagataccttggcgtgagttgtttctcctttcaccttggaagctttaggaatacctagcatccggctctcctgaccatccccagttaggaatgaccacttctctaccccagctcctcttttctcagtggcaggggcgccatcaacaccccactcttaccctcatttattccttcaataaatatgagcatctgctttgtgtaaggtcttagctaggtagaaagtaaatagagccttgtcctcgtagcgcttacctaagtgagagcatactggacgagagactggaggatggtggggccctttcttgaaatggagtatatgttggcggaaggaggaggcaagggttccttttggaacacactaaatttgagaaatctgaaaaatcaccgtcagtgttcccgctagtttctggaattgatgtatttgattctggcactaacatacctatttgagggtgtgggtcttggtatcagactgccctggtttaagtctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcttgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcatgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccatgttggccaagctggtcttgaactcctgatctcaagtgatctgcctgcctcagcctcccagagtgctgggattacaggcatgagccactgcccagcctcattattttaatttttttatagagacaggatctcaccatgttaaccaagctagtttccaattcctgggctcaagagatcctccctcttcaacttcccaaagtgctggggttatagggcatgagccactgtgcctgccccatttgtgcattctgttgagagcacccgtagtcccatagtatgggccagcctaaggagatgcaagtcaccctttattagagtgaaacagtgaaggggatttcccctctaaaccattgaggtcaagctagagaatgaggcgctcagggagtgagatacagtatgccattttctcagaaccagacgaccaagtgctgaagaaaatgctcagctcagctgggacggcggtccctttgggcatctcctgaaaaacctactctggcctccctttctcctcctgtacttcttgcacacttagttcctaacttcgttatagctgcctgccagcaccctcctcacccttctccccgccctagattctgcacagaggctgtgtttgctcattgctgtattcccagggcaggggctgtactgtgaatgaggcggggaggtatgcatcctttcttaaagctgggtgggaggacagacgtggtggctcatgcctgtaatcccagcactttgggaagccgaggcaagtggatcacctgaggtcagaagttcgagaccagcctggccaacctggtggaaaccccatctctactaaaagtagaaaaattagcctggtgtggtggcacatgcctgtagtcccagctactgggaggctgaggcaggagaatcacttgaacctgggaggtggaggttgcagtgagcccactgcactccagtctgggcaacagagtgagactccgtctcaaaaacaacaacaacaacaacaaaaaaaaactgagtgggatgtgatatcacacagcattttagggcttgagcagaaggttggagctggtcactgggaaggtttatttggagagactgccaacctggtgctgtggggctgagtgtggtgatgggtatgtgtcagcccacagacactgagcctttccagtgtgcctgcactgttccaaacactctcttgtaataacttctggaatcctcacacaccattaaggtaggtgcagttctgttctatagataaggaaatggggcacagagaagttcaatgccatgccccaaggtcacaggttggggtttgcaggtgcctggattttattttcattttttatttatttttttatttttttgagatggagttttgctctcgttgtccagggtggagtgtaatggcatgatctcggctcctctgcctcccaggttcaagagattctcctgcctcagcctcccaagtagctggaattacaggcatccaccaccactcccggctaattttttgtattttctagtagagacggggtttcaccatattggccaggctagtctcaaactcctgacctcaggtgatccacccgccttggcctcccagagtgctgggattacaggtgtgagctactacacccggccgatgcctggatttcaatctcagttgcctggctcaagagatgtgccctaattgcagtgccagcctggctccacacaccatgcttaggagttaggccttgataaggagccagggaaagttgctgcggcaaatgtttcggaaagatggcctggcagtagggtagacgggcacccagggacaggagacccagcatgagcaggcatggtaatggtgcacaggaggatgacacggcacagcactggggatgcacagaagggtggatgtgagagcgttcctgtcgtttccgccacctggatccctctcacctgtgtctgttttgcaactccatctcgttatgctacttcagtacgttccatggtgtggtctctggaagcagcgcctgggaacttgttagatacgtaaattggagggcctagcaggctgtgcttaacgagccctctgtgggggagcctgatacaggctcatgcttgagaagcactctcctaatctaagccactagcacccagcagtgggtggccacaagggtcttgtccttgctttggctctctctcaaccctcaggcttgcctgtgctcagggctttgtggctccattaaccatgcgtcgctgacgctgagtttaccgtggtcggcctcgcttctcagtgaagtccaagggcctcgcagcctctgcatctggtgatttctctgcctttcctcaaagcttctgcttggctgcctagtccacagcctcccgattcaccattcacctggtcccagcaacagaagtctcagctggacacacaacatgctttagagtgagtggctcttgtcttctcaactccggacggcgacagtgaaattgtgggaagaacctgaggctctgagctgtggcctcagaagctctgtcccttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagattccttgagcccaagagttcaaggctagctatgatcacaccactgcatttcggcaggatgactgagtgagactctataaagtatttgcaacccagttttctgttttcccgtctgttttgtttccctgtgacattcttggttcattcagtgtgagcatggtagtaataatccatagtgaaaagtttcttatattcactgaccaaagttgattcgtcattataattactgtttagcgcttttgtttgtttgtttttgaaacagggtctcgctctgtcacccagcctggagtgcagtggcccgacctcggctcactgcaacctccacgttctgggttcaagtgattcttgtgcctcagcctcccacatagctgcgattacaggcatgcacctccccgcccagctaattttgtatttttaatagagaccagtttttgccatgttggccaggctattttggtttgttttttgagatggagtctgttgcccaggttggagtacagtggtaccatctcggcttgctgcaacctccgcctcccaggttcaagcgactctcctgcctcagcctccggagtagcttggattacaggcacctaccaccacacccagctgattttgtatttttagtagagatgtgatttcaccatgttggccaggctggtctcaaactcctgacctcaagtgatcttggcctcccaaagtgctaggatgacaggcatgagccaccgcacccagccgtttttatttgtttttaagagacagggtctcactcagtctcccagtctggagtgcagtggtgtgatcatagctcactgcagtctccaactcctggagtcaagcaatcctttcacctcagcatcctgagtagttgggatcataggcatgcaccaccgcacctggccaatttttaagaaaaaattggccaggtgcggtggcttatgcctgtaatcccagcactttgggaggccgaggtgggcggatcacgaggtcaggagatcaagaccatcctggctaacacggtgaaaccccgtctctactaaaaatacaaaaaattagccaggcatagttggcgggcgcctgtagtcccagctactcaggaggctgaggcaggagaatggcatgaacctgggaggcggagcttgcagtgagctgagatcgtgccactgcagtccagcctgggggcagagcaagactccatctcaaaaaaaaaaaaaagaaaaatcatttttgtaggcatggagtcttactttattacccaggctgatcttgaactcctggcttcaagcagtcctcccacctaggctcccagagtgagcgacaatacccagactgtttagagcttttatcacatctgtgagacagctctggtttggtgtaattcaggtgtctcctggaaccccttgagctctcgaggagattacctgaaggtccccctgtcccagtttattctctactgacagagttctcactgcaagtttgttcaaatgatctaaactcaaaacatctgttgtctgagatcctgaattccttgtcagacagaccagatgtgaaatagcctgctgatttcttccagtgctccagaagtactgtgaatggtatgggaagatggatggtggggacaggtgagactgaacaaacagctgtcagagggaacagtgatggaaatgctggtcacaccctctgagccttttgggtcctcaccctcttctgttacttcctggccgccattgtgctccagggcccacttttgatggtgatacacaaaaaagcccacttctttgacctcccaccttggtgcttcacctgcaggttaccatgtagctcacctatggggaaataggtgctttaagccttaacccatctctgcttaggccagatcagaacaggcaaaacaatgtagccttttgtgcatgtgtgtgaagaaattggttaaaattcctgaaagttacggtgtggttatagcttatgtggttgtgattggatggtcagttttcaccaaaagctatggacctctgagggccctgctagtgaaaaggaagagaattatgaccagaattatgggagggccagagtggggagctctgcagatattcctggattgattgagcctgtcttgagtggtgcagggaagctacttgggaggaggaggctcagagacagcagagtgggagggtaaaggatgtcctcaggaaggaggtgacatttgagtgggttctggaaagctgtgcaagaattggccaagtaaagaaagggagggacaggcactccaggcagggaagaagctctggttaaaggcatggaggggtcgatagagcaggcagaaaagaggattcctgaggttagggaggggtggggacattcctgtaattatccgtgaggggagattttgggtccaggacccatggctgctttcttggctccctcagtggggcccagaaaccacacaggtagctgtgggacatggaggtctgcttagcagtgcctagtaagaaagacttggtctgctacaggctgggcatggtggatcacaaggtcaggagttcgagaccagcctggccaacatggtgaaaccccgtttccactaaaaatacaaaaaaattagctaagcacagtgcgggtgcctgtaatcccagctactcgggaggctgaggcaggagaatcgcttgaacctgggaggcagaagttgtggtgagccgagatcattccactgcactcctgcctgagcaacagagtgagactccgtcttaaaaaaaaaaaaaaaaaaaaaaaagacttggctacaagggaaggagcctatacgaggacaaaggacattgtcaaagagaatggggtaaatattttcatttatttattattattattttgagacagagtcttgctctgtcgcccaggctggagtgcagtggatgcaatattggctcactgcaacctctgctgcccgggttcaagcgattctcctgcctcagcctcccgagtagctgggactacaggtgcatgccaccgcgcccagctactttttgtgttattagtagagacggggtttcagcatcttggccaggctggtcttgaactcctgacctcgtgatccacgagaatggggtaaatattaaagagtcctaagtgtttgaaatgcttgttttctggtgctgtaaagaaatagcatttgaacgtaaatttaattttttttagcaaggccatatttatactttctgcagaaagggtacactcaccagttgttttgccatgagaatacattgaataaaggagacagggttatttataacttgatgtgtttactctgctgctgtgtccagtttttattggctggaacaggacctcacattctgtatttgtcccaattggctagcaacttagaacttttttttttttttttttttggagacagagtctcactctgtcgcccaggctggagtgcagtggcatgatctcggggtcactgcaagctccacctcccgggttcacaccattctcctgccgcagcctcccaagtagctgggactacaggtgcccgccaccacgcctggctaattttttttgtattttttagtagagatggggtttctacgtgttagccaggatggtctcgatcttctgaccttgtgatccgcccgcctcagcctcccaaagtgctgggattacaggcatgcgccaccacacctggccagaacttttgaaaagaggcaaaggcagaggagaataaaggaaggaggaagtaacttgtggaatgctgaaaaaggtaaaaataacctttaaataaggaagaggaacaggctatgatctaatgcttgcttggactaatataagcatgccaaggtaaatatttaggctaaattgtgggagctaagaatataaagtacattgatttctttattatggctagcagatatttaagaatgttagtacaggtctttgaataaattttgcttttaagagaagttactatttatttctaattagatggggaggaaagtctttgaagaggaacctctactttactttttacataagcaacctggtggctgctggggaaacccttaaaacactgggcagtagaactccactgaggttagtgtcagctcccttgaggccaagagcagctgctcacttgggagttttggctgctgtcgcttggcctctgggccctcctggggctggttctgtgctccttagtccgtgggaagttactagacccagcttcatttccaaaacatctcaagctgccatttgataagagtagcattggaacacagaatcaggcttatccctgttgcctagcgagggcttggctggatggtgggtgttcctggatcttgtatgaatctctcctgcaatatctggtcctttcagagtttcctgggacagattgaccctagtaaggctaaggaattgggatagtagtagcatcttccgtctctgcgcagtactttacatacatgatctcatttagaccttataacagctctgcaaggctggtactggtgaggaacttgagacttagtagtgcagtacttgtcccaggttgtccagtgcaaaggatagcaggacagggcacagggagaagagcacggaaacaccagtgggaatacaaggtgacaggctctgttgggaagctcttttttttttggggggggggtgagatggagatttactcttgttgcccaggctggagtgcaatggcacaatctcggctcaccgcatcctccacctcccaggttcaagtgattctcctgcctcagcctcccgagtagctgggattacaggcatgtgccaccacgcccagctaattttgtatttttagtagagacgggtttcaccgtgttgcccaggctgatcttgaactcctgacctctggtgatccgcctgcctctgcctcccaaagtgctgggattacaggcctgagccactgcgcctggccagctctgtctcttgattaaggtggaggatattctcagcttgtcttttgggaccaggcagaccagaaatgctggagcatattggcaaaccagcagcctaaggatttggaagaaaggctggtcagagtgtcagttgcttatcaaccagctgagagcctgaactttccggaagacatggctcttgggtagccactgggaacaggcttaaaacagctttggttctttgagttctttgtggggagtgattgtctggtgtgaatcacagttgatagtgccctgaaaggttcaaggccacatttcccaggggaagataagctttccacaatgtatagaaactcagaaaactccaagttctttatgctaagaaacaaaaagggctcagaaaggctgaacacaaagtcaaggaagagaaattgataacttttggttaaagggaagagtttccagccttttggccagggcatccactaccaagtccaaatcctgacttggcctcaagcttttgtaaagggatgcatcgtgtcccttttgacctgctgatagtttttttgagatggagtctcacactgtcacccgggctagagtacagtgacgcgatctcgcctcactgcaacctctgcctcccaggttcaagtgattctcctgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttatttttacttatttatttttgagatagagtcttgctctgtcgcccaagctagagtgtagtggtgcagtctcggctcactgcaagctccacatcctgggttcacgccattctcctgcctcagcctcccaagtagctgggactataggcacccgccaccacacccggctaattttttgtatttttaatagagacagggtttcaccatgttagccaggatggtctcgatctcctgaccttgtgatccacccgtctcggcctcccaaagtgctggtattacaggcgtgagccactgcacccggccatgcaaactcgcgttttaaacagaagaaacttagtgcaagataaatttcatgggccccccaggagaaatgaagttctctatatggtctctgagtttcacttctacaaatgagttcttgaaagccttgacttgaggctaggatcctggctctagaccaaaaaggaacgaactgctttccgtcatggcacttgtcatcctctaggcagtcttacccctgtgtgtacttagggctgcccattagagcactgttttgtttttgtttctgtttgagacagagtttcgttctgtcagccaggttggagtgcaatcgcgtgatctcggctcactgcaacctctgcctcccaggtttaagcaagtctcctgcctcagcttcccaagtagctgggatcataggcgcccaccaccacacccggctaaattttttttgtatttttagtagagacggggtttcaccatgtcagtcaggctgatctcgaactcctgacctcagattatccacctgccttggcctcccaaagtgctgggattacaggcctgagccacccgcctggcctagagcactgtttttgtaagagcccagaattgtgttcaccagaaagagaatggttcaataaattgttgtatatcagtatatggactgttggacagcccttctttttaataaagaatgcaataattttatataaattatattgtatatgtaagattatcacggtttttattcttgtgaaactttatgatacaagaaaataaaacaggccagccagattgcttgagcccaggagtaccagaccagcctggacaacatagtgagaccctgtctctataaataaaaaaattagccaagtgtgggaggctgaggtaggaggatcacttgagcctggaacattgaggctgcagtgagccgtgatcgtgccactgcactctagcctgggcaacagcaagaccccacctaaaaaataaataaaagaagttacgttgggttgggcgccatggctggctcctataatcccagcactttgggaggccgaggcgtgcagatcacctgaggtcaggagttcaagaccagcctggccaacatggcgaaaccccatctctactaaaaatgcaaaaattagacgggcgtggtggcgggcgcctgtaatcccagctacttgggaggttgatgcaggagaatcacttgcacctgggaggcagaggttgcagtgagccgagatcgtgccactgcactcctgcctggacgacagagcgagactctgtctcaaaaaaaaaaagttaaatgcattacaagacactttccccaaatattagaccaatactgtttcttaaaaaacttcatttagtgttttgttgttgttgttgtttgtttgtttttgagatggagttttgctcttgttgcccaggctggggtgcagtggcgtgatctttgcatcccggggttcaagcaattctcctgcctcagcctcccgagtagctgggattacaggcatgtgccaccacacctcgctaattttgtatttttagtagaaacggagtttctccatgttggtcaggctggtctcgaactctcaacctcaggtgatccgcccacctcagcctcccaaagtgctgggattacaggtgtgaaccactgtgcctggcccattccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccttggccgggcacggtggctcacgcctgtaatcccaacactttggaagactgaagtgggtggatcacaaggtcaggagttcaagaccagcctggccaagatggtgaaaccccatctctactaaaaatacaaacaaaattagccaggcatgctgccaggcgcctgtaatcccaactactcgggaggctgagacagagaattgcttgaacccaggaggcggaggttgcagtgagccaagatcgcaccactgcactccagccttggcgacagagcgagactctgtctcaaaaaaaaaaaaaaaaaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctatattacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagacatcttacaacagatgccgtgtttgagtgcctgacacctagaatggtgcccagtcactgtgagtgtatgccctcccaactgaaaggaaagggaacgttggctcagcactgcccatgggaaatctctcaagttccaaaagtgcctgctacttagcatggcctcaggggatgcaggctccctgcattgccacctgatgcctgctgcgtcctgatgccagggaggctggagcccaggaggctgcctgtgtccctgtctcatggcaccggttacagactgcaggggacgtgtgtatacgtgtcctgcctgccaggagggaggccttgtctggtcagaggacacacggagaagctatttctgatagacctgtttcatggtgcatgcaggtctgggaatctggtcagcatcttaagggcaagtttgcctctggaagatgccacttgagtgttttctgacagtgtgctcggaacacaggtcggggtgggggcacacttggcagcattggcagtggggtggtaagtgctgctgaggaggactgtggggtgtgggggctgctagtagctgagtcttcgccttggccctgggctcactggtgttggggttatcctgtttggctgatgcctgggtatctgaatagggacaccccataggtgttgcttcttagttgtgctgagaacttcagaatagggttatactgagaagtttcaagacttcaatgcaaagaaaaggacagggatggaaaaccatctgagataagcagcagtgggtttagttgtacgtggtccctgcttaggtctcattaacgtgttttctgaggtacatacacacatatgactttgcttatcatccctgtgtcctgcatggagttctggaaagataactaatttggtatattagctggcagctacagcacagtcactgatttttcccctctttctttttcccagctgacaccttggtttcaccagttgctcattaaagctggaaagtggtgtctgcagaagtttttttgttttttgttttttgtttttcttgaatactcagtgttcaccacagtcttcttggccttctctctgccagaccctgaggagagagctaggattttgactgcaggaagacaatgattgattggcttttgttggctgacaaaccaacatcatttcccctttcacacttgtgttttcttttgctttagaaacagggtctcaggctgggcgcggtggctcacgcctgtaatctcagcactttgggaggccgaggtgggcggaccacgaggtcaggagtttgacatcagcctggccaacatggtgaaaccctgtctctactaaaaatacaaaaattatgcggacgcctgtagtcccagctattcaggaggctaaggcaggagaatcgcttgaacccaggaatcagaggttgcagtgagccgagatcacgccactgcactccagcccgggcaacagagtgagactccatctcaaaaaaaaaaaaaaatacaaaaattagccaggtgtgatgatgcatacctgtaatcccagctactcgggaggctaaggcaggagaattacttgaacccaggaggcggaggttgcagtgagccaagatcgcgccactgcactcaagcctgggcgacagagcaagactctgtctcaaaaaaaaaaaaaagaaaagaaaagaaacagggtctcactctgttgcccaggctagagagcagtggcatgatcacaccttactgcagcctccaacccctgagcttaagtgattctcccacattatcctcctgagtagctgagactacaggtgcatgccaccatacactactaaatttgggtcgggtggtggtggtgattttttaatatttttgtagagacagggtctcactgtgatgcccaggctggtcttgaactcctgggctcaagcagtcacccacctcagcctcccaaagcactaggattacaggtgtgagccaccacactggccagctttgttttgttttgatgactaagctgctcttgctaaaagggcttcctctctgaacttccctacctttcttctgtttccctgggctagggctccatgttggcagtcctactcccaattaacctggggctgtctggttaacctttataagatctgcagtcattgggagacccggggaccaggaatattgttgttgagggagctaccctggaaagtggatgggtggccagagggagagctgataggtaaaagggagacgctcctggcttgggaagcaggagtcctaggttctggtctctcagatctactggtcagtttgatcagtggatttatctcacactgtcctcagtgttgtcagccacaaaataactgctttggacttgatagctcttgctaatcattctctacttatttttgattttaataagtccaagtgccagtttatgaatttacactgagacatatacttgagtttggaattctgcctctgagcagatctgtttgggaggcctctaatgctagtcactgaggataaggggcatctgtagatggatcgtgtgttcagggtgaccctaggctgcacctgcaggagagtataaaatggataaatgtattcattctggaagcggggtaaccttccttaccagttccgccaggacctgtcgaatagtttgagtgcactgctttagctccagtagctctgtatctgtaatataggaatccctggataccaggatccagaggtagccgtcagaacatcagggaaccctctaaactttgtgcctgtggtcccagctactgggaaggctgagcaaggaggatcacttgaactcaggagttcaaggcaagcctgggcaacatagtgagaccctgtcttcttcaaaaaagaaaaaaagactggaaactttgcatacaggtgtgcacattcttccaactttcgaaggaattcaaagcccctgaaaaatgaagggaaatgaaaaatgcggtaagatgcagtgagagactttgttcatctcatttgattagtttccctcaaaatgaactttcatttttggcattgcatagcctagaaaaggcatcactgctgtgtcccgaggtgtgagtgtctttgatttttactggataaatgccagacttttctaaagagggagcagttcacattcatgccagtgtttgaggttctccacatcctcatggccacttttaattttagccattctgatgcttgtccagtggtgtctcattgtggttttaatttgtgcttttttattacaaatgggatcaaacaccttttcatgtttatttttctcttttgtgaagtgcctgtttaaaacttctttgttttatagcttttatttatttatttatttatttatttatttatttatttattttgagacagagtcttgcactgttacccaggctggagtgcagtggcgtgatcttggctcactgtaagctctgcctcctgggttcacgccattctcctgcctcagcctccagagtagctgggactacaggcagccgccaccatgcccggctcattttttgtatttttttttttttttttttttgagacagagtctcactctgtcacccaggctggagtgcagtggcacgatctcagttcactcagttcacctccgcctcccgggttcaagcaattctcctgcctcagcctattgagtagctgggactacaggcacgcaccaccatgccaggctaattttttatatttttagtagagatggggtttcaccatgttgcccaggctgttcttgaactcctgacctcaggtgatccactcgccttggcctcccaaagtgctgggattataagcatgagccgctgcacctggctgttacatagcttttttttatgcaactttcgtatataaacttttttcatcataaataggacttttcactttagtacctagctcatcccagtagcttttccagaactgctgtcttcaccacaaagctccctacgttttcccaatgcaaacctgagtgtttttagcattttaactttcctcacagagaagacatcgtggagcggataaatagatttgcaggcatttctgtgtcttctccagtgctgtctggaataattttctccaccacttctttcaagttatttgtctgcatctctctttttttttttttttgagatggagtctcgctctgttgcccaagctggagtacagtggtgcgatcttggctcactgccagctccgcctcctgggttcacaccattctcctgcctcagcctccagagtagctgggactacaggtgcccgccaccacacccggctaattttttgtatttttagtagagacggggtttcaccgtgttagccaggatggtctcgatctcctgaccttgtgatccgcccaccttggcctcctaaagtgctgggattataggtgtgagccaccgcgcccggccttgggtcatgatttccatcatcttagacctgttggtgctgaggttttctttaaccattggtagtctagacatcaacatgagcttcaatcatggtctgcctttttttttttttttttttttttttttttgagacggtttctcactgtcactcaggctagaatgcagtagcgtgatctcagctcactgcagcctctgcctcctgggtagctgggactataggcatgcaccaccacgcccagctaatttttgtattttttgtagagacaggattttgccatgttgtccaggctggtctcgaactcctgacctcaagtgatccacccgggtggtctgccatttttaaatcacacaacacattttgtcatgggtaagacccacgcatggaagctaggcagtttttgccctgaacatcttgaacagtcagcttgagttttctgcaagtcagcaagccttcaaacataacccttgaggccatcagatacagttttggttccttgagtcctataaactttttaaatcgttgaaaaaattgaactagaacaaagcaaaccatttgttgttttctttttcccccctgagacagagtctcgctctgtcgcccacgctggagtgcagtggcacagtcttggctcactgcaacctccatctccagggtgccagcgattcccatgtctcagcctcctgagtagctgggattacaggtacacaccaccacggccagctaatttttgtatttttaggagagacggttttgccatgttgaccaggctggtcttgaactcctggcctcaagtgatatacctgactcagcctcccaaagtgctaggattacagacgtgagccaccatgtccggcctccttggttgctttttaacagcaaataatcttttttttttttccaagttgtgtgctttctccaaatttgttttttttcttcttcttcttctttttttttcccttgaaacagggtctcactttgttacccaggctggagtgcagtggtgccatcacggctcactgcagcctgtaccttctgggctcaattgagcttcctgcctcagcctcctaagtagctgggactataggggtatgtcaccatccctggctgattttttatatttttttggagagacaaggtcttaccgtattgcccagggtggtctcaaactcctgggctcaagtgatcctcccaccttggtttcccaaagtgctgggattgtagttgtgagccactgagcctgaccttgggtcacttttcatgagcattttcagtatgccagtctctgctctggctagaagcaatgcagtggtagaaaagagactggcaactctctttaaggaatcgagattctttaaggggaaggttattgaaaatgttacttaggctgtttttcttaaatttccaaagattgtctcttagtaaggttgatttttctggaatctttttttggtctgtttctataatgtatgaataagtcacactatgtgtgttttattctgtatcctgcctggttttccatttatgagactctgtagaaaggatgcttgataaaggcttttctggaaggaaggaaggaagagggagggagggagggaaggagggagggacagaaccctgtagatctctgggtgtaaaggacacaggaggcacactgttggaataagtgagccagcccaattccatagaaagaaagaagagctcagaaaagcccaaacatcatatccaggaattagccaagatgggttggctactcaactacaatgtgattgtccgcaccagtcttcccgactttcctgccagtgccgcaagtaacaggcatcagtaactgcatgatgtgtgtagctgttggacattgagtagccttttgtgtgcacagtgcttggagatggctgtttttccagtggagcaatgtgcagtgctgtgagctgtaaagttgtctaaagcaagtgtgtcttggtgcccttggctgggtgaacattcctagaaatgccaggggccagcctgagtgcacgggacccagtgattcctatacttgcttctttcatgcagaggtgttctgaggctcacctgtgcttttagaagcacaaaggggcttcgagtgaccaatcagatgtgcctgctgcaggtccactcgtctctaaatgctctgacctatggactgttgtccatagttgagaagaagctagagtaaaataaaatgtatgagtgagtgaatctttttctttttttttttcttttctctttttgagacagggtgttgctctgttgcccaggctggaaggcaggggcccgagctcagctcactgtagcctcaacctcccaggttgaagagatcctcctgcctcagccccaggagtactgggactacaggtacacactgccatgcccagcttattctttgtattgacgggatctcgccgtgttgcccaggatggtctcgacctcctgagctcaagtgattcatcccgccttggcctcccagggtgctgggattgcagatatgggacaccatgcccagccgaggaagtgtgaatttctgatcttgggctagcttaccacagtactaattaaactattcagttcaggggattagttaattgttgttatttcagttttggtttttcacttatcttaaaagcctctcaaatagattagaggccccagagcttgtgttacacctctatccatctctcaactcatctggtaggcatttatgaagcgctggtactcttccctctgcacctatcttctgtgctgggcaagtactgtgccacctgcagggccatagctgtgatttaggttcattacagagttcttgagatgtctgcagggattctggaatttgatgtgactcggccactgggtggagggaacaccagtaatcaatactgtattgtccaccagctgagaggccaggctgtggtcgttggttttgtttttttgtttgtttggtttttgttttgttttgttttgttttttgtttttgttttgttttgtttttgagacggaatttcactcttgttgcccaggctggagtgcagtggtgcaatctcggctcaccacaacctccacctcccaggttcaagtgagtctcctgcctcagcctcctgagtagctgggattacaggcatgagccaccacatgcccggctaattttgtgtttttagtagaggcggggtttctccatgttggtcaggctggtctcaaactcccgacctcgggtgatctgcccgcctctgcctcccagagtgctgggattacaggcatgatccactgccccaggccttttttttttttttttttttttttttaattaaagacagtttcactattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatttcatgcggacagtacattgtgccggccctggtaagtttggtcctgatggtgaggttgactgattgtccccagatttcccttttcaccgtctgcagtctcctctaagaggaaaggggagcacgtttcagtggctccacgtatgtggattatattctcatcctcaaatcaaagacctttatactcagtcctgcattcttcctgcatggccgtttgtgtatgtcaggatgccatttgggaaacaaaatccactctaattattcctaagcttagtggattttaacatggaaggagaagcctaaatcagcagtctctgggctgggtctccaggaataactcttgacctcgaagcattgacccacctagggagctgctgtgtctgctccatgaagaaggtctggaggcggcatccaccccctgcactcatatctttgggttcgtgtagacagtactgcagaccctttctagggaggagaggcctgggctcaagacatagcagcctctgccagaagtgtttcttcaggatgcagctgtgcctgccagtgccaacaccctcagcagctcaaatcggcctccatcccctgccctgccagtagcatgagtgtgtctgtttgagggaactcggttcacgtctaggatcctggctgcacgggagtcagagtagaggattagagcttcttgtcactgtagggcaggatgtcctgcccaggggacaggcagggtgaggtgagcagtagggctttggtggtgagaactttcctgaaacagcccctcctacgtgctcagcaagagggaaagggcgttccactggcccccctagatgggtaagagcacttggccagaaggtgggaggaaccacgtttgaaactgttggagcagaaattgtctagatgtaagttctgagctggcaggtgagaggcttgtcaggttcttaggcccccaggacagagaattggattgtgttcaatccttggtgtgtgtcacacgcattggtcatgcatagcctgcttttctctgttagttacttgtaacaacctactgagcaatgcaaatcctcctccacatgaaggctccaccttggcagtggcctacattggtcgcgtcagcttgagagagcatcatgcccctagtgctgtctaaatgttcactgcctcacgtaaccctcacaacagcacagtcagatgtgggctctggtgactctgcttcagaagagaaagctgcagcccccagatagtaagtaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatgccttcatttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccgcacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgacgcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctgggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaaaaaatgtctttccttttttcaatgtacatagttcaactctttctttgttacatttaaactatatccatggatatcagtctgctttggactcctctgctagtgttacagatggaaataaaaccattaatttgaaccaaatatcttttacacattcatttgctctttggaatcaatttcccccctttttgccaaggtgcggggttcttatctgcctcacgttgagtgtattttgcattggtgtgtgttcaggaagtttccatgtcctaaatccagcaagcatgtgagaggctgttcttggagcacagccacaagcccaagccctggagtccctaagagagcagagtctactctgagaggcaaggttgaccaaggagctgtctgctcagctcggccagtctctcagaggtgctgggggtgctgctctgagtgggatggactgagattgccctggaaaccttgcactgcagcacccccctttgcccctgaccacctagatacaaaatttgccctctgagtgggagtcagcactgggagtgcatggatatgccagccactgccacaggcgagcagtgccagcaaagccacaaggagggaatgggcttggcagtgtggccaagctctccctttgcctctgccctctgtacctatccagctgtccccagggactagaaaggctaacatgctggctgcctgggtcccaaaggcctaccatccagtgcagtttgcttaccatgctcctggcactgcacttttggctctgtgggcagtgagacagacatcatggaacatgtttacagaggagacagtcccccaggccactggaaaattgaaactgatgagggtggggtacgggaaaccaggagatccagcaggaagaagttgaagctgtccagaaagctctctctgaataagggctgctaagttgccatcttcaaggtccagaaagctctctagggaaagaggaaagaattccagagaccccaggccaggcctgtgaaagttatgagaaagagcttcttgctggcatacagtagggtctgcaggctccccgatacctaaaggcattggaccagacacttctggtggctacccagggcctggcagttctttaccccaggagcaagcctaggggaggcagggagcagtgtatccctaagactggtactgctggagtgggtctggtcctggaaaggagggagcccccaaggctggctatagaaactcaaaagatgtctgtattaactttttcggtgggggggtggttttgttttgttttggcagcatagaaacaattgattctctatattgtgtatccagaatccttgctatttttttttttttcctaagacggagtctggctctgtcgcccaggctggagtgcagtggctcgatctcagctcactgcaacctccgcctcccaggttcaagcgattctcctgcctcagccacccaaccagctgggattacagggacgtgccaccatgtccagctaatttttgtagttttcgtagatacgggctttcaccatgttggccaggctggtctcaaactcctgatctcaagtgatccgcccgcctcggcctcccaaagtgttgggattacaggcgtgagtcaccactcccagccccaactctattttttttttcttttttctttttttctatttttgtagagacgggggtctcatcacgttgcccatcctggtctttaactcctcgcctcaggcgatactcctacctcagcctcccaaaggtgctggaattaaaagtgtgcgccaccgcgcccagcctagcccagtacattattattacacacaaatggtgtttgtgttttagtgtttcatcaagaaagatgtttgctgtaggttctagttagataactgtcagatgagggaggttcattttcctaccatgagataagcatttatctttttttttttttttttgagacggagtttcactcatcgcccaggctggagtgcagtggtgcaatctctgctcactgcagtctccgcctcctgggttcaagcaattctccagcctcagcctcccgagtagctgggattacaggcatgcaccaccatgcccggctaatttttgtatttttagtagaaacgggattttaccatgttggccaggctg

SEQ ID NO: 17527 - DNA, 53769 bp, Human
gagacggggtttcaccatgttggccaggctggtctcgaactcctgacctcaggtgatcacctgcctcagcctcccaaagtgctgggattacaggggtaagccaccacgcccggccttttttttcttttgtgagacaaggtctcactctgtcacccaggctggagtgcagtggcgtgatcttggctcactgcagtctccacctcacaggctgaagtggtcttcccacctcagcttcccgcgtagctaagaccacaggcacatgccaccacgcccagctaagttttgtatgttttgtagagacaggattttgccatgttgtccaggctgatgtcgagttcttgggctcaagcaatccttctgccttggcctcccatagtactgagattacaggtgtgagccactgtgccccgcctacgtggaattgttttatatgagaacagaggttctaccatcattcagtgatagcagggctgaaatatatttcaggcagactagtgtgatatattagaaaatgagggtattttaggtatgtgtaaatcatatttgcaaacttgggttttccatttcagtcttttccgcccccggaggaatgggttggagcttggtccgtctcacggcctggctctggggaatgtcctgaatatctcactgctgtcctagggttgagacctccttctgctcagttggattcacggaattatcagagtgggctttagctgacatctaagccagtgggcaaggttggagcagtgaggcctactgtgtctgaagtgttaaagctccccagagaaccgggcacggtggctcatgcctgtaatcctagcactttgggaggctgaggcgggcagttcacgaggtgaggagatcgagaccatcctggctaacatggtgaaaccccatctctatcaaaaatacaaaaataaaaattagccgggcgtggtggtcggcacctgtagttccagctactcggcaggctgaggcaggagaatggcgtgaacacgggaggcggagcttgcagtgagccgagatcgcgccattgcactccagcctgggcgacagagggagactccatctcaaaaaaaaaaaaaaacaaaaaaaaacaaacaaaaacgaaaaaacgaaaaacctcaccagaaatgcacactagggcttacccagccccagtccaggaaggaatagtcttcctgcctccccattgccctctatgctttctcttttcctagcatatctactcttcctattttctgcctctctcctctagaatattagcacctcaagaataaggaaggcattttgtttgttgctctatttccaagtgctggagaacttgggtgggactcagtggttctttatttttatttctttatttttattttaattttagagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactggtaatttttgttttaacctctgtatttttatttttcacctgagtgctcaaatattttcatcttttttataatggtcatgttgcatttgtaattttaagaagaaaaatatttataaacgaggaattcttaggttattagtcttcttcctacaacagcacttctccagtaccaatctgattcctctaagtccgcatccccaggtttgacatctctaactctaatcccttccgttctttgtccttgtgattttacacctttcttttgtgaaagagatatgcatattaaactctcaggccaggctcggtggcttaaatgcctccaatcccagcactttgggagtccgagacgggtagatcacctgaggtcaggagttcgagaccagcctggccaacatagtgaaaccccgtctctactaaaagtacaaaaaaatgagccaggcgtggtgatgcatgcctgtagtctcagctactcgggaggctaaggcaggagaatcacttgaacccagcggcagaggctgtggtgagctgagattgtgccactggcacagttccagcctgggcgacagagactccgtttcaataaaaaaataaataaataaactctcagtctttgcatattgcaagatgtattttgcctctttttttgttttttgttttttttttttttttgttttgttttgagacaaggtcttgctctgtaccccaggctggagtgcagtggtgctttcttggctctctgcaatctctgctgcccaggctcaactgatcctcctgccacagcctccccagtagctgggattatgggcatgcacccagctgatttttgtatttttttgcagagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgaggtgggcatttattttcccttaatgcttgcttgattgattgacagacagtcttgctctgtagcccaggctgcagtacagcggcatgcttataggttgctgtagcctcgaattcttaggcttaagtgatcctcctccctcagcctctgaagaagctaggagtagcttctaggactagcttctaggactgtaggtgtgtgtcactgtacctggctaaatttaaaattttttgtagagacggcgtcttactatgttggccaggctggtctcagactcctgacctcgagtgatcttcccacttcagcctcccaaagtggtgggattacaggtgtgagccaccacgcctggtgaagattttctgtttgtcctccatgttctgtcatttcaatacaatgtatctagatgatttgttttcatttattttgctcagaacatagggtgctcttttattcagaatatctaattttcctttcatctctggaaaatgtttcacctctttgaaatttgttggctggctgaggtggctcaacctgtaatcctaccactttgggagtccaggagtttgagaccagcctgggcaatgtggtgaaaccccgtctctacaaaaaatacaaaaattagccagtgtggtggtgcatgcctgtattcccagctaattgggaggctgaggtgggaggattgcttgggcccaggagttctaggatgcagtgagctgtgatggcaccattgcattttagcctgggcaacagaggaagaccctgtctcaataaaaaaaaaaaaaaaaatgaaaagaagaagttgtctttccctcatcctcccaagcctctccaactagaactgcattggaatgtaagctccttgaaggtagaggatttttgggggtatacgtaacataaaatttaccattttaactattttaaagcatttagttctatggtcttaagtgcattcacattgttatacaaccatgacactgtctccagaactttttcatcttctcaaactgaaactctgtcccataattccccatcctcctttttcttcccccagtttctggcactcaccattctacttcctgtctctatgtattctattctggggacctcatgtacgtggaattttacagtatttgtcttttttgtgtctgccttatttcacttagcatagtttcttcaagattcgtccatattgaagcagatatcagcatttccttccttttaaagctgaatactactccactgtgcagatagtctacattttggttatctattcatctgttgatgggttacgtctaccttttggctactgtaatagtgctcctgtgaacatggttgtacaaatatcttctggttcctgcttttaattcttttgggtagacagactgtttttcaccctgttttgttcaatgttataatcccaacacctaaaatcagtgtcttgctcatagtaggcactttatatttgaaagaatgaaacattcatgaatgttatgtcttaatttatcttacatggttttcatctctttatcagcccttttccttgctgattctctcagatttatcttctaatctattatatttttagctgtgcctggtctgctatattcaactcaactgagtttttaatttcaataccaatacttttttttttccaagtctgcaaatcatgaaaacagtaatttcctgttctcctgtagaagaccttccatactgtcccatgcctggctcctggaggatctctcactgctggtgggaggctgtgtttacctcaggggcatctctcagtggctctcccggggagaggggggctccccatgagcagttctcaggtttccctgcaggtcctaccagtgtcactcattctagacctgttttgacattttttggtctccggatttagccttcttaggcggaggcttggggttcacatttctcaagggtggctctgtcaccccagtggcctctggtgggtgtttgctgagggcccagccctgggctggctggtagaggggctcaggtgatgatgacagcactgtgaccacagacactcacctggtgatgaggaagtcctctgcctggtggtggcttcttttcctccttactgtttgaaagtacctgcaaggtgggtcctctgtcctcaggacatggagtgaggatgagtggtagaggctcttggccggggtcccacagtgtagtaagtggcagagctgggattctagtccagacagcagctccacacttggtgctcctaatcacggcagccagctgctcgccatgactcctctccttcgggctctgtgcaggcagcccagtcaggcccaagcccctgtcctgcacctcccttctgtattccggctgccaagccccagcacctaaaccctggggtcctgccatgggcagcctgcagcctatgaggctccagactgctgttcccttttcatttctagacctggagattctctctattgctttgcattaggcagtgtagctagacaaggtcttgctgagtctggcgtgcaatagtgtggtcacagctcactgcagtgtcaacctcctgagcccaagccatcctcacacctcagcctcccgggtagctgggactgtagatgtgcgccagtgtgcctggctaattttattttttgtagagacagggtctcactatgctgcccaggctcatctcaaactgctgggttcaagcaatcctccctctttggcctcccaaagtgctaggattacaagtagtgaaccactgtgcccggcctccctccctccctcccttccttcccgaactcttccattcctctccttccttcctttccttccttcccttctctctttctctttctttctttccttctttcttctcttttttttcttttcttttctttctttctctctcattctttctttctttcttttcctttcttctcttctcttttcttttctttctccttgccttccccaacataagaaagatagttaaacccgggtatggtggctcacatctgtaatcccagcactttgaaaggccaaggcgggtggatcgcttgagcccaggagttggagaccagcctcggcaacatggtgagactttgtacaaaaacacaaaaattagctgggcatggtggcaagtgccttgtagtcctcacagctgctcaggaggctgaggcaggaagatcacttgagcctgggaggcagaggttgcagtgagccatgatcataccactgcactccagcctgggtgacagagtgagactctgtctcaaaggaaaaaaaaaaaggaaagtggtttgggctgggtgcagtgtctcatgcctgtaatcccagtactttgggatgttgagatgggaagatcccttgagcccaggagtttgagatcagcctggacaatatagtgagatccatctctacaaaaaaagggttaaaaagttagctgagcatggtggggtgcacctatagtcccagctactcgggaggctgagatgggaggattgcttgagccctgaaggatagaggttgcagtgagctgaaattgtgccattgccctgcactccagcttcggtggtagtgagaccctgtctcaagggaaaaaaaaaattgtttggcagggtacaggggctcctgcttgtaatgccagcactttgggaaggattccttgaagccaggacttagagactagcctggtcaacaagacaagatcccgtctctacaaaaaattttatttttatttttattgatatatttttgagacagagtctcactcaggctggagtgcagtggcgtggtctttgcttattgcagcctccacctcctgggttcaagcgattctcctgcctcagcctcccaagtagctgggattacaggtgtgtgccaccaagcctggctaatttttgtatttttagtagagttgtggtttcaccatgttggccaggctggcctcgaactccagaccacaagtgatccacctgactcagcctcctaaagtgctgggattgcaggcatgagccacctcacccagctgctgaacttcttgaatctgtacatttgtgtcttattaaattggggaacttttggaggaccactgttttctccaaatatttttgcctttttttttccctcctccttctgggtggaactccagaccctttaatattgttccacagatctgtgaggctctgcttcctttttttcccccttctttttacagtcttgctctgtaatccaggttggagtgcagtagtgcaatcatagctcactgcagccttgacctcttggactcaagcgatcctcctgcctcagcctcctgagtagcagggactacaggtgcacatcaccacgactggctaatttttgtattttttgttgagatgggctctcactgtcttgcccaagctggtcttgaattcctggacttgagtgatcctcctgcctcggcctcccaaagcctgaccacattccccttaaaaatggtttcgtggccaggtgcggtggctcacgcctgtaatcccagcactttgggaggccaaggcgggcggatcacgaagtcaggagatcgagaccatcctgggtaacacggtgaaaccccgtctctactaaaaatacaaaaaattagccgggcgtggtggtgggcgcctgtagtcccagctactcaggagggtgaggcaggagaattgaacccgggaggtggaggttgcagtgagctgagatcgcaccactgcagtccaacctgggtgacagagcgagactccgtctaaaaaaaaaaaaacaaaaaacaaaaaacacacttttttttttttttttgtccagcagctggaatctcttttcagttatttcataaactaggctgcttggaatcagcctggaatttgggcagagtttataggcagaatttgggactcccctctgagactctctccttgagatttcccccctcattttatagttgttacagttgcttcaaactctcctcagtcacacatttcaaaatggagttcacccagtgctgttccctttctttcaacagttggttccgtccattttctctctgcttttggttgctctcagttccttcaggaggtggttttttatgttttgtccagggttatagtttttaccttgggacagttggtatgatatgagctggaagaggaactgactttgatctacctttttaagaaattgtgcgggtcagacagaacacatttgtatgtgttttggtgttaaagagttgtccagagcacatgaagctgaactgggacttcaacattttttcaaggttttacatttgctctttttttcctgtctccttcctcagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagaggtcagggtccgccccctagtggtggtaataaaaaatgcttccagatgaggttaagtgtccctggggaacaaaatcctccccatttgagaaccgctgttctagtccacgggcatctctggtccttactgtactcagattttccctagtgtctgatgctattgatttctggcttctcagagggctgttgttggagcttgtgatggtgtactcctgagagatgccttcccagctggggcgggtgcctacctgtttcttattcctagctgtgttttggggctctggccccttcactagatgtctcagattagggactgtagctttgcagggaagaccccacaccagcatgctgcagcgagttaccttcctaaactgccccttctgcacgtgggcctcactggccagtgtggtgcactggcaaagtaacctgtgttgtggctcagcagtgttgttctcaagtagttaatcttcaggtagtagctaaaaaatgtgaccttactgctgtgttctttcttgtttaatttaggcctgaacacggaggggattagtggactgagataagaatactgggttgagcatagccagacctgactgggattgctttcacccttggagactcttggctttttgcttcttattttcatcaacctggagctaatcctgtgcttggagttggaatatctggttttagactttgctgaccaggtcatcttgggcacattctgagcctctgcctgatacctcagctgtaacaggagggattgggatgagctcttttcctgttagtgtcgattttgcttttatgctattccctgttgtccttttgcataggcctggcattatgccagctgcctcacacatattagctcttttaagtatatgttggtggacaggtggaaatctgtgtttcagggatgattggcaagttaagttatgtgtccatggccacactgtagattattagtggtatgactggagtgtgctgtcttgactgactttcatgttcttcctttaaaaaatgattcctttttctttcagctttatcattttgtgattccgtgtaatttttgtgatactaaaactgccttctgtgacctgaattattataaaaacatcataaattgcttacaaagaaaatcagaccccacaaagctgtagaggtcctggcatacctatcctaggttttaaatgtaattgctttttctttcttttttcttttttttaataccatagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaaggtatttaggagacgttgtgtaaggggtcatgtgaccttgagcagtgagcatggccaccctatgagggcacctgcacgagtactggggcgggcggagaaggtgaggacaggcctggtacttccagccacttgcctgagccctggctttgggttggagggtgggctccaggatgccctggcactgcctcctcagttctcagctggctgctgagccagttgagaggtctagagaggtgagctaagtgttcaagattcaaatggctaaaaagaggcaaagcttgtttcttaacgtggttctgccagtttcagagcccttgcttgacaacgtcaggctacactcttttcatggatctcatctccaaggtgttctttagcctgatgtggtcagtggagacaggctgggctctagagtgtgacttcttaagtctgcaccatctgatgagtgggaagcagagctgtgcagaggtgctcccgctgtccttaccctgtggtccagtgtccacttactgtctcctcagccaggtggtccagcagatggcctgcctccctgaggcctagggatgtgtcttttgcctcctgttcttggttcccagtgcagagcccagcacactgaacacaagcgaatgagtgtttccttatcctaacttgcgatggaaaggtgtggtggtgctgctccattctgcctggtgatggtgtctccacgccttcacgtggcactcgggatggccctgacactcggatgagtataagccataggaaacaaccaaggggccatggctttggcagaaggaaggaactcttgatggggcagcagtctctgttcatctggtggtctatagggtgttgctttttagttgtaactccttgaaattgttaaaataatgaagagctttgagggttaaaaaaacgttttttgattactcaggagctgtttagttctcgctcatgtaatggcagtggtgaagtttttaaattttatttatttatttatttattttgagatggtctctgttgtccaggctagagggcagtggtgtgatcatggctcacaacagccttgacctcccaggcttaggtgatcctcctacctcaccctcctgagtagttggaccacaggtgtgcaccactatatgcccagttaattttttattttttgtaggacagggtcttgctgtgttgcccaggctggtctcaaacccctgggctcaaacgatcctcccacctctgcctcctgaagtgctcgagttacaggtatgagctaccatgcccagcctacaaagattttttgaagtgcccacagcagtattgaacctcatgcttttgcttgggaagaggcctgtgcaagttgtcagagtcctagctgttttgttttgagacagggtcttggtatgttgcacaggctgttcacgaactcctgacctcaaacgatgttcctgcatcagagctggctttttctttctcctccaactgaaaaacaaaccaaacaaaaaaatctggcttttattcctagccatgtcccttggttttgttaaaacttgagtaactcaacctgaattttgactcttcctctggagagtggggtcaataaatgtaaacctgggttgctgtgcagtaatctggtagctgttctgaaagtatgtcaggcctgatggggtggctcacatctgtaatcccagcactttgggaggctgaggcaggaagattgcttgagcccaggagttcaagactagcctgggcaacatagcgagacccggtctctataaaaaataaaattagctgggcgtggtggcactgcctgtggtcccagctactagggaggctgagatgggaggatcaaaaaaacatgaaaatgtgtcatgtggcagctcatgccaggcttcaccagcatgcttatggcaaggttttgggccggcctcttcagcttacaggtgagaaaactgaggcctgaggcagtggaacaatttactcatgtgtatagtgctcttgagcaaggctagagattcacccttggagggttggggccatgctggctgtgcttatttccactggagagcagaactgtgagtggcttgtggggaggagtttttctttggtggaatgttcagccttaacctacccattatgttctagagatggagaaattgaggctcagagagccccaaggactcaaattacatgtgatggagccgagacttgctcctagtcctcctggtgcccttgccctcaccacactgggatggttcatgttggtgacacatgggctgctgagaactgatcgtcagacatgactggaggggcagaagtcagtatggatttggaattctgtgagaattccttttcgaccagttgaataaagtaccattaaagaccgtctattaatactaggccaaggaaatagatttatatagagatcttcaaaatgttgaacacctgctgtgtgctatgcactgtcctgatcctttagctgagagtgagagagaaattttttttttttttttttttgagatggagtctcgccctgtcgcccaggctggagtgcagtggcgtgatctcggctcactgcaagctccgcctcccgggttcacgccattctcctgcctcagcttcctgagtagctgggattacaggcgcctgccaccacgcccggctaattttttgtatttttagtagagacagggtttcattgtgttagccaggatggtcttgatctcctgaactcgtgatccgcccacgttggcctcccaaagtgctgggactacaggcgtgagccaccgcacctggcctgagagacaaaattttgatgaaacgatgttgaggctatcatctaaaacacagcaagggagcacactccatttttgggggtctgtgtgtatttggacattgtagcctggtgaatccttggtcttctggatacacaggtagtgattggatgtgttagtgtttgtcttctgttgttcattttcagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattgtgttctttgggttgtttttccaactttctcttctgcacttaatctttctcatctccaggcttctttcttactctttctaaatagccctgctatggttcatttttgcagctttacctaaagttagtgattgattcaagtgtgatgtgttgccatttctttttatattcaactcaaatatgtacttcatctgattgaattagtgttaagggacacatgacctttgccttgtataacttctgtttttatgatagtttattatttagttacgatgattgcttgtttcaggatgatttgcagcaagagtgttttatgctaagtttaagttgtaaaaatgtccaagtgaattttattaggcctatgggaagaatggaaaacactggaagtgatcatctttgtcttatgaagcttgggtagataaattgatttttacatggagcggctgatgtaacatattaagaatgtacggccgggcacggtggctcacgcctgtaatcccaacactttgggaggccgaggtgggtggatcacttgaggtcaggagttcgagactagcctgaccaacatggtcaaaccgcgtctctactaaaaatacaaaattagccggacgtggtggtgcacgcctgtaatcccagctactcaggaggctgaggcaggagaatcgctagaacccgggaggtggaggttgcagtgagccgagatcgcgccattgcactctagtctgggcaacaacagcgaaactctgtctcacaaaaaaaaaaagaatgttatatgtccctgatacagagcaaataatggttggtcaacccataaatgtgtttttagaggaatagtaaaagataatgtggtttgaggtttttctgaaagttcttctagagtgaagttggaatttagtttgagcaagttgcgatgtggcgagtgcggagttagaactgagcaagttagtgtcaccctgtgatctgatctgtgcaccctctggaagtgtggcgtctagagtcaggccagactaggccaatgctccagtccaatattgctgaccagtcagcctcttatggccccttggtggtccttgcgtacatgtccccttctggtctctggctggaggcctgagctcctgtgggggcagcgttgctgcccttgctatgagcttatgtctttgtactgccacctgcatggccaaaacaggcttgtcagctggctgtgggagcaggtggctgctaggaatggggtacagaggtgcctccctggcagatgtagatgttagaggggcaggctgaggacgaagaggactctgccgagtcctgggtgcccttgcctgagtcctgccctggcctcctgtcctgtgccatgtgtgctctgcaggagttgtggcagaagagcctatggcctggcttcagctctgtctccatggaggacctttggcatccttggcttgccagaattcggggattcctttccaaggggttgcgggaaccccagggtgtaccccagggcctctagactcggtcagtgtatgaaaaaataaatgctggttgagacagaagctgtctcccctttgtctgaggatggaccttcaagcctctgcagcccgggtgcaggcacacatgggtgtgtgtgaggggctgctaattctttctctgctttctaaaaccaggcatagtctccacacagcaaaccctgtgactcccatgtcatttgtttgtgtggcacacaagcagctcttactgatttcctttttagtgtctggggatatttacttatttatatgatgccatgtttagctgttagcctctcatgcctgtgaaactgaagtagtcttttgaaagtctccttgttcttcctattagggcttattacttttaatttctttttttggggatggaggctcgctccatcacccaaactggagtgcagtggcgcagtcttagctcactgcaacctgtaccttctgggctcaggtgatccttccatctcagcctcctgagtagctgggactacaggtgcgtgccaccacacctggctaatttttgtgttttttttgtagagatggggtttcaccatgttgcccagttggtctcaaactcctgggccccagtgatccgcttgcctcggcctcccaaagtgctgggattacagaaatgagccacagtgccgcagcccaacttatatatcattgcatcttttccctgccttggagttaagtaattcctgtagtctgcaacagcttctctgacattcagatatactgccatttttacttctctctctctctcttttttttttttttttttttttttgagacacagtttcactctgtctcccaggctagagtgcactggcgcgatctcagctcactgcaacctctgcttcctgggttcaaggaattcttgtgtctcagcttcctgagtagctgggattataggtgtgtgccactatgcctggctaatttttgtatttttagtagagatggggtttcaccatattggccaggctggtctcaaacctctgacctcaagtgatctgcccacctcggcctcccaaagtgctgggattacaggcgtgagccaccgtgcccggcctcatctctctttctttgcttgactccgggaccttgcactgtggctaagtgctttcactcttgtgcttatggcaccgttgtgttactctctgcggttgaggctgggactcaggaatcagcctgccagggtctagttagctggctgatcttgataatgaacttaatctcgctaagcttcagtttccctgtatatgaaaatgaggaagatgataccatcaccttcatggaaaggtcttaatgcagtgaccaccggatgctcgtattagcaattgtcattatcctcacttttacttttaaaacctgagtttttattgtttcaactcccattcccctggtttcttctatagctgcttcctgaaaaccttcatgtttgaccagttattaaccctgcagccacctagtgtttggttaattttaatacttttgtatctgtttttaagtgttttcatgtcctcaggtattccctcagttttcaaaacataatgccaaatgggtatacttggattctagctttttttgtgtatgtgtgaaatatttgatctatttttttaatctattttaaaaactttcaagtcaaagtaaaacagcacagcagacacctatcccctcatctagattctccaccttgaaacatcttgttctacctgttgaatctctttttttttttttttttttttttgtgacacagtctcactctgttgccaggctggagtgcagtggcacgattttggcaacctctgcctcctgggttcaagcaattctcctgcctcagtctcccaagtaggtgggactacaggtgcacgccaccacacccagctaatttttgtatttttagtacaaatggggtttcaccatgttggccaggatgatcttgatctcttgaccttgtgatccacccaccttggcctcccaatgggattacaggcatgagtcactgtgcctagcctccatctcttttgttgcatgatggctggtagctttcgtggcactgttacccccaaatacgtcagaacaaggacagtttccttattgactcagcaccagccgcatttcgggaaacatcacatcagtaacaagatctgttgctgtgctaagagcaggtgtagggcgtgtccccagcaggcccctacctgtctttttctgtacttcagggttgagatgcatactcggcatctggtggttgtgcctctttagcttctgctagtctagaacagcactcccaatccccaattcctcatgactgctttagctttctcatgatcagacctaggtcagaaaggccaggttggatctcacagttggaaccttgaaaggtagctttggccctttactaaagatctgtgtacagaagaagggagtgtcctgcaccagcataggctgggcagtggcctgcctcacctcagcagtcggcttctctaggaattattgtgggatgtagagtaggaggcacaagcaaacctacttcagaagactgataatatacttttttgtgtgtgtgaaggcattagagtataaaagatactgtacatttgaaaagcagttcagaaggagtcaagcctgggtagataaccctccaactgaaaggagattcagataatcttaaaagaaaaggggtcaaaggaagtgagcagaacaaagagaagtgagggaaggacagagtgctagtcagaccacatcaggaggagcttatgtgtcagctgacccacccctggtaggcgatgaccaccagagctctctgtggaaaggcacaggtccccattgtcactaatgagggacctgtgggctgtgcttgtagtctgtcccaacagtgtagcttttgttgttgttgttttgagatagggtcttggctctgttgctctgtccaggctagagtacagtggcacaatcatagctcactccaggctcaaactcctgggctcaggtcatcttcttcctgccttggcctcccaaattgttgggattacaagtgtgagccaccatacctgtccccagcagccacggctttagcagtccttgatgattcatcatggacttgttaaatggtaactggctattattgcactttctacattttagttgtcatttttctatgaaaatgagctcctccctaaaaaaaaaagagttatatattttagttcttattttcttaaatcctcacattgtcccaaatttgaccagtgggagttctattaagttcctttaagttgtatgcctttgacatgtccccgtcagcccttgagcacctctttacgttctggtacaacaagatgttccaggctcatcttgtactgtttttcccaccaccccccccaaccctagcatcagccgtttctcagagaaggcctaggttctttgagtacagaatagtatgtaggagcccaggtctggtcgctggttgtgttcattgctctgggagacagagtttgcaagggaaactctgtgcagtaggtctccaagcagtgctgagcccttgctccaagtggagctcttgggtccatttttgattctccaacacttggcctgcagcaccccatgatgagaatgagacagtgagtggtgagtgtcgttgttttggaaggacagggatgtgaagaagagatagctcctgccgtggagtgggctgagcatgggtcctgtgaagccagtacttttatatttttctatcctctattcctatcctttttttttttcttttcctggagatggagtcttgctcactcgtccaggctggagtacagtggtatgatctcggctcactgcaacctccatttcccaggttcaagcgattctcctgtctcagcctcccgagtagctgggattacaggtgcacaccactatgcccagctaatttttgtatttttagtagagctggggtttcaccatgttggccaggctggtctcaacctcctgaccttgtgatccgcccaactcggcctcccaaagtgctgtgattacaggcgtgagtcaccgcgcccggcacccgttaaaaaaaaaaaaaattatttatcatgcttgggatttatggaccagtttgaatccgtgtatcttagtaatatacttaaattttgaaaactgaggtataatatacatgcaaaagtgaacataactcataagctacagctcaatctagattcttttggaaatcaaaatttcctttggaaatcttaagttaatgaaagtcttaatagcattgttgtaatttacagcagcagaacctgtgttagctagtatctaccagggcacctaggtggactagcagcttttaggctcaacctttttttttttcgagacagtctttctctgtcacccaggctggagtgcagtgtcacaatctcggctcactgcaacctctgtctcccaggttcaagtgattctcctgccgcagcctcccgagtagctggcactacaggcatgtgtcaccacacccgactaattttgtatttttgctagagatggggtttcaccatattggccaggctggtcaaggctcaaccttttaagttggaaacagaagataactatatgttttagatattacactcactggtctctttaggtaactgtggtctggaatcaagtaattttctgttgtggagatttttgttgtcaccttttctgtgttatggaagggaatgttaggaattaaccctccttgctttatataggaaaaaaaatgcttctggcattttctaaaaatattgcaggtaatctggctttctcgtgtcttgtgctgtttgatggtattatcttcctactgatttgtttcttgcttgttctattacttgctgagagatgtgttaaaatctcccatgggattgtggatttgctgtttttctacttgtagttctggcagtttctgctttacctattttggggctctggtgccctccagagactgaactgggaaactcaggcatggtcatgcttgtcctttgtttcccagggagctctgtggtctcatgtcgttgtgactttgctcctgtgctccattcttggcttccgcagacacctggccttgtctgcatctttatggcttctcttccctccctggagctttatctctgaggcagccttgtctcttggtggggttcattttgcatgcatggaacttaacaggctccacaaaatctggagagaaactctggcttagttgagcccagagagtcacaaactacctgtagtctaatgggctgtgatggggaaaaaaggaacacagtacaaaattaggtaccaggactgttagtagaagccaggttctcttcgaaggggatgtaggtggggaggtcagtgacttgcatttttatacagatggtgattaatgaacatcagaaattgcataggaagagggccaggtgcagtggctcatgcctataatcccagcactttgggaggccaaggcaggtgggtgacttgaggtcaggagttcgagaccagcctggccaacgtgatgaaaccctgtttctgctaacagtacaaaaattagctgggtgtggtcccaggcgcctgtaatcccagctcctgggaaggctgaggcatgagaatcgcttgagcccaggagacagaggttgcagtgacccgagatcgcagtactgcactccagcctgggcgacagagcgagacgccatctcaaaaaaaaaaaaaaaaaaaagaaaaaaaaaaagaaagaaagaaattgcataggaagggaggattactaataacatagtactgggacaactggttaattattggtaaaataaaaacagtgagatattcacctctcaacttggaccaaaggatagttcctatggattaaagaaacccataaaaatagtagaaaattcggttatgttatccggtttctagatgggaaagaacttcagaatgttacactcatttattttacaaacttgggatcagattacaataatctcttctgctttttttcccacctgacatgtaaggagcatttatctgtgtcattatttataaacatggtttaattttatattgtgtgtgctgttacaggttttctttattataaaaatgctataacatacctgtattcattttcattactaagaaaagttcttacaaagttttaaagtaatggaagaagtcacaaatcccttgacatatccttgaatcttaggtattttcaaatcaaagaagtttgaacacttaaaaacaagtcaaattgtactgaaagattaatagtgaaaaatcatcccctgccttcctctctcctccccagaggtaattatttttatctctttcatcattttcttctacttctaatactttgatttctcatgtagacattttctgttaactttctatcatggaaaatgaagattgaactcttcagccattttctatttctttccccccattctccccatataattaagtcactatttgtaataaatgaaaaataagtgtttacataattttgactatgtaaatatcattcagtgaaaaaccaagttatgttctgtaattgcattttcttgtaaaaccttttgtttcccttggaattaattactgcctttcttttgaaatcatacactatgttgtccatacagccttaatttttttcaagtattcatctcctcatccttaaaactcatccttattatgaagttagtttctcctatttatatatttatatagttattttttctccttaaaaaaaaatgaaaacctgggtttgagtcccatcttccctttctgcttcttggaactcatcttttaaccctccttccttactacttagattttctttctttgtaaaaaagttgttttctctcatcttttcttcccttggagctctctcctagaatcttcctttttcctgcttgattctggtttgctagcactcttaaccttttgcactgcagtaagcttagactttctttaagctgctttccctagttatttacattgttttctgtagttctatgtgggcagcaagccacccaggtgccaaggcaagagactgaaggcacaggctgttccagtataataaagaaaatacttaaaataagaatagttatattagacatagaatatagacatgattatatatgaatattattaatcattagtttgtagcattactctttattcaaatattataacaatctctgttctacaattataacctaggaaaaaccaggtcatacagagataggagctgaagggacacggtgagaagtgaccagaagacgagtgtgagccctctgtcacgcccagacagggccactagagggctccttggactagcggtaacgccagtgcctgggaaggcacctgttacttagccgaccttggtctagcggtagcgccagtgcctgagaaggcacccgttactttgcaaaccaggaaagggagtctccctttccgtgggggagttagagaagactctgctccaccacctcttgtggaaggcctgacatcagtcaagcccacccgcagccatccagaggcctaaccgtctccctgtgatgctgtgcttcagcggtcacgctcctggtccactttcatgttccgccctgtacatctggctccgccttctagatagcaatagcagaattggtgagaatattaaagtctttgatctctctgagaaatgcatagaagaaataatgtaagctgtcccctctctctctctgcctcggctaccaaacagggaagggccccctgtctggtggacacatgactcgcttgaccttacctatcattggagatgactcacactccttaccctgcccccttgccttgtatacaataaataacagcgcagccagacattcagggccactaccagtctccgcatcttggtggtagtggtgtcccctgtgcccagctgtcttttcttcaatctctttgtcttgtgtctttatttctaccatctctcgtctccacacacgaggagaaaaacccacaggccctgtagggctgatccctacagttctatgctgtgttctttcttggttaagttttcttttttcctggaggctatttttggtatcttaagacagtttgtatgggaagtaaatttgagtccttgcagttcagagtatgctacttttgtttttgtgaggtggagtcttgctttgtcgcccaggctagagttcagtggcgggatctcagcttgctgcaacctctgccacttgggttcaagtgattctcgtgcctcagcctcccgagtagctgggactacaggtgtgtgccaccgtgcccagctcatttttgtatttttagtagagatggggttttgctatgtcggccaggctggtctcgaacttctgacctcaagtattctacccgccttggcctcctaaagtgctgagattacatgtgtgagccactgcacccagcccagagtatgctactttttttttgagatggagccttgctctgttgccaggctggagtgcggtggcacgatcttggcttattgcagtctccacctcctgggttcaagtgattctcccgcctcagcctcctgagtagctgggactacgggcacacgccaccatgcctgactaattttttgtgttttagtagagacagggcttcaccatgttggccaggctggtctcgaactcttgatctgaggtgatctgcccaccttggcctcccgaagtgctgggattacaggcgtgagccactgtgcctggcccagagtatgctacttttctatcttcacacttgattgatggtttgactgggtgtagaattttatgttgagaagaattcccctaggaattttgaaggtattactccatttccttctagcatccagagtttttggccattcttcacataatttgctattcttcacataccttgctattctatttcttgttccattaacttggaggctggcctttcacccaacccccagcagcttgaatttcagcagggtgtgccctgctgtggatgttgcagtgggacacttaggactgttttagttggagacttgattttgggtttattcttggagcttctctgtttctccagaaagcctattatttgggtatcaaacctcctagattgatcttacaggttgctatggaaataggtatttttcatcttaatttttttcttctttctgggagatttcttatcttccaagctttcttgttgaattttttctttttttctcttttttttttttttttttttttgagacggagtctggctctgttgcccaggctggagtgcagtggcgcagtctcggctcactgcaagctccgcctcctgggttcacaccattctcctgcctcagcctcctgtgtagctgaggctacaggcgcccaccaccatgcctggctaatttttgtatatttagtagaaatgggatttcaccgtgttagccaggatggtctcgatttcctgacctcgtggtccgcctgcctcggcctcccaaagtgctgggattacaggcttgagccactgcacccggcctgaattttattttcatagttgtattttagaatttcaaatatctctttgtttttctgtgttctcttttcatagcacacagggtttctctgttgggtatcttctcttcccttgccttatgtctgtggccctgcagagggccattcatttctgtgtgttttggattcattcatactggatgcttccctgggtccaggggttccttggtgctgggctcgtgtttaagagcacgacacttagagctgcctgcaaccatgggtggggaggcttggttatccaccctcctttgcattagagggtctgattggccattgaccacttaattgggggaatctccagaagactcactggagaggtttttcctctggagcacttcaggtcttcaggaaatatcctttgattcatctgggccagtgttctgcatgaggggacagggagtggtaactgcccccaccctgtgccagggagatccccctccctcctctcacctggcacagagatctgaccttttaacctgcttacctgtattcaccttctcatttgacttcagtggaatctggtacctcctttcttttattttgggcccgtctctttctttcctcatccccctggctgcactgtgggacgtggcttcttcctctcagctaagagtaagactagtgggcatctgtggggttactctgtggtctgagctgctctctgaggccactgatgctcctgtcactctagcactgtgagataggggggtagctagctggtaggtagcagggctgggatttgaacccaggttgtgtgatgtccgtatactgcctccttcactgcctctctcactcctttcttgcacatgtcctcttgtcttatttggtatctttttaagagggaataaaggagtgcatttagtcagctagctagcttttttctttttcttttttttcctttctttttttgtttttgagacagggtctagctctgtcacccaggctggagagcagtggtatgatcttggctcactgcaacatgtgcctcccaggctcacgccatcctctcacctcagcctccagagtagctgggactacaggtgcacaccaccacacccggctaatttttgcatttttcgtagagatgggcttttgccatgttgcccaggctggtctcgaaatcctgagctcaatctccctgcctcggcctcccaaagtggtgggattacaggcgtgagggactgcgcctggcctggttggctttctttcccattcaattttgaaccttatctgagtctcttgtaagttaattagtttccctctttggcatgtggcatggaagggataagaagtatagaatttgttttgaggttaacaggctcagacaacaccaagggaaacaactgcaaaatagcagtagatttgactagtttcatcccagattctaactttcattctctaacattttattttaaaaactaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaaggtgatagatgacccttcagtctacttttagaccagaaatttaatttttattctttaagttaacttatttttgttttgaacttatacttgctcgaaatattgtaatggcttaacaatctctttcattgttgacttttgcccaaggatgccatgttacaatatgataaagttcttttagagacacaactgatttttttttgctcatttgatgactctcagagataacttgttttagaatttatatatacacatatatgtacgtatatatgtgtatacacacacacagacagagggattaatgtaatgtgataggaattgatttctggtttaaagaaacaataaaggtattatgttgggctgaattctaaaattggtttttaaaagtttttatttctattattttttaaaatttttttgagatggagtttcactcttgtcgcccaggctggagtgtaatggcatgatcttggctcattgcatcctctgcccctccgggttcaagcgattctcctgcctcagcctcccaagtagctggaattacaggtgcctgccaccacgcctggctaatttttgtatttttagtggagacagggtttcaccaggttggccagactggtcttggactcctgacctcaggtgatgtgtctgcctcagcctccacaggtgctgggattacaggtgggaaccaccacgctggccaagttttttatttctaaaattatgtgaaaatgtaaaagtattcttttttttttttttttttttgagacagggtcttgctctgtcaccccaggctagagtgcagtggcgtggtctcgggttactgcatccgctgcctcccagttcaagtgattctcatgtctcagcctccctagtagctgggaccacaggcatgcactaccatgcctggcttatcttttgtattttagtagagatggggttttgccatgttgaccaggctggtcttaaactcctggcctcaagtgatccatctgccttgacacccataagtgctggaattataggcatgaatcatgtgcctaggaaaagtagttaacttttatgtttgtgtagtgaaacttacagtgtctcttttttttttcccagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtcagtactaagttgtgtttcatgctagcaagtttcagaatttgaggaacatcccttcagtgcagaatcatctgtttctcagcattatcaggagactctaacatgagccttgcatagattttagatctaataaataagtattagggaacagccattctgacccttgagggaaaagatactcgacttgcactctggggtcttaaaatatccttcctaatgtggataagaagataccgagaacaggccaggcacagtggctcatgcctgtaatttcagtactttgggaggccaaggcgggaggattgcttcagctcaggagtttgagaccagcctgggcaacatggtgaaaccccatctctacaaaaattagccgggtgtggtggcacatgcctgtagtcccagctgcttgggagactgagacaggaggatcccttgagtcctggaggcaggaggatcccttgagtcctgaaggtggggtttgcagtgagtcgtgatggcatcactgcaccgtagcctgggtgacagcagagcgagactgtgtctcaaaaaaaaaaaaaaaaaaaaactagcacagagggaagtgggtctcaacaggctgcgctttgcttgaagcgtgtggtcatgtccttaacgtgtgactccaggttagcactttctccagcagtctgttctgaagcttccagtgcaggatatgctcatctgtaaagctcattgtgtccactggcactgagggtgttgatttatttccctgacatttaaaagggtagcaatgtgattaagacatttatataattttcttaattgtttgcataaaatgcacagtctgttagtacataataaaggctgtaaagaactgaaggagttgggttccccacttcccacttttggttatgttacttggagtggatcatattctcatgcttaaaaggctttttttaagtgttcattttaattttacttccataggaattttccattcagtagtctaaatctatgtggtgattaaaggtatcaaaaacaatagtgttggccaggcacagtggctcacacctgtaatcccaacactttgggaagctgaggcgggtggatcatgaggtcaggaatttgagactatcctggccaacatgatgaaaccccgtctctactaaaaatacaaaaaaaaattagctgggcatggtgacgcgtgcttgtaatcccagcttctcaggaggctgaggcaggaaaattgcttgaaccagggagtcggaggttgcagtgagccaagattacaccactgcactccagcctggcgacagaatgagacgccgtctcaaaaaaaaaggaaaaaaagtctgtcttcaaaaaattttccatgaatctttaaccagcatgtattttgtggcaggcagtgtggcacaataaggagccatgagtagttcaggcagagatgcataaatgggtgactgtgagtattctaataaatctactggacatgatttttttgtccctatatgggatctggaaattctgccagagaaaggcatttgagtgatgccttcaagagtggctgggcgtggtggctcccgcctgtaatctcagcacattgggaggctaaggtgggcagatcacctgaggttaggagtttgaggctagtctggcctacatggtgaaaccttgtctctactaaaaatacaagaattagctgggcatggtggtgtgcgcttgtaatcccagctactcaggaggctgaggcaggagaatcacttgaaccgggaggccacagtgagctgaaatcatgccgctgcactccagcctgggtaatccttagggcttttctcaggaatgcaagggtgatttgatgttagaaagctattattgtgacttactgtgtaatgctcatctccatagagggagaaaaggcatttgataaaattcattgctttttttaattaagtaaacaccctgtatttatggggtatatgtgatatttggtacgtgcattaaagttcattgctttttctccttgggaggttgaggtgggaggattgcttgagcccaggagtgttgaggttgcagtgagctgtgattgtgccacagctttccagcttaggtgacagagtgagactctgtctcataaaaagaaaagaaaggccgagtgtggcagctcacacctgtcatcccagcactttgggagggtgaggcaggaggattgcttgagcccatgagtttgagaccagcctgggcaacatgaaaccctgtctctaaaaaaaaaaaaattttttttaattagccagatgtgatggcatgtgcctgtagtctcaactactcaggaggttgaggcaagaggattgctcgagtccagaagtttaaggctgtggtgaaccatgatcatgccattgcactctagtctgggccacagagtgagaccctgtcttaaacaaaaaaattattgcttattgataaaaggttagtaaaccaggaataaaagggaacttcctaaatctgtttaaggatatgtatcagaagctttcatcaaggatattacacatgaaactttagaagcattctccttaggccaggcatggtggctcacacctgtaatcccagcacttggggaggctgaggcgggtagatcacttgaggtcaggaattcaagaccagcctggccaacatggtgaaaccccgtctctaccaaaattataaaaaataagctgggcatggtggcgtgcgcctgtacttccggctatgtgggaggctgaggcaggagaattacttgaacccaagaggtggaggttgcagtgagccaagatcgtgccactgcactccagcctggcgacagagcgagactccgtctcaaattaaaaaaaaaaagcattctctttaaaatcatgaacgagggccaggcacaatggctcatatctgtaatcctagcattttgggaggctgagacaggtggatcaatgaaagctgggagtttgagaccagcatggccaacatggtgaaaccccgtctctactaaaaatacaaaattttaccagctgtggtggcgagcgcctgtaatcccagctacttgagaggttgagaaaggagaatcggttgaacctgggagacggaggttgcagcgagccaaaatcacgccaatgcactccagcctgggcaacacagcaagactctgtctcaaaaaaaaaaaaaaaaaaagaataagacaggaaaccatttttcaccatttaataaacgttgtacggaaaatagtagccaatattaggccgggcgcggtggctcacgcctgtaatcccaacactttggaggccgaggtgggtggattacttgaggttaggagttccagaccagcctggccaacatggtgaaatcccatctctactagaaatgaaaaaattagccaggcgtggtgatgcgcgcttgtaatcccagctactcaggaggccgaggcaagagaattgctggaacctggaggcagaggttgccgtgagctgagatcacactactgcactgcagcctagacaatagaatgagtcttcgtctccaagaaaatactagccagtattataaaggaataaataaagctgtcattgtttgcagaagtctatgtagaaaactcaagagaatgtacagaaaatcttttagaattaatagagttcaccaggatataaaattaacatacaagtgcagcatcaaagaggaaatgtaatgttaaaaaagataccattgataatagaaaccaaaatgtcaggtactgcggaatcaatattacgaaatatgcatgtaactttagagaaaaataactgatattttagcagacctcaataaagatgtatttatatataggaagattcaagcttctgaagttgtcaattctccctttaataatctataaattcagtataattctaataaaacttccaacaggaatttatttgccctttgtaagtggatgctgctgtggccacatttgaagagaggcttggcctgaggatttgctctaccagataggaagttatcttatttaaaatagcagtatttggccaggtgtggtggcttacgcctgtaatcccagcactttgggaggtcaaggcaggcggatcaccggaggtcaggagctccagactagcctggccaacatgatgaaaccttatctctactaaaaatatagaaattagttgggcatggtggcaggcgcctgtaatcccagctactcgggaggctgaggctggagaattgcttgaacctgataggcggaggttgcagtgagctgggattgtgccattgtactccagcctgggtgacagaacaagattctgtctcataaaaaataaaatagcagtattcacgcagggcagtgatatggcccaagacggggcccagaacaggctctcgagcatgtggacatggatgggaaagcgctgcaggccagttgcgtgggaggtctgcactggacgtggtgctgggaccactgtgatttatgaacttggccagcatgggagaggagctttgtcaccatgggagagggaaggatttcttaaataagccaaactaataacaggctataaaggctataaaactatgtatgttaaaatgaaaatctaggccaggcatggtgactcacgcctgtaatcccagtactttgggaggctgaagcgggaggattgcttgagccactgcaccacttcagcctgggtgacagagaccctggctcaaaaaaaaaaaaaaaaaaaaaattcttatgtgtcaaggacaccatcgacacagtgaaaggacaaattctgtaaagagccgaaacaattctgaaggagaagggcaagtttcttggagagccagtaagtgcatgaagagatgctgctcaactgcggccatgcccaggaagctgtatgttacgatcctggtgggatggtccttcacagtcatccttcacagtcatcaggtgagcagacatcaaactcagaacagccagggattgagaagatgagcaacagtgggactcctcatacaatgctggtgaaacatcatttattacacctgttttgagagaaatttggcaagatctagtgaaattgaagatgtgcctttttttctcttacagttttactcctagatatttaccctagagtaattttgcccttgcacgcagagagaccacagtgtccaaaaccaaaaagctacccagtgacagactatggtatgttcctacagtgtaactacacatcaattaaagtgaactcattggatgtcaaagcagaaacaaattgctgaagggtatgcagattctatcacttgtgtagtttgaaaagggccacatacccacaactgagtttaacttatccctttctctgcgtccatctaaaaagtgtaagtgggcagctgtgaaggtatgtgcctctctccaggagccaagaggtctatccaggcaggagccattaacacctggtggagtagctgtggtcattgttggatataaaatgatacaaagcaggccaggcgcaaggtgggaggatcacttgaatccaggagtttgagaccagcctgggcaacatagcaagatcttatctctaccaaaaataaaaataaaataaaatggtataaagtaatcagcaatgtgtgtacagccaccgtttcaggcatgttgggggagggtgcagtggcaagctctgaatggacactccagtgtttgacagctaggcctgcgcagggttggtgaggtgctgtatgctcttgggccctggaagcagggtaaggcggtgtcgggtgggaaccgccccgtcagccactctggtatgttgctcggctgtgtctctacaacctgttcactagtttggaattgtgaaaaaaatgggtacctgagaattgaagccactgtccaaagaccaccctattggctttttgggacccaaattgatctcagatggtccttctagtgctaagaaatgtgctaaaaatgaaagtctggattggcactatactaaaagtaatataaaaccaaactgaaggtatacagttaaaactgagttctgggcagagtgcagtggctcacacctgtaatcccagcaccttgggaggccgaggagggtaggatgcttgaggttggtagtttgagaacagcctgggcaacacagtgagactctcatctctacaaaaaaaaaaacaaaacaaaacaagaaaattaacggggcatgatggtgcacacttgtagtcttagttactcaggaagctgaggcaggaggaccacttgagcctggaaggtcgaggctgcagtgagccatcattgcgccactgcactccagtttggatgacagagcgagaccctgtcaaagcaaaaactacaaaaaattgagctctgtgttaatgtccaacactctgccctgcccacccctggttcctgatgtaaggcccatggggcctcccttccctcccctggactctggctgggtggttttgaagaattttctgttatcggaaaagcaatgactattaggatgctctttaactgttctgtaataagcaattctaaacttgaggaagctcctccctgcttccatctgtaacctaggtctttctacattgttttttatttttcgggagtgctggtgcacacaaggatggtttttgttggcttgtcagttaaccaatggccaacccttgagggatagagtcaggtggaacttccttgctgctttctgtgccttccttttctagggtccctagatgtaaggctgacttcaggactttttgttgctacttgctgactctttagaggtcattttctttttctttctttttttttttttttttttttttttttgagatggagttttgctttgtcacccaggctggagtgcgaaggcgccacctcggcccactgcaacctcctccccccgggttcaagcgattctcctgcctcagcctcccgagttgctgagaccacaggcacatgccaccacatccggctaatttttgtatttttagtagagatggggtttcattatgttggccaggctggtcttgaactcctgacctcaggtgatccacccgccttggcctcccaaagtcctgggattacaggcctgagccactgcacccagcctagaggtcactttctagcttcctttctccgtactagtgaagaaatgtacttctttttatatatctatatatatatatttttttgtttgtttgtttgtttgtttgtttttgtttttgtttttgagacagggtcttactctgtcgcccaggctggagtgcagtggtgcaatcatggcttgccacagccttgacctccctaggctcaagtgattctcccacctcagcctccctagtagctgggactacagccatgtgccaccacgcctggctaacttttctattttttatagggatgaggtcttgctatgttgcccaatctggactcaaactcctggccttaagcgatcctcctacctcagcctcccacagtgctgggattacagacatgagccagtgcacctggccggctccagtatgagcagcattttcactagcaggctttttgggcctgaatttttttttttttttttttttttaagacgtagtctcgcactgttgccaggctggagtgcagaggcatgatctcggctcactgcaacctccgtctcccaggttcaaacgattctcctgactcagcctcccgagtagctgggattacaggtgcccaccaccacgcccagctaatttttgtatttttagtagagccagggtttcaccatgttggccaggctggtctcaaactcctgacctcgtgatccgcctgcctcagcctcccaaagtgctgcgattacaggtgtgagccaccgtgcctggtttggcttgaatttttaattttttttatttttatttttgagacagggtctcactctgttgcccaggctggattgcagtggcacaatcacagctcactgcaacctccgccttccgggttcaagcgatcctcccccctcagccttcctagtagctgggactactggtgcacgccaccacacccagctaattgttgtatttttagtagagacagggtttcaccatattggctaggctggtctcaaacacctgacctcaggtgatctgcccacctcggcctccctaagtgctgggattataggtgtgagccattgcaccagcctgagtttttaatttttaaaggcttttctacctttcctgatcctaatttttacacatccattagattggaaccagtgctttatgtcagttctttttacatgccttggtattagttatctattgttgcataacatgttacctcaaaacttagtggctgaaaacaacaacatgcatttactgtctcacagtttctgtgggccaggaatttggcaaccgcttagcttagtggttctgccttagggtctcttgaagttgcatttaagatgttacctggggctacatcatcctaaggcttgactgatgctggaggatctgcttccagggtaccttctctcactcatgctgctggcaggaggcctcggtccttcaccatgtggccctctccacagggctgctggtgtgtcctcacaacatgatgggggctggctttctccagagtaagtgatccaagaaagagcaaggtggatatcttttatgccctacacttggagtcatatgcaaccatttctgcactatgttattgactacgccgtaagcagtagtgggggcttgagctctaggaggcagggctcacagaggggttgggggtcgtcttggagggtggatacctaaacattcttcgctgaatcctgaaagcaaaagaaaactctaaaaagatgttggggggagcacagtgcagtgcctcatgcctgtaatcccagcactttgggaggccatggcgggcagatcacttgaggtcaggagttcgagaccagcctggcccacatggtgaaacccccatctctactaaaaatacaaaaagtagccaggtgtggtggtgcatgcctataatcccagctactcaggaggctaaggtgggagaatcgcttgaacccaggaggcagaggttgcagtgagctgagatcacgtcactgcactccagcctgggccacaatgagactcttatctcagaaaaaaaaaaaaaaaaaaaaaaaaaaaaaagccttttggggagcagcaagtttaaggagggggattttatcttgaggactctatttgggggagtctccaattacgttggcaatgttttagtcagctgtgggattgtggaaatttggttttccatgtttttttggtatgttttaaatttttatttatttttgagacagaatcttactgtttcccaggctggaatgcagtggtgcaatcataggtcactgcagccctgagctccaaggctgcagtgatgcttccacctccacttcccaagtagctgtgactacaggcacttgccaccatacccaactaatttaaaaataatttctttttttttttttttcaaacacgatctttctctgttgcctaggctggtctcaaactcctggcctcaagtgatcttcccacttaggcctccgaaaatgttgggattataggcatgagccatgtgtccagcttgttttttgatatgttaagaataaagaagtggccactattgagtgcttatcacatgtcagataccttgccagtatgttattgtacaaaagtatatctagtactcctcagaatcaccttataaggtaaatataaattatctctgctttatagctggctaacctgagcttaaaagttgtaaggtttcagtgagatgatgcagtcaggaagtaggagaattgggacctgaccctaattgtgtgtgagcatgcgcttttgtgtttttagaactcgtaaccatcataccatacagtttcaccgtgaagctcggagacgttaatgaggagtcattgctctgttaacctcagatgatgatgacactttcctggcttccccgcagaagccgtctgtggtggctgtcttgtgaggcgtggtggctgtcttgtgaggcgaggtggctgcagggcgcttgtgactctgctttgacgaagcagtaaaggacactgttagcattcatcctaactgggggctctggagtcatggtgggtgatggggtgccaggggcagaggtgggtgggagggcagcaggcccgtgaaggaatgtgctgtgtttgaggaggtgagaggcagatgtgttgtggatccgaagccctgtgcagaaacttccactggttgaagagctgaggcccttggagcttgaagagttgggagtgagtgggctcatggagtgagtcatggcagcaatcagggtagggcctgctgggttgggaggggtgtggcaggagtaggcatatgcagggctggggacagggaccccacagggaacactggtggagtgctgggggtcagagccagacccagaactgcagaaggtgtcctcaaggtgggaggtcccaggcagttaggctgggggtgtctgcaggttgtctagagaggtggtgggtgggcattggtgggtgttggtgtccaggccagggtgaggacaagagggagtggagcacatgactcatccaggcaacaagagggcaacaagagcctcccatggtggggccatgggaggctataagaagccgtctgtggtgactgtcttgggaggaggggtttgggtttgggggcagaggttacctgtattggctgggcaggtggtaggtccaggtggtaatggtaaccaaccaacattaacctgatggttccttaccactgccaggtggagtgttactgcccccgtttcacagagtggaggcagagacagtgccttcacttgccgaagtccacagaactacccagtagaggagccagcatcagagctggttggtgccgagccagtcagcagactttccaaagggctggtgagcagtgagggctctgttctgactgctcagctctgctgttgtggcaggaagacagccatgggcagcatgggaacaaatgcatggggctgacatccagtaaaactttgtgggcactgttgtttgaatttcctgtaatttttgtgtcatgaaatattatgatgtttttcagacattgaacagaaacaggtggtgggttacacctggctggctggcattagtgtgtcagccctgtgccctgctctcgagatccgtggctctcggacttggggacacattagcaacccctgggaaacctttaactcactgaggccagacccggtgggttgggttgatcttgggtgggacctaagcaccataggatttcaaacccccaggttattaccaggtggagcgaagtccccaggatcagacttcggtgtgtctgcggatcatcctagagaccttgtgaaagtgcagattcctggtaggcaggttggggtggggcccgggagtctgcatttctagcatgctccgggtgctgatgctggcagccctggtgtggctggagggtagggaagcctcgtcttttggctgtgcaaggttgtctccgtgtgctggcctgggctgtgacagaagccagctcgcactccttggtgtgtgccttcacccctgcccagggcctgtacctgaaagacgagggtaggtgctgcccagtgaggacactgagctgagcccacctccatgttcaggggcagcgttcctgtggcactggctctacagctaatttttcaggggtgcctagaggctgggtcttaagtgagttagtggttttggaaaagtatatatatatttttatcatttatcatttccaacatttacagaagtagagttgaattgttttcactggcactattctaatttatgagttttcattgagtcacagcatcagttaagcactacttttctttgaagcttttatggacatagttccacgatgtgggaataaaaatgcgacacactaagttctaaagggccgtgcatttgatttcatgcaaaacaaaacccaatgagttttacggatttaacttctcattgcaccttctcccgttcccacaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaaacatagcattatgctgatgtcctctgcttgggttgatgtgtgtagtgtagcaagctgagctctgatcttggaaccgtagggaagtgtgtccactctccctgtttctgacccgtggggtttgggccagcggtccaagtgcgtgtggtcacagtaaaaacagcttctgccatctgcgtttactggcttatgagagctattcaatgtagtgccttctggcctgtggctcccttgctctcctacccaagttgagcagccactgtggtcactgctgctgatggggctgtgtgaagagaggacacaagaaggaaggggagggaaggtcgtctcttggattccaggcttacatgatgtggtagggtcagccttcaggcctgtgacttccgaggaggcagcacttttcttgcttctgagagcaatcctcctggtttcggctgtagtctgcaccttacaggggtccggagtgtgggcagctcctggcttgtttgcctgagagctcatagggcaagaagggtgactggactgaccttgaattcaggtatcctttggtccttcctaggccttcggcttaaaaaaaccaaaagtgctagtttgctttgggcagtggcaagaggagggagagctgacattgtaagatttgaagatgtgtaacagtggttagatttgtgataaatatgtgcttggatgtaaattgtggaaaactgagatttgaatgtaaaaataactgacatattagggtatcaatttaaaattaaaaaaaaaagtactgtatatctgaagagtcatcattgaggagctttggagagtccaaacataaagtgtttcaagactcacctaaagggaagtcggggcccagaagcgaaagggtctggccacatgtgcctgctgtcacctttctctttctcagatgttttcatcttgatttaggtgtttctagatctcttcatcagctatctcattaatcttgaatttgttcaacttcctcagtgttcattgcaaatactataatttagaatagcaaggatatttaggacttgtatattttctttaaaagaaaatatacctcactctatcagtacactaaatttagagacgtgttcctttaaatgactggcttattaaaaatgagcagctcttctgaagccagatcagctaccccgaagtgtaagcataattgatgtgtatatttgctgagtgcttagtggaagaagtgacagtgagttctgccacagtgtgtgtcaggtgttgcaggtcttgggtgcctttaatctgctttaggtaccctggtgctaacaactaggatggcgcaccacatcattgtcacgcgcccatgacctcagtgttagaaatctacacagatgtctgggcacggtggctcacacctgtaatcccagcactttgggaggccaaggtgggtggatcacttgaggccaggaattcaagaccagcctggccaacatggtgaaaccccatctctactaaaaatacaaaaaaattagccaggcctggtggtgcatgcctgtaatcccagctactcgggaggctgaggcacgagaatctcttgaacccgggaggcagaggttgcagtgaggcaagatcacgccactgcactccagccttggcgccagagcaagagtcaatctccaaaaaaaaaaaaaaaaaaaaattccagcccggcgcagtggctcccgcctgtaatcccagcactttgggaggccgaggtgggcagatcacctgaggtcgggagtttgagaccagcctgaccagcatggagaaaccccatctctactaaaaatacaaaattagccaggcgtggtggcacatgcctgtaatcccagctacttgggaggctgaggcaggagaatcgcttgaacctgggaggcggagattgcagtgagccgagatcgtgccattggattccagccaatggaatggccaacaggagcgaaactccatctcaaaaaaaatgaaaatccatacagatgcccctgttgcttgtttctgtaagaagcggctgctgcctcatcctggatgaatggagaggtgctcaggaggtgctgtgtcgaggatgtgctgtgtcaaggacctcgcctgtgggaaagcgaggcgcggggctggctttgtgctcacgaacgggtgttctgaaggcagacctgcctgaggggggcctcgagagtttggctggctgtgccatgtggtgcctatgcttggcagtgcctgagcaggtcctgctgccgagcattccacgggcttcttccccagactgcctttgcaccagcctgcagtggtgtggccaggagtgggcttcacgagggctgcttgcctggcccccatcacaccaggctggaactgcagctggtgagggcccccacgctttggctgctgactcttcttgcgcattgggctcaggcctagacctgaggtgaggctctgtgaatgcattggcagcagggcacggacacttacttgtacctctgcctgaggccttgctggaccctgtggagctgagcactcttttgctggtgtctcctgtcccaacagtagtgaggcttgagggtgacagcgtccttcagggcaacagtgtccttctgcaagatgttttttttctttgagttggagtcttgctctgtcgcccaggcggctggagtgcagtggcgcgatctcggctcactgcaagctccgcctggcgggttcatgccattctcctacctcagcctcccgagtagctgggactacaggcgcccgccaccatgaccagctaatttttttttttgtatttttagtagagacggggtttcactctgttagccaggatggtctcgatctcctgacctcgtgatccacccacctcggcctcccagagtgctgggattacaggtgtgagccaccgcgcccggccctgcaagatgttttatgaagagtccattaataaaaaccctgaacccctccgtaaagcagtcatgcaaatgataatattggatttatatttaaaataaacattggcatgttgaaattaatcatctctgtagaatttgcacttacaccttaccgtcttaggttgatattgtttggatgccttaggtcttggattaactgctattcctgggaacacctaacacatggaacagctgagcaaacatggaggaagcccttaatttgcatatataaatgttgtgttactacttaacatgtttaaggaaatgtttaaaaagtagcaagttgtttttttttttaagttcaacttaaattccacaagtctttgaatgttagtaaggaaaagattttttttttgtttttcgttttttttttagacagagtttcgttcttgttgcccaggctggagtgcaatggcacaatctcggctcactgcaacctccacctcctgggttcaagcgattcttctgcctcagcctcctgtgtagctgagattacagacatgtgccaccatgcctggctaattttgtatttttagtagagatggggttcctccatgttggtcaggctggtctcaaactcccgacctcaggtgatccgcccacctcagcctcccaaagtattgggattacaggcatgagccaccatgcccggcctaggaaaagatttttttaaaatactgggctatcaggaggcagaggttgcagtgagctgagattgtgccattacactccagcctgagctacaagagcgaaactccatctcaaaaataaataaatagataaaatactgggttatatttaaatttaatgctttaatacattaaattataattataaggccaggcgcggtggctcacgcctgtaatcccagcactttgggaggccgaggcaggcggatcacgaggacaggagttcgagaccagcctgaccaacatggtgaaaacccatctttactaaaaatataaaaattagctgggcgtggtggcacgtgcctgtaatcccagctactcaggaggctgaggcaggaggatggcttgaacccacgaggcggaggttgcagtgagctgagattgtgccactgccctccagcctgggtgacagagcgagactccatcttaaaaaaaaaaaaaaaaaaaaaaaaaaaaaaatatatatatatatatatatatatatatataaaaaacagataaaacagatgctaatataatccctaaggttagatatagtcaccagtttttttgttgtaaagagatttgatctgtaagacataagccctggaaatcagcagggttacaggaaacccatcatgggctggatctgtatgttgaatgccctgggtaggttctcacagtgcttcaaatgcagcttttggagtggttttcatgtacattttccccattccccattccaaggtaatgtaaatgggaaaaaaagaaaccacacaaagaggatacaggaccctacagaagatgctgaagctgaggacacacccaggaaaagactcaggacggacaagcacagtcttcggaaggtaattgtgttccaggtttgcttgacctgtcagagtgtatgctctgtgactcttggtgccactgtttccctgcatgggagcacacatgagatgcaggtgtcagtgcacccagctccttccaggctggtattcagcagaaggcttgcatttcttacagaaccccattgagaaaggctgcttgcaggttcttaccctccaggggtgttatcacagaaaccgatggtgtgttgctctgcaagaaaacagacatccaaatgctttgagtaatacttgttttttagattggacaaaattgtcactaaaaataacctctttggccgggtgtggtggcttacgtctctaatcccagcactttgggaggccgaggcaggtggattgcttgaggtcaggagttcgagaccagcctggccaagatggtaataccccgtctctactaaaaatacaaaaaattagctgggcatggtggcgtgcacctgtaatcccagctactcaagaggctgaggcaggagaattgcttgaacctgacaggcagaggttgctgtgagctgagatcatgccactgcactccagcctgggcgacacagcaagattctgtctcaaaaaaaaacaaacaaaaaaacccccaaacaccataacctctctatagggcttattattcaggatgtaagtaatgaactggcatcaaagtccattagagatatgtgttacatgtcaataaaaagtcaacagttcattaaaggcaatgaacctagattttatttagtttattagtaattcatgttattgtttactgaatgggaatactaaacaggctgtgcaggaaaagtgcagcatagatacaaagccagccccgggtccttgtgctcctcgcttactgccagcatgtgtccagggacagagtttgcctggtacctgcaggggagtgaaaccaaccaaggaaacaccgggttattctgtctagcgtatggtgcccatgcatgtagaagacgtgagcccttttcctagtgtatgaagtggtgccattcatttcaactgtctcagatgtccggttaactttttcatgaactgagactttaattagactttgtactttgtttgaatttctattttattcgataatagttctggccgggtgtggtagctcacacctgtaatcccagcactttgggaggctgaggcaggtggatcacctgaggtcaggagatcaagaccagtctggccaacatggtgaaaccccatctctactaataatacaaaaattagtcgggtgtggtggtgcatgcctgtaatctcagctactcgggatgaggcaggagaatcacttgaacctgggaggcggaggttgcagtgagctgagattgcgccactgcactccagcctgggtgacagaaggagactccatctcaaaaaaaaaaaaaaaaaaaaaagttctgacagagtagttgtatatttgtgattttgagtaaagcttcatcctgtttttcactgatctgagttaaaatgctctttttatttcaaagaatggaaaatacatctcacatattgctaaggtgtaaatatgtggacaccatatcatttaccttatttctttaaacttgtatttgtagttgagaggagcaggcaggccctgcgccatttttctggcccacagaacattcttctggggcacctgccataggtgaggttgttgagtgatcaagtgttcagcagtaagctaggtcagattcacctgtagtcactaaggtttgtagttaccaggaagcctgcacttaacatttgctctggtcacctaattttttttttttttgagagggagtctcacttcgtcacccaggctggagtgcagtggtgcaatcttcactcactgcaacctccgcctcctcgattcaagtgattctcctgcctcagactcccgagtagctgggattacaggtgcgtgccaccatgtccagctaatttttttgtatttttagtagagatggggtttcaccatgttggccaggctggtctcaaactcctgacctcaagtgatccgcccacctccacctcccaaagtgctgggattacaggtgtgagccactgcggctggccaggttaccttctattaaagcagccctttgctggcaatcatactgaaactggttgttttgaaatatttgtgtaaatgttatacctaaaaaatacatgaccctagacactcagaataccaaaattcacattaagtggctagtaatgttttattagctcctatctcaggagatagcacatgataaaaagaagtaatggtgtcttgtctcttcagatttgggttttataaacctgagccaaaccacatatgacacccaatgtgcactgagcacttctgacatgctaggcactgtcccaagtgcattctcctgtcgccttgtccatgatcctctggattccacctcaccgcatcctgtctcactggctctggttccaggcaggtgggtgagatggagtatgagtgcaggagtggcaagtcattccctgggcagcgctgctctagtgctatggggacaggacagttttcagccacacctttcagaatctcagcccttgagaaaagcttcatgatcccttctcccatttcttgcttttctcagttgtgacatgttttactgatgatctttgttcattaggtgtatctggtgtttgtctaaaaattggaaatcctcagtatagtgatactagtaatgttggtcctgacttagcagggctgagtctaacttgattgggcacctcttgaatggaaggatccatttttctcatgttcatcctctgctttgggttcagtggagagtctaggtgcatgttcaataagactcgtatcaggtgtcttaaccacatgactgcagcgggtcttggcgtggccccacccacctcgccctcctgacagatgcgagagcgggaggtgcgaagaaagaatcagtccagattgtgaaaaaagtctgagattgggcaaccatggatgacttatgtgtggaacacatttccaaaggaagaagtttctgccacgaaacttttcagcaacctgtgttcattcacatgaggagattttttttcctttcttttccttttgttgttctttttctttttttttcctttttttcttttcttttttttttctttctttttttttttttttttttttttttaaataatagagagacacaatcactgacaaaacggccagaacaagctcttacaaggccatggaggcagcctcctcgctcaagagccaggcaggtaatgtggtcagcgccctttccttcttggcttctgggtgcccaggctgggctgggtgggtgggctgagagtgtgaaaggggaaggctggggctggtgaaggggaacagggcaggggaggaatccacaattaagctaggagtgaaaaagaaggaaaggaggttctcctgtggttgaaaactaaactgttttaatgtgtatgttattttgaagggtttggctaaattttattgaagttactttttacttggctctattatttgcaatttaaaattttactagaaaagtgatttcaaccagaagttttcaggtttcttacttgatggtgccagttgctactgtaaattctgtcacccttcagtaccctgaccctctgcatgtaagctaacagtaagggctcgttatttatatttcacatgctaaagaaactagcttaaaacctttatgaaaaataattgtcaaaaaaataagaggggaaattacacttccttttaccttttagttatctttttgaaatacctgtttgatcccttattgaagaagtcataccttctccaactcttaattaaaaggaaaacaaaaccctggggaggagagtggcaatggctctgtttttcttgttttgcatgaggtgcttgactggcttttaaaaatcagttaaacagactttaaaaaaaaaaaaagacatgagcaattggacatttgaacgctagctgatgatataagagcattgttacttttaagtgtgggagtagcattgtggttatatgtaagactttatgtttagagatttgtgctaaacttcttatggatgaaatgatatgtctgggatttgcttcagaataatctggcagggggacgtggaaccaggtatggatagagccacgctggccccaggttgatgtttttgggggccaagtagcgaggacatggggttcattgtacagtttgtctgcttttgtttatgttcagatttttccatgatagaaagttaagccagaaggacaaaggaattcagaagattcatctttagaacttcacttatttgaggggtaatttttaagcagtaaaaagatcaagggtttatgatttgaaactttacaaaccaaaattattttacagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactaga

SEQ ID NO: 17528 - DNA, 30250 bp, Human
cactgtatacagaaaagtgctgcgtatcctacagaaagctacagacagttgggggtcagaatcattcggattgtttcaagtttggggctattataaataaagctgctataaacgtttgcacacaggtttctgtgaacaaaaattttcatttcaaccaactaatgtttacggttcaatcatgatttcacaacttgaagtaactttcactcttctcatactaaatttgatatgtcgtccactgttaaactatttcttaccctcagattataattattaaacttttttttttttttttgagagggagttttgctcttgtggcccaggctggagtgcaatggcaaaatctcggctcaccgcagactccgcctcccgggttcaagccattctcctgcctcagcctcccgagtagctgggcttacaggcaagccatgcgccaccaagcccggctagttttgtatttttagtagagacgaggtttctccatgctggccaggctggtctcgaactcccgacctcaggtgatccgcccgccttggcctcccaaagtgctgggattacaggcgtgagccaccgtgaccggcctaatcattaaacttctttcagcactagccccactgatgtcacaacttcacccattagtcaataacttgtctttgctgaattcgacacttttgaatcatttaaaaaatattctcttaaattttatgtgctatttgcaatgtaacggttgtcgacatgacagttttaagtttaatctttatcatcaacattttctctatcactttcttcagtttaagcaatcaacaaaaccaccgctccagcactgatttgtagcatttgcgggtttcccccgtgtgacttccgcaggactgccaagttcaagccgccagggccagggcactgctagcagctgggctgagccctgttctcccggcgttcccaccgcccagtggcaatagctgtgaacggcggcaggagcatggcagtggaacaataaggaaaagatcttttaaaaaaaagatataatacagaagccaagcaaggcggccccgacctgtaaccccagcactctgggaggcagaggcgggcgggcggatcgcttgagcccaggagtttgagaccagcctggccaacataggaaggcctcgtcaaaaagacaaaagggtaaaacgaatttaataaaatgaagtttaacttttactcatgtttgtatctaatgacaagcttttaaaactgaaaagttcactactggctcctgcctggcggctccagcccgactgggggccggggcctccctgcactgtggggtcacgagtgcccctggacagctcccgagcgccctccgacccgcatgctcagcgcagccccgtcggcggcgcgccacgggcagagcgggctcagcgggggacggaagctcagcgctgcgaccgggatcccgcaggctcgctccgcagggccgcggctcctctccgtgcaggtgctgggcccgcgggggcggggcgtccacacggtccgcgccgagacccaagcggggaaaaagcgaagagcggacagcggggcaggtgccacagggagcctccgccccaccgcgcgagcagcaagtctgcggcgcttgacacctgcactgcgaatgccaggccgcagcccgggctcccaagacgcgaatacgcgcgcctgctcgtgacgtcattttttgcggtcttcccgagagccagcagagggcgccgccatgatgttttacggaagccgatagtccttgctcagcggcaccccgtccttccggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgaggtaaggcaggcgtggcgccccgcggcccccagattcccaaccttcccacctccgacccgcacacccaactccggaccctcctcgctccctcccccaaccttcccatcccccttcagactgttaacccccccggcccgccctcacgccccctcctcgctcctccgaatacctccctccagtcctcacctccccctgggtcctcatcccccgcctcgatcctcatctcccacctcggttctcatccccaccgtgggtcttcaggaccccccgcccctcctcgccccctgggaatcccccactagggtcctcacctccctacttttcgtcctcacccctacccaagttttcacctcccctgggatcctcaatctcctccccgccgggccccgggttctcgctacgacccccaggtcctcactcccctccctgggcccccgggtactcatccccacccgcccccgcctcccccgccttcggtcctcaccaccctaatcccccaccgtgccgaagcgaccgactcttggagcgggggtgcgccggccccagcggggtctcccatcggggtttcccgtcggggacgcagccctggtgacctgggcgagggcggggatcccgagagaaacccccgcgtgaggaaggggcggcctgggctcggtagctccagtgtccgctgactggattttcttgttctcacctcgcaaagaccccggccgtccggagcgctctgtgtccgttttactcttttctacacgccgttttgcgtcattccaataagtgggtgtgtgaggtttgttttcttttttcctaaactttatattgtatcgctttccgtgcgaaataaaccgagtagttttgcagactattgaagccccatggttgtttaaacgttcctggctactgatgtattattagctattataggttgtaattgcttttgattgagatatgacatgtatggaaaagtgcatttttgttcagtttaacgaataataatagcatcgcgagccactcctgtgatccttacacaggtggagaagtagaaccatgcctgttccttggaagcctcccactggtaatcacggccttcttcctttccccttcctcattttggaaaggtaatcatttctgtgccatctccccggtgtgagcaattatttatgcacccctaaatggcacagcttggttgccggatttggagttagtgtgatggtatcatagtgtattttgtgtgtggcgtgcatgtgtctttttggtcgacgccgtgacagtttcatccacgttgcagctgactgcagtttaattttcactgctgcgtggtattcctgtctgtgagcacgaggcactttatccattctgccacagtgacacgcttagcttttgtgctcttgtaaatcatcccgttactacattacggtcatatgttcaggtgtttggaatcttggatttctctagggtataacatctaggagtggaattgtgaggatcataggatcatgccaaattatttttcagagtgttttgtttttgtgtttgtgttttgtttgagacagggtctggcgctgtcaaccaggctggagtgcagtggcaccatcgtgactcactgcagccttgacctcctcacctcagatcttcccatctcagcctcctgagtagctgggactacagggtttcaccatgctgcccaggctggtcttgaactcctgacctcaagcaatctgcttgcctcagcctcctgaagggctgggattacaggtgtgagccatggcactcggcctgctgtttggttttctgctttgagaattgtatattcaaatctgcttttaaattctcttttttcccattgttttgtaagagtgtcttttttattatttattataaatgctagatatcagtcctttttcagttacaaatatctcccagttgtcctttgactttgacttagcttcctggaatccttttttttttttttttttttttttttgagacagcgtctcactctgtcacccaggctagagtctagtggtataatcatagctcactttaaccttgaactcctgggcttaagcagtcctccctcctaaacctctgtagtagctgggactgatgcgctgccaccacgcctggctaatttttgtgcatgtgtatggagatgggggtcttactgtattgcccaggctggtcttgaactcctagcctcaagtgatcctcctgccttggcctcccatagtgttgggattacaggtgtgatctgtgcgcccagcctttcctggaatcatggagaaaaagctcctagttttaacatagatggtgtattcatccgcccactatcattggtgcctattgtgtctccccgagggacatgcccggaacactccctgggttatcttggcgtagctgtacagttttacctttcgcacttgaatcttcagtctgcgtggaattgatgattgtgtgaagcagggagtctaattttccacatggatgtgcaattagtccagcacccaacgttgattgaaatgactgtccttttccattgatctgcactgcagcttctgctgtggatgtgtttctgggctgtgctctgttcttttggtcatttacatatcgatgtgctaataacccactaagtcggttcttgtcactttatttataagccttgttagcggacggagcaaaccctcccactgtatctttctccgggatcatctatggctattcttgtcccttcacacttccacatgtatcttatatacttacttcttaaacacgtagagcctgcctgctgggattttaaggctgagctgaacttgcagttcattctggggtgctgtcctctttatattgcatcctataatttgtgggtgtgggcttatctatttagatgttctttgtgatctctgtaggggtcttccatctcatatattaccacctatttcatatttttccatgccgttgtaaatggtatctgttaaagtcttagtttttacttgttgctggtatatagaaatgcgttgatttttgtttttgtttgtttgtttgtttgtttgttttttagacggagatctcactctctcacccaggctggagagcagtggcgcgatctcagctcactgcaacctcctcctcctgagctcaggtgattctcctaccttagcttcccgagtaactgggattacaggcatgcaccaccacacctggctaatttttgtatttttagtagagatggggtttcaccatgttggccaggctgctctcgaactcctgacctcaggtgagccactatgcccagcctgatttttggataatgaatttgtgactagtatctgtgctaaagttttgctagttgcaaaattttttttttctatagaatctccttgatttttctgtgcacttcatattatttttctttctccaattaccttttgttttttttctcgtctcactggactggctaggaccctccagctcattgtcttacctccgatcacacagggagaactcggaatgttttgccagtgagcattatgtttcctgttgtctttaataaataccctttatctagttaaggaaattctcttcttagaagacttgtaaaaaaaatcttttaatcatgaatttttttaaaatagctttattggctgggtgcagtagctcacacctgtaatcccagcactttgggaggccgaggcgggcggatcacgaggccaggagatcgagaccatcctggctaacatggtgaaaccccgtctctaaagaaaaaatacaaaaaaattagccgggcatggtggcaggcgcctgtagtcccagctactagggaggctgaagcagaagaatgctgtgaacccaggaggcagagcttgcagtgagctgagatcgcgccactgcactccagcctgggcgacagcaagactctgtctccaaaaaaaaaaaaaaagctttattaaaatataatgtatagctgggtgcagtagctcatgcctgtaatctcagcactttgggaggccaagatgggcggattgcttgaacccaggcattcgagatcagcctgagcaatatggtgaaaccctgtctccataaaaaatataaaaattagccaggggtggcggcacatggctgtggtcccagctacttgggaggctgtggcgagaggatcacttgagcctgggaggttgaggatgcggcgagccatgattgcatcactgcactctagcctggccgacagaatgagaccctgtctcaaaagaaaaaagatattattttatgtaccatataattatgccaggtagttcaccatttaaaatgtacacttcagtagtttttagtatatttacaggtttgatggtcatgctagtcaattttcaaacattttcatcatcccccaaataaatcctacactcattagcatttgcccagtcctcttcctccccactcctaggtgactagtaatctactttttgcttctatagatttgtctattcaggatattttatataaatagaatcatacatctggtcttttgtgcctgacttctttcacttaatgtaatgttttcttttttcttcttcttctttttttttcttttttttgaaacagagtcttgccctgtcgccaggctggagtgcagtggcgcgatctcggctcaccacaacctgcgcctcccaggttcaagggattctcctgcctcagcctcccgagtagctgggactagagacacgcgccaccatgcccagctaattagctaatttttgtatttttagtggagacggggtttcaccgtgttggccaggatggtctccatctcttgaccttgtgatccacctgccttggcctcccaaagtgctgggattacaggcatgagccactgctcccggcctttatttcttctttaaaaaaaaaaaaaaaaaaggatgcatatgcagaacatgcagatttgttacataggtatacgtgtgccatggtttgctgcacctattgacccgtcctttaagttccctcccctcactcccacccctattaggccctggtgtgtgttgttcccctctctgtgtgcatgtgttctcagtgttcaactacctgccacttatgagtgagaacatgcaatgtttggttttctgttcctttgttagtttgctgaggatgatggcttccagcttcatccatgtccctgcaaaggacaggatctcattcctttttatggctgcgtagtattccatggtgtatatgtatcacattttctttatccagtccatcattgatgggcatttgggttggttccatgtccttgctattctaagcagtgctgcagtaaacatacctgtacgtgtgtctttatagcagaatgatttatattcctttgggtatatatccagtaacaggattgctgggtcaaatggtatttctggtgttagatccttgaggaatcgccatgctgtcttccacaatggttgaactaatttacactcccagcaaaagtgtaaaagccttcctatttctccacagcctcgctagcatctattgtttcctgactttttagtaatcacccttctgactggcgtgagatggtatctcattgtggttttgatttgcatttctctgatgatcagtgacgtagagcttttcttcatgtttattggcctcataaatgtcttcttttgagaggtatctgttcacctcctttgcccactttttgatggggttgtttttctcttacaaatatgtttaagttccttgtaaatgctggatattagccctttgtcagatgagtagattgcaaaaattttctcccattctgtaggttgcctcttcactctgatgatagtttcttttgctgagcagaagctctttagtttaattagatcccatttgtcaattttggcttttgttgctattgcttttggcatttttgtcatgaagttgttggccgtgactgtgtcctgaatggtattgcctaggttttcttctaggatttttatggttttgggttttacatttaagtttttaatgcatcttgagttaatttttgtatgaggtgtaaggaagaggtccagtttcagttttctacatatggctagccagttttcccagcaccatttactgaatagaagatcctttccccatcgcttgtttttgtcaggtttgtcaaagatcagatgctggtagatgtgtggtgttatttctgaggtccctgttcttctccattggtctgtaggtctgttgtggtaccagtaccatgctgttttggttactgtagccttgtaagtgtagtttgaagtcaggtagcgtgatgcctccagctttgttctttttgcttaggattgtcttggctatatgggatcttctttgattccatatgaaatttaaaatagttttttctaattctgtgaagaatgtcaatggtagtttgttgggaatagcattgaatctgtaagttactttgagcagtatggccattttcatgatactgattcttcctatccacgaggatggaatgcttttccatttgtttgtgtactctcttattttctgttttttctttttttttctgagatggagtctcgctttgtcgcccaggctggagtgcagtggcgcgatcttggctcattgcaagctccgcctcccgggttcacgccattctcctgcgtcagcctccctagtagctgggactacaggcgcccgccaccatgcctggctaattttttgtatttttagtagagacagggtttcaccgtgttagccaggatggtctcgatctcctgacctcatgatccgtccgcctcggcctcccaaagtgctaggattacaggcatgagccaccgtgcctggcctttttttttttcttttgagacagagtctcgctctgtcggccaggctggagtgcagtggcacgatctcggctcactgcaacctccgcctcccttgctcaagcagttctcctgcctcagcctcccgagtagctgggattacaggcttgtgccaccacgcccggctaatttgtgtatttttagtagagatggggtttaaccacgttggccaggctggtctcaaactcctgacctcaggtaatctgcctgcctcagcctcccaaagtgctgggattacaggcgtgagccactgcacccggcccctctcttattttcttcaacagtggtttgtagttctctttgaagaggtccttcacatcccttgttagctgtattcctaggtattttattctctagtgattttgaatgggagttcattcatgatttggctctctgcttgcctattaaaatcacattgattttgtattctcggactttgctgaagttgcttatcagttcaacaagtttttgggctgagttgatggggttttctaaatataaaatcatgtcatctgcaaacagagacaacttgacttcctctcttcctatttgaatactctttatttctttctcttgcctaattgccctggccagaacttccaatactatgttgaataggagtggtgagagaggacatccttattatcttgtaccagttttcaaagagaatgcttccagcttttgcccattcaatatggtattcgctgtgggtttgtcttaaataactcttaatattttgagatacgttccattaatacctagcttattgagagtttttaacatgcagggatgttgaattttatcaaaggccttttctgcatctgttgagatgatcatgtggtttttgtctttggttctgtttatgtgatagattatgcttgttgatttgcgtatgttgaaccagccttgcatcccagggatgaagccacttgatcgtggtggataagctttttgatgtgctgctggattcggtttgccagtattttattgaggattttcacattgatgttcatcagggatgttggcctgaagttttcttttttgttgtctcttcccagttttggtatcaggatgatgttggcctcataaaatgagttagggaggagtccctccttttcaattgtttggaatagtttcagaaggaatggtgccagctcctctttgtatttctggtggaattcagctgtgagtccgtctggtcctgggcttcttttggttggtaggttgttactgcctcattttcagagcttgttattggtctagtcagggattcgacttcttcctggtttagtcttgggagggtgtatgcacccaggaatttatccatttcttctagattttctagtttatttgtgtagaggtgtttatagtattctctgatggtagtttgtatttctgtggggtcagttgtgatagcatctttattattatcattattattatttggtgtctatttgattcttctctctcttctttattagtctagctagcattctgtctattttgttaattttttcacaaaaccagctcctggatttgttgatattttttgggggggagggtttttcgtgtctctatgtcctttaattcttgtctgatcttagttatttcttgttttctgttagctttggggttagtttgctctcttgcctctctgggtcttttaattgtgatgttaattacatctctgggtcttttaattgagatctttctagctttctgatatgggcatttaatgctataaatttccctcttaacactgctttagctgtgtcccagagattctgctacattgtctctttgttctcattggtttcaaagaaattcttgatttctgccttaatttcattatttgtccaggagtcattcaggagcaggttgttcaatttccatgaaattgtgtggttttgagtgagtttcttaatcttgagttctaatttgcactgtggtctgagagactgttatgatttcagttcttttgcatttgctgacttccagttaattacatggtcgattttagagtaagtgccacgtagcactgagaagaatgtatattctgttgatttgaggtagagagttctgtagatgtctactaggtccacttgatccagagttgagttcaaatcctgaatatccttgttagttttctgtctcgttgatctaatattgacagtggggtgttaaagtctccccctattattgtgtgggagtctaagtctcgttgtaggtctgtaggaacttgttttatgaatctgggtgctcctgtattgggtgcatatatatttaggatagttagctcttgtcgaattgttccctttaccattgtgtaatacccttcttgtcttctttgatctttgttggtttaaagtctgttttgtcagaaactaggattgcaacccctgtctttttgtttgctttccatttgcttgaagtttcctccatcccgttattctgagcctgtgtgtgtctttgcgtgtaagatgagtcttctgcatacagcacaccaatgggtcttgactccttatccaatttgccagtctgtgtcttttaattggggcattcagcccatttacattgaaggttaatattgttatgtgtgaattcggtcctgtaatcatgatggtatctggttattttgcacactagatgcagtttctttgtaatgtcattggtctctatattttggtgtgttttttcagtggctcgtactggtttttctttccatatttagtgcttctttccagagttcttccggggcggggctggtggtaacaaaatccctcagcatttgcttgtctgaaaaagattttatttctccttcacttatgaagcttagtttggctggatattaaattctgggttgaaaattcttttctttaagaatgttgaatattggcccccaaactcttctggcttgtagagtttctgcagaggtctgccattagttagtctgatgggcttccctttgtaggtgacctggcctttctctctggctgctctgaacagtttttccttcatttcgaccttggagaatttgatgattatgtgtcttggggttgatcttctcatggagtgtcttagtggggttctctgtatttcccaaatttgcatgttggcctgtctctaggttgaggaagttctggataatatccttaagtgtgttttccagcttgtttccattctccccgtctccttctggtactccagtcagtagtaggtttggtctttttatgaaatcccgtgttttttggaggctttgttcgttccttttcattcttttctctctattgttgtctgcatgtcttatttcagtaaggtggtgttcaaactctgatatcctttgttccgctttgtggattcggctgttaatacttgcggatgactcatgaggttctggtgctgtgtttttcagcttcatcaggtcatttatgttcctctctaaaccggttattctagttagcaattcctctgaccttttatcaaggttcttagcttctttgcattgggatagaacatgctcctttagttcatcattgtttttttttttattacccatcttctgaagcctacttctgtcagctcgtccatccaatcctccgtctagttctgcgccctttttggagagacattgtgatcatttggaggagaagaggcactctggcctttggggttttcagcattttttcgttgattctttctcatcttcgtgagtttgtctagtttcagtctttgaggctgctgacccttggatgggggcttttgttgtggttgttgttgttgttgttgatgctgttgtcgttttctgctcgtttgttttccttgccgtagtcatgtccctcttctgtagggctgctgcagtttgctgggggttcacttcaggccatattcatctgattcactcccatgcctggaggtgtcactaaaggaggctgcagaacagcaaagatgggtgcctgctccttcttctgggacctctgatctcgaggggcaccaacctgatgccagtagggtcactgctgtatagggtgtctgacaacccctgttggagggtctcacctagttgggtgacatagggagcaggacccatttaatgaagcactttgtcccatgatggagggagtgtgcttcagtggggggaaaccacttgtctgggctgcccaggttattctatatttaacattttgagaaattgccaaactattttccatagtggctacaccatcttactttctccatagtgattttcgagtgttcagtctctcacatccttgccaacatttgttatctttttgatatagcgatcctagtgggtgtgagcacaaaggaactttaaattttatcaaatgcttaaatatctattgacatgtaattcaccacattaacaaaatagctttaattataaaccaaccttgcattcctgcggtaaacctaaattggtcattttatgttgttagattatatcatcctgatgttttgtataggaattttgtactatatctttgttcttgggtgagattgacctgtagttttacttacccagactgtctttgttggattttggtattggggttatgctacccttaaaaaaggatttgtaatgtatctggtcttttctttttctttggaaagtttgtttactaatggagtgatttcttcctaaatatttggtagaacttggtaatgaagccttctggacctgaaatttactttgtgggaggatttttcagtattgatttttgtttttatgggttttgttttttttgtttgttttaatgcatagtgtcactgtcactcaggctggagtggcagtgatgtgatcataactcactgtaaccttaaactcctaagctcaagtgatctcctgcctcaccttcctgagcagctaagactgcaggcatgcaccaccatacctgcctacttttctttttttttaaattttttgtagagagagtgtctcaaatacccttctgtcatcgaggctggagtgcaatggtgcaatcttggctcactgcaacctccaccttccagactcaagtgattatcgtgcctcagccttctgagtagctgggatcacaggcgtgtgccaccattcccggctaatttttgtatttttagtagagacaggtttttgccacgttggccagtctggtctcaagctcctgacctcaagtgatccacatgccttggttgaccaaattgctgggattacaggcatgagccaatatgaccagctcaaacatcttctttttaaatgtcagaagcatgtatagtgattatttcttattttttcccccttgatccatctcaccagatgtttgttgattttataagaattttcaaactaccagcttctggctttgttgaacttggatttctgtttcactaattttctttctcctgtctttgtacttactttgttgctctttttctaagttttaaagatggatgccaatctcaggcttcttttcgtgtgtgtatgtgcgtatgtccataaattctcttctaattacagtgtaagccgcatcccacaagttttgatagtcacagaactgtatcgtcacactattttttaatttcagtaagttcttcactgatccctgtgtaatttagaaatgtttcataatttccctacattggaggggaagatagttttgtttttattattaatttctagctgtattgagctcttgtcagagaatatggtttattttagtcgtttgaaatttaagatctgcttaatggcaaaatgtatggtcagtttttgtaaatgttgccagtaagcttgcgaatcatatgtactctagttttgaaatccattgctcagtggatgttcattaggccaatttgtataatcatgttgtacaaatctattctattcttaactgttttttgttttaaaggtgtggggtcttactatgttgcccgggctggactcaaattcctcagcctcccaagtatctagaactacaggcacgtgcagcttggtttaaaaaaaaaaaaaaaaatcagtgagaagaggatttgttgatctccccgttaggattatgggtttgtctgttcctccttctcagcttatgctgtatatattttggggctgtgttattaggtgcatccaagtgtatagttgttatagttaccatgtgagctcaaccttggatctttacatagagattctctgtatttagtaatgttttgttcttaaaatctgcttccatctaacattaatataaatgtaccagctttattttatatgtatgtttcttggactttgtctttatgtattacaagaaattgtgataaagacctcatttaactggattgtgaaaggactaggccattctgggtcatttacttttctgaaaaatatttttattttcttggtatttaaaaaaaggtttataagacattctaatttatcttagttttcttccttcatttatttaggggtctggtatcttagggatatcattctgaaaattaaacttttctacataggaccatagatacagggtgactagatgactgggctggatgtgttccacagtgtatcagtcagggttctccagagaaacagaaccaagagggtatatagacacatacatgcacacacaccaggagagccagtgatgtaagccctgagactcaagacccaggaagagctgatgtttcagccagagtctgaaggctggaaaagaccaatcttccagctcaaacaggcaggagttccccttactcagcatttttgttctgctttggttttcagttgattggatgagacccactcagcagtagggagggccctcgcctcactcagtacaattcagatgttagtcttatgtagaaacatcctcacagacacacctggaatcatgagggactaactgtccaggtgccccatggcccagtcaagttgacacataaggttaaccttatgcatggcatctgctacaacttgtgtttctgaatgaaattctacaaccagttcactggttttgtaatgtgtctttttatttttaatttttttttttttttttgagacggagtctcactctgttgcccaggctggggcacgcaatctcggctcactgcaagctccacctcccgggttcacgccattctcctgcctcagcctcccaagtagctgggactacaggtgcccaccaccacgcccgcctaattttttgtatttttagtagaggcagggtttcactgtgttagccaggatggtctcaatctcctgaccttgtgatccgcccacctcagcctcccaaaatgctaggattacaggtgtgagccaccatgcccggcttttttttttttgacagactcttgctctgttgcccaggctggagtacagtggcgccatcttggctcaccagaatctctgcctcccaagttcaagcaattctcctgcctcaccttccccagtagctgggattacaggagtgcaccaccatgcctggctaatttttgtattttcagtagagatggggtttcgccatgttggacaggctgatctcgaactcctgacctcaagtgatccacccgccctagcctcccagagtgctgggattacagacgtgagccaccgtgcccagccaatttttaatttttttaagaaatgaaatcttgctctgttgctcaggctggagtggagtagtgccatctttgttcactgcagccttgaacccctgggctcaagtgatcctcctgcctcagcctcccgagtagctggaaccacaggcgtgagccactatacccggccctattcctctgaaaagcttagtaaacagcagttctttataccagggaagaggaagagacattttaatgatgtgatagtttattcagtgaagagtacagaaatgagttagggcccctgctctctaagaattacagaccttacaaggtaggcctgggccgggcgtggtggtggcgcctggattcccagcactgtgggagcatgaggcaggagaatcgctggacctgggaaggcggaggttgcagtgagccgagatcctgccattgcactccagcccgggcgacgacaacagcgagactctgtctcaaaaaaaaaaaaaaaaaaaggcccaggggagctcgttcccaccttccaccagcaaaaggcaccttccatgaagctggaaggggcccccaccaggcggggaatccaccagcgccttaattgatcttggattcccacctccagaaccgtgagaagtaaatttctgttgtgtgtaagccaagcattttcttttttctttctttcttttctttttctttctttctttcttttttttttttgagatggagtttcgctcttgttgcccaggttggagtgcaatggtgcgatctcagctcacgcaacctccgcctcctgggttcaagcgattcccctgcctcagcctcccaagtagctgggattacaggaatgcgctaccacgcccggctaattttgtatttttagtagagacagggtttccccatgtgggtcagtctggtccccaactcctgacctcgtgagccgcccgcctctgccggccgaagtgcggggtctacagacatgagctaccgcgcccgggaaagccaagcgttttcctacaagaagccccagtagagcgagccaggcttcaacatgcgcgttctggagagaaaacattgactccacaacagtggtcctttttgttttaaattaacatccccgactttttttatccttaccatttttataaaatgccgcgcgcttgcctcttggcaggcgtagggtttccctggggctgctgtggagaggccgcactggctggaaacagccgggctgtgcggctgccagaggcagcgtgtgcgcagcgcttcctgcagccacgtagcatcttctgccgcatcgcgcactcagctcgggcgggcgtcgggagtgagggcccggggcgcagggtcagcggccggggcgacaccctccctggttgcccaaggaacagaaggggctgggccacgcggggggttcttgactcctgagggcagctgggtgtcctgcagggcagatgcagaggggcttggcagcaggcaggctcccctggcacgacctctgatctctgcccttcgagccaacttccctcagggcaggaagcccatgaggacagtgagggaagcgctggaaggtcctcccactcagaggccaccaggaggcggcgctcgcggggacgtgatggccgcagccctcgtaggacgggtctctggcgcctgacgcagggagtgggtgtcaggaaggcctggggctggggtttcagccccggcgtctggacagggcagggcgctgttgttcacccccagcgccagccagcccagctgtctcacactgtgagcagcccagtgggcgcatggcagaggcacaggcacgccatggcctggctctctgcgtttcctcgtgggagggggtttatgtggccgaagcaggccctggtgtggatggatctggcctcccaggtattgagggagcacggggtgcgcctgcttcctccacgcacgtcgcccatggcctccccaaggccctggcctcactccagatcccggggccacctccaggctccacgagcgccaactcccagcgccgtccagacccagaggcagccgtccctgcctagatggtgactaggcaccagctcagctgtcacgggtgctgccccaggtcccaggccccaccccctgctgcccaggcacacacccccgcggcaggtgactccaccctgctcctgcgctctgctgtgccgggcacctgcctgctctacgcccctcatccccaggatttcccacccgcaggctttctgcgggagcagtggtggccccggcttctcacccttcaggttttcttgcatctgcgcaccggtggaagagtaggcccagtggactgggtgctgctgggaggtgggaggctgctgggagggcaccggatgccggggccttgcaacctggcagaggctgtgctgctcagggaagcaaggtggccctggggtgaggcggggggctcagaggaaggggagccctcaggaggaagtgttgggggcaactgccagagagcccggccactgcccagtgcccatccggaagctcagcagggagtgggcttggaagtgggcaggggcatggtggcgccggcagcatcctattttgcagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaagggtatgttgtgctgctttaattcatgttgggtggagggaaatggatctttcttgaaaaatttttttctgaaatgaatttgatttttagacctttacgtttttccgtgtgtcctggtccctagaatattaactgtatatgcaccatcctcccccgtaagctgctgcctggcttttgccatctttgaaaacaaactccaaacagcccacaggccccatcctcactgctgcggtgtcagtgggaggctgtgtcacgccactcgccgtctctctctggtcggctccgtgagggtaggggctctgcccattcaggtggtatctgtagatcctaggttctagggcccagagcattccctggcccagagtacatgctcagaaatgcatgttgaaaatatcaacgatttagttgtttaaatgtgaactgaaagtcacttagaaaatattcacaaggctgggctccgtggctcactcctgtaaccccagcactttgggaggctgagatggccagattgcttgagcccaggagttcgagaccagcctgggaaacatagcaagaacccatttgtacaaaaaataaaaattaggtgggcgtgatggcacatgcctgtcctcccaggtacttgggaggctgagtcaggaggatcacttgagcctgggaggccaaggctgcagtgagccatgatcgcgccactgcactccagcctgggtaacagggtgagaatgtatctcttaaaagaaacaactatttgtagatggatttgaagaacatgtcttgatgggatgcttgatgcttgtgcttttctgagtttctctcctgctttggacaattggaactggctcctcagagcccaaacgttgtgccccagctccttcaagggcagcacccagagagacagggttgtgggatggagacatcgaggctgcacactcctgcaggggccctgctggccacccccctgcaagtggcacctctccccacctgtgaggtcacacacaccacacagatgcctctggagcagtggtctggacaggtccaccccaccccacccgttcgtgtctcaggagtgtcccgcgggcaggaaggctgaggccggtgaactctcatgtgcctgcctgtgctttttctccaggtggggcacgtagccagttcaggtgggaggtcgcctgtccctcgtggggcagtttctgggatctgaaccgtgggtgagcacacaggctgaggaaatggatgtgggcagtttggatgagggccagggttccaggagagaccaccagcctggctaccctcggggacgggaagagagaagccacagatcgggggtccttcttacgtgggggtgggatctgttaacatttcatgttctacaagtgtctggagccctccaggaatcactgtatctatgtccgcctgtggttcttggtgtccgcggtgccagaggtttccagtttacagccctctcaaggcatgcccgcctctcaggcattcctgttctgcaaatgctcctgggtgttcctgctggagccgtggggagtcagtctcgaggacctcaggggacagccgaagctcccatgacctaaccctaactgaggagggtgtggggctgggcagccgccagctcctctcagccgggaggtctgcggcctgggcgcccctaacttcatgtggttcttaccggcagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtgtgagtggccgcggccgccatcgggcattgtctttgtagtttccagtcataggtttcttaggttctaaggtaccaagactgccccttcaaggtggcgttctgggccaggcatggtggctcacacctgttgggaggctggggcaggtgggtcgtttgagcccaggagtttgagaccagccaagaaaccccatctctaccaaaagtaccaaaacattagccgggcatggtggtgcgtgcctgtgctcccagctactcggaaggctgaggtaggaggatcacctgagcccacgaggttgaggctgcagtgagctgtgatcacaccactacactccagcctgggagagagtgagaccctgtctcaagaaaaagaagataaagttctgcataaagttttttgttagaagtttatcactatattaaactttatgttctgaaaacatgctttaaaaacttcagaatttaggctgggcatggtggctcacacctgtaaacccagcactttgggaggctgaggccagcagatcacctgaggtcaggagatcgagaccagcctggcccacatggtgaaaccccgtctctactaaaaatacaaaaattagctggctgtggtggtgcatgcctgtaatcccagttgcttgggaggctgaggcaagagaatcacttgaacctgggaggcggaggttgcagtgagccaagattgccccactgcactccagcctgggcaacaagagcgaaacaacatctcaaaaaaaaaaaaaaaacccaccaacttcagaattttaggtgaaggcatctctaatctctgtgaccaaatgaactctgtgccagctgagtcacgctgttgggcacggtgggtgccagggtgaatggctggaggggcacgttccttactctcacgttgctgccttctggagtggcgggtgatctcaattccacttgaaagatatttaatcatttcagttaacgttttcccaaagcacgacaaagatttcaataacatcgttttattttgaatggttatggaattaatatttataatgtacatcaataccccgtttccagagaatccaaataaaaggctgacagcagctgtgcatggatcttggctggaacgggcagcagccagggcccagcgctgtccgggaggctccgtgcagccccgggcccactgggtagcccaggaaggactctgctggccccttgggccccaccccctttggaggccagcagtggccacagggtctgctttgggcactcggtgtcccctgacccttcagccacactgaaccaagtcaggaatatctcttcgtttgtttcttcctcatatttttgtatctagaccgtgcctgctgaccctcagcgaggacggtgctaccactgggccagggggaggcccgggtcgatggagagggctcatgaggtccctcagctcctcctcggctgcctcccccctgccatggggtcctgggaggtgcagccacagccacccagctcccgaaacttgctcacctgagtgagtttctgactcgttgtaaagtgcgagctggtgtcaggcccggctcggaacagctgctcatttagagagaatgcagcgttcacggctcaggccgtcggatgaatccacttgacagagatgtttttacaagggccaagggctctcgctctgaggatccctgacatatgtgacctcttccttccagccacggagaccgcccagcagttgaagcggagcgccggggtgcccttccacgccaagggccgggggctgctgcggaagatggacaccaccagtaaggcccccaccctggtgccgtgagccttgcttttggggcagagctaagggcttcacctggagacccgctccctgttggggaggtggtgcctgtgaatggtcttcaggcagcagtgttgggagcccgtgggaaagcgaaggcactggggcaatttcaccggcttctccccttggggagctcccctgggaggatgtgtgggcacggagacaggagggccgggatctgaggacagtgctgggcacggagacaggaaggccgggatctgaggacaccgctgggcatggagacaggaaggccgggatctgaggacagtgctggcccctgctcctctgctgttggcaccggtggctctcggccttcccagctcgggctttcggccccaagtgctgctcttgggttccgagtgtccctgggcggctccgcggggaggacgtgaccgtgctcagctgcccgtggggctgtgccccccgcacccctccatctgcccttcctgatttgtgctctcagggctgggcgtgagcttaagcaggatgcaccctgatcacaggaagacggcgtgcccctgggaaccatggcagggcatactcaccccagagggtgctggatagtgacctgggggccagagggcaggacgggtgtcgtcctgtgctgagacagctgggtaaacttgcagatgggtggggctgaaagggcagccttacaggcgctctccatgcagctcccagaccagcctggcttagtttatttgggctcccataatcccacagtgttcacatgggacctagtagaaggcatcttgggtctgctgactattgtcgctgtgtggggggccgtccctgggtcatgttcctgcccaccgcagccgaggttccaccttgctctcctctaccccgcctggagcagacccttgtctttccacccccaccaggcatcccagggccagggctgcacctgctggcccagggagggtgggccagccgttgagcagtgtgtccagcctggcccggtgtgctgatggcaccatcccccgggcgtcctctctccgggcctggcaccatgagagccacgcacgccttggagggtgcgtgtgggcgctggtgggtaacagcgtaggtaggcctcaggagtgtcctcaggggacagggggagaaggcttgggagggcggccctcaagcccaggcgcctggcttcatgcccctgccggtggaggcacaggaaggaggcagagctcagcccccgccacactggtgagagactccacctggtgagatcctgtggctgggctggggtgccgctgtctttgtttggtgtcttggcaaagtgtgaggtcgtggctccaggcgttcccctgctccttgaggtccgggatcctgggggtcctgcccgctgcccgccaggggtttggcccttcccctctgcggcgctagcctagaagagggtgggacgttctgggctcagggggtgggggacgtttgccggtcactgctgctggcgccctgactgttgccgtcctccagccccactcaaaggcatcccgaagcaggcgcccttcagaagccccacggcgcccagcgtcttcagccccacagggaaccggacccccatcccgccttccaggacgctgctgcggaaggaacgaggtgtgaaggtaggcccgtcccccagctcctgtggcaccccggggcccgttgcgccctggtgccgtcactaaggcagggctgtgcttgtcttggcagctgctggacatctctgagctggatatggttggcgctggccgagaggcgaagcggagaaggaagactctcggtgggggttggggcctgcgtgtcggcggcaatgggggtccctgcgggccctgcccagttggggtgggttgtgcccacgctcggcgggcagggctgtgccccgtgaggctgctctccgtgggtgggtgcctgcttttctcctcgctccttggtggcctcccctgggaagctgtttgattccctgccgctgccctgagctgacactgcagacgcgcccgggcactggcgaggactcctgttttgtccacagatgcggaggtggtggagaagccggccaaggaggaaacggtggtggagaacgccaccccggactacgcagccggcctggtgtccacgcaggtagggctcggggctgcaccccatgtctggcaccactgcgggtgccccttttgttccgattgtggccactagtgtgctctgtcggagaatatatatatgtatgtacatatgtgtgcagtctgtatttatgtatatatacgtatatgtacatgagaggcagtgtgggccgtgccctgacatgggcatctgactcaggcttggagcgggaacctgccccacgcttgctggaggggctgccaggggagtcctcctcaaccctgtgcctcagtgtcccgtcaggcagggctggtgggacctaagccttgcacgtggccgtgaatgggtgcaggacaggcctgtgggggtgctgggtggtcagaggcctcagtgtcccggagaccaggccctgcctgcgggtgggaggcagccacggggcgcggcaggtgcacagaggctgcagtgggtcgtctgaggccagggcctggaggaggccacactgtggggtcacttcaggataataagctcctttcttcccgccgctgcgtgttctgcgtttcttaacatgagcatcttcctttatatcaatgcttcgtggtaagaaaaagcatcgctccttctgtgctcaagatgggctgtttgggctcctcaacccctcccctctcctacacaggagcggctcagtccccaactctgctggggcgccaggggccaggggtcccgttgtctagcccagggagctcgggagagtggcccccgccttcctgctctagctcggggggccacagcctgtggcagtggagctccgggtcgggccatgtgttagcacatgccggaagcatggcctcttctggaaggaaccttaaactctgtgttccagaaacttgggtccctgaacaatgagcctgcgctgccctccacgagctaccttccctccacgcccagcgtggttcccgcctcctcctacatccccagctccgagacgcccccaggtgagtctgctggccccagcctggaaccagccaagctgcctgccaggacatgaccttgcccacgggcgctgccagggctgcggttctcactcctgcatctctgttgtcccccttctgcctcagccagaatctgctgggggcagatgccccgctgttcagcttgagctccaagacataaaccagctgctttgccccaccctgcccgtcctgggcacagacaggcagcggccccaggggacacggcaggaaggggattgggttcgaaagggttttctgccaggtgacccagctcttgttgctgggtaggcgggaggggagctgagagccatcccctcccagacggagggcactgccaggctcacagcacctcaggccaggtcctgggcccaaggggcttgaggatacagccttcctgtcttcccagcagtgcctacggtatggggacctgctgcaggccagcagctggccagagtccagacatcttatctgcgagtctggaaaggcctgagaccactggccttgttcctctggctggggcttctggggcctgtgccttggctgggggccacagggagttcttgtcagagggtagcaggacagagaaggggagctgagcctgtcacctccaggagcactagggtttgggaacagggtgggggtccagccccctcaccaggccccggtctacttgcagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacggtaggtgtacactggtagggcccacaggccaccaggtaggtggtacggccctggccacctcccctagcgtgggggtgccacggtgcctgcagggggatgcaggaggtggtcctggcggggccctggcacccacacccctctccccgctgtagagagagcagatgttcgctgcccaggagatgttcaagacggccaacaaagtcacgcggcccgagaaggccctcatcctgggcttcatggccggctcccgaggtatgttcataaggcagggcctgggggtgcaccgggccgggttgggggcgggtgcccccagacacccacccagcagctcctgctctctgcagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgtttgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagacagtctttgggtacctattttcattgtaaaactatctgaaccattaaagtcgagcttttctaaagaaagccaccatagctgtgtttggggccagcttgtcctccctgctccggggacccagtccctccctaggcggccatcaggacggggtgggccagggctgggggcttcctaggacaccctggcccacagggtggggaacaggtaggatcagccctcggggtactcccttgacttacttggctgtgggcctggggaccacccggctcagccgactgcagggctgggggacagcagtgcttccttctctctagaccatttcacccttaatgggaatttgggaagcaaattatttctgaaagaagaagaaagcatttttccaaagtcagtcagttatgcctgctatttccagtatttgttgttatacttcccaaggtggcactgcctctccccagcgggtcaggtcaaaggcaaaatgacacagtcaggacagggagccccacccatcggaggcatcagtgccacacccgatgctttgcaattcaaagtaactggaaaaaaaatcaaacaatcccatataaaataagttaagaaaaaagcctttaaaatgtttttaatacaaaaatactcatacacaattttccaaacacagctttccattttaaatgctattttcccccaactggcaagtctcaactctctatttcagtatatccctccccccaaaaagtgaatttcaagtttttaagtctaactatcaaacctggtgacagcacccagtattcctaaaaggaatctgaccttacattgtatgaagtttagacaccaataggcacatttaagtttgtatttaatttctgacggggcatttcacacctcaacagggtatggtgaggctgtgacaccccgtggacacagcattttactctactgactaacaaacagtcatcaactacactcataggatcaagatatttggcaactgacagtcatttgcattaacttgaattataaaacaggtttaattctggaaaataaggtagtcctggaagatgggcactgcacacgccggggtttagatgtcaagacagacaaacactgcgaaggggacccagccagccatggacgggtgtcgccggaagaaaggccggcctgaggacggacagctgggttctcacttcaggtgcctgaagagtttcccccacaggtgaccacattttaagctgcccattcggacacatccccctgtgggcgcacacgggtgggtatgggtttaggtgcagatgctggtttcggatgccaaggaatcctgagggattggggcggtttttgtgttttgcttcacattaatgatggaggattgaagctgatgttcaggaagtcaccacgtcctcagaacaaagctgggcagggccgagagccagccacacccacggtcacagctgggggcgtggtcagccccagtggcgagaaaccctgcaagctcagggccgctaccccaaagcctggctccactgagttatcaacgggtattgtagagacattcaaagttagtgttacttgctcattagtttaacagtttttggaaagggggagaaacatatttaaaatgtttgcattatttccttcagaaaaatcataaaatttggaagtattatcaaagcgattaaaaatcacaagatttcactactgtccaacacaaaaataagttaatatctgctccccaaagtgcactgcaaagccgattctgctgttttgacgtaagcattggtagtcccttacctgccggaagggatcttttgggcaagtgacagcggggccctggggccttcgactctaaggtgtgtgtggggacactgcccggcctgtccctagaacaaccttccaagttagggcatcataaggagcataaatctatgagccgatccagtattttcttaggacactttgggagaagttagagtctgaactggaaagcactactcccaccctgtcttaaccggcgagtgcccctcagaggccacggccgcgcgagcaagtcagtggctacacagctcgtttcccctggg

SEQ ID NO: 17529 - DNA, 23024 bp, Human
cctccgcaccctggttgtctcaaagcctgtgtgccgaacaacaccaagctcacagcagggcctgccctggcacacaactgaaaagccagcacagcccagagcctggcccacagcacagaatcagatactcacggaatgaacgcatgttagtgaatggctgcctgctcgctcgtctcagagggactagccctctattttgccctgcagagccaaccaggtggcctttctaaaaccaaaaatggatgaccatttaagcctgtaccattgttcctcagcaccatgggacaaagttcacaatcttgagcttgcagacgaggctgttttcatctgggcttccgcagcaaggcgggtacttgtgtccttgaaaataattctcactgcactcatcctcactccaggagtacccatcagccagcacccatgtgtggttcacctttgcacccagcaggtatttgctgaacaggaagatgactattagagctgaaaatgttctcaagggccacagggcccaaagcaactcagagaggtggaatgaggggctcagggtggcccagtcccaggcaggggtgcggccacaacctcaactgagttccttggtcaggaaacagagcaattctctgaaaatgctacctgcaactccacacgtatgcatgccagagcccaaacccctggctgatccccagtccatgcaagccttaatcaagctggcaggtgggccaggcctggcacacaagtagggcctcagctaaaacagctgcttgacttagtacagcctctcaccagctgacaacacacccctaagttccatacccctctctaggcctccgtcttctcatctgtagaatggagctaattctgcctacaagtttaaatggccctgagttggtcaccacaaccctgtcgtttgcaaaccgagggggctgaagcagcagttccagcctctgtgactccactgttagcccagctgatttttgtgaactttcccccaaacccactgtgtctcaaaggatggtccctgggccacccacccacgaattacgggggcgtgggtggaggctcgttaaatgcagatcccgggcctgacccggacctgccgtctggatctcattttaggcggcgctagagatcccgggccagggaaacttgagaaccgcagctccaaatcgccagtgctgacggcttccgctttgggagccccaggtgttgctgtccgaactcacttggtggaaacagacatttaccagaaagcctggggtcgggcagcgggcactcctaccgctctaaccccgcgtagctgaaagaattcgctccctcaaaggagtcagtgagcttcggcagtctgcgttccacccgtttcgcttcgcgcggcggggcgattgtgtaaagcgggcccgggtctcggcgtccagcccggccccaaacctccggcccccaggcctctccgggctagcggccgggcggcgctgctgcggggtggtcggggcgcctccgcggctactcacccggggcgactcggccgagagcccgacagtcgggaccggagcgggaggagcgggtggccgcggcccggcccctgccccgcggcactttaaccggcggcgccggcgccccgcgcgctctctgcgtccggaatggggacgcagcagttccgacccggtcggccccggagccgcgaggctagctgggctccagcggaggcgcgcgaagcccgagggcgggtgcagctgatgcacctggctcactgcatgcacgtgtgcgcgggggtaggcgcgcgccgcggcggcccgtgctccgccagcgctcggacacggcccatccctccgagccccagcaggcgagggcgctgcgacctgccccagcctgggagggggccagcgggcccgccctctgttcgggtggcgggaatgggtcggcgctgcgagaggcggagccgagaaggggcggcccggcggcgccgggataaaagcgcagcgtgcgggtggcctggatcccgcgcagtggcccggcgatgtcgctcgtgctgctaagcctggccgcgctgtgcaggagcgccgtaccccgagagccggtaagcccccgccagcacctcttccctcatctcccggccctcgagcccagatcctgacgtcgtctgatccgccagtccaggctgccccgaaggcgtgcgcggactgccggctcgaggggcatgcctgcaccctcagggcagccccggacatcggcgtcaggttgcttgagtcaggggcgtgggaatcagacagacccggtctcagatgccaccctgtactgttggttctgtcatttatgctcaccaagttccaagtcccgaacggtaaaacgaagggcagtaccgaacccaccagggtctcttaaggtataacgacatggcctgcaattagcggcgaagggcctggcacgtagttattgttacttggggtctgctcacctgttggggcacaagaactgtttctccattagtaccccctccctttttggccatattgattgccatgttcactcgtgaaggcagttgcctttcttccccagtaccctgaatgatcgagggaatcttctgggtcactgaagagaaaatagctcatcccccaaataacctttgaaatgataccgctgccctcttagaatagcatatagcatcaagctccgtagtcacctgctggtggacaaaccccattcactgtttcctgatgtcttcagctcctatccttcccctctgtgtcagttcagaagccctcttggctctttgcactaaagggaagaattcatcccttttgctgtagttgctgcaaggccaacaatttgagcttggtagcatttagggttgttgcttggcctctcaccggccatttgataagaactcagctcctggtatgatggctcatttgttaaaaaaaaaaaaaaaagtcaagtctggccgggctcggtggctcacgcctgtaatcccagcactttgggaggctgaggcggccggattgcctgaggtcaggagtttgggaacagcctggctaacatggtgaaaccccgtctctactaaaaatacaaaaagtagccgggcatggtggcaggcgcctgtaatcccagctactccggaggctgaggcaggagaatcacttgaacccgggagccagaggttgcagtgagccgagatctgcgccactgtactccagcctgggtgacaaagtgagactctgtctcagaaaaaggaaaaaaaaaatctgatgatatcccttagagttcattttttaaaagacaaataaatgattgacaattttgcccaaactcaaatcattcaaaccatcaaaaggagatcttagaaggtgtttggaaatgtggatgctcagcagcatattccagagctgctggacgtatcacattgagtcttgtcatttgagcttgctgctgcctaaagccccaatattttaggttcagtattttattccagaaccaaagcacaaattattttttcttatgaaaaaacacgagcagctaacttcaaacgatttagtaccagcctttcttgaacactaataattgcttatggtttcgtgaattgctcagtgagtccttttgtgttagaaggggaacattttaaagaacctgaggaaagtaccatggactgcattcagagctttcttttgtttatctccttagcatagctactccttaacctggggtagcccagtaaatactctaggccgtcctaaaaacctagagttaaacattagagtgtgaaggggcctcacatcggtcccaagtcatcccctgcttgcagcagggaaggatgacatccagagacagatggagacccacctgtggtcttcaagtgaggttatgcactggcttgaggatcaggtatactgatggctaatccatggtccgtcatagcctacagtgggacagcttagttcccccctaagctgtgaagcagaaccagttcatcttttctttgaaagtttgtcacttgtatatgcatttaaggggaaaatggtgttctgcctaatttggcaaaggaaagcttgtggtttgccggcttcaacatgacgcttggtttttttctctcccacagaccgttcaatgtggctctgaaactggtaggtgcattagagaatgggtatttggggctttacattgaaagcacagttggacttttaggaagcctaatataggcaataggtcatcgaagaccagacacagggtgacccattgctttattggctgatgcagatgaagtctctgtctgctcgaagcagaactctggggctctgtgggaatgaggccgtgtttcagacaggctagcctcttggccagtcaagatgggacttgccatacaaggtggaaagtgatgcctgccactctgcagagggagatcaaggccgtggaaggaaggtcacttagagttgggaccgagaagcaaatgtttcataggagagcgggtgtttgagatggtggcatttgaagaatgggtaggcttctgcccaaaaaatgtgggtaggaagagtgagctggaggagagatggcaccagcaaaggttaggaggtgggaaagtgggggctgtgtgggccagctggctggaatccagggccgaagcctgaggaaggcaggcctgactctaataaacatgtcaaatacactaaatatatacatgtgtacatacacaggcacctggagtggtcccacgtgctctgtaggtgaaagccaggaggttgagagtacttctgttagatcaaaattatctgggctataaatcagccagcgctaagaaacatttggccttagcaggaagaactgaggaattgggtcaggcgtggtggcttatacctataatccaagcactttgggaggctgaggtgggaggatcatttgaggccaggagtttgagatcatcttaggcaacagagtgagaccccatctctacaaaaaacaatttttttaattaaaaaaaaaaagaagtgaggaattgtgaatgggggaaggtttggtgtgagtcactgagaggagatggcatggcatcagactgggctgggaaagacagtgtcatggaagtcttgctttttcccagggccatctccagagtggatgctacaacatgatctaatcccgggagacttgagggacctccgagtagaacctgttacaactagtgttgcaacaggggactattcaattttgatgaatgtaagctgggtactccgggcagatggtaagtttgcatccatcagagataaggcccaaagtgtctactaaatcagaaatgtgcagactatatgaaccattaattccccttctatgcataaccaacagaaatacatgcatacacgcaccaaaagccacatactagggtgatcgcagtagcactacttacaacaggcaacattagaaagcactcaaatgcccaacagtagaaaggaatcaccagataaattccgtcacagcaacaagaatgaatgatctgtaactacgtacaacaatatggatgaatgtcacaaacataaggcagattcaaaagagtttgtacatttatatctgtgtgcatgcctgcaggcatacatgccatatgatcccatttacagaaagtgccaagcaaacaaaaccaatgtagtgtttagaagtcaggatagtagccaggagcggtggctaacgcctgtaatcccagcactttgggaggccgaggtgggtggatcacttgaggccaggagttcgagaccagcctggccaacatggcaaaaccccatctctactaagaatacaaaaattagccagatgtggtgttgcacacctgtaatcccagctactcgggaggctgaggcacgagaatcgcttgaacccaggaggcggagcttgcagtgagctgtgatcgcaccactgcactccagcagcctgggcaacagagtgaaactccgtctcaaaaaaaaaaaaaaaagcaaaagaccaggcgtggtggctcatgcctgtaatcccagcactttgggaggccaaggcgggtagattacttgaggtcaggagttcaagaccagcctggccaacatggtgaaactccatctctcctaaaaatacaaaaaattagccaggcatggtggcacatgcctgtaatcccagctacttgggaggctgaggcaggagaataacttgaacccaggaggtggaggttgcagtgagttgagactgtgccattgcactcctgcctgggtgacagagagactgtctcaaaataaaataaaataaaataaaataaaagtcagggtagtggttcctgctggggtaggaataactgtaaggaagtatgaggagcacacctgagggagtttcttaacctgcatactggttgcatgagtgtcccgatgcatcaagtggtacacttatgtgtgtacttttctgtgtatgtacttcatggaagaagataaggtaaggcgagagatgattttccccaccccacttcagtttagggaaagcactggcttagatagattacttttccacttcccagatgacgtcacgaagcttttggcatttccccaagattgtgctgcaaggcaccatatgagttctttcagtgagctactcctgggatcctaatgcccatccttttggtttccatctgctaaattcagatcggaaaaaagtctacctggtcaagaatccatgagtgccaggcacagagagaggagtcacctacagtctccacccaggaggattcagaggggtaggggaggcagacacaggcacaatgtcaggggagtcccagaagggagctgtgcttcatctgagtgggatagggcgagaggagctggaaagggtctctggtgaggttgctttaggtgagatgtggccataagggtttgggcccttacctggcacagagtgagctctttgtcagctgtggttatgggctgtggtgcatgagtgagttgggctttaaaagagtgaaacttgaagaggtagataatgggaggaaaggaccttcagggagaagaatcagcatggataaaggtgcaatcggaacaggtgtggtttggtgatgacagtcttggagggtctttgtgggtctccctgaggccagcctcttcctcttaaaagagacccagaatagtgcagagctatagccacctttgcaggcatcctatgaaattcaagctgacctatgaggaggagggagcttgggctttggaatctgaattcgtatctgctacttgctgatgagttttctaagtttaagcagagctccctgaaacttcctaagcctcacgaaccccatctgtaaactggagacagtggtgcctacctttcagtactattgtgaatatgaaccgagacataaaataaagcatgctagtaaagcatctagcatcaagtcagccacacagcaagtgctaaataaaccaatgtcctcttgcctatctcggcagccagcatccgcttgttgaaggccaccaagatttgtgtgacgggcaaaagcaacttccagtcctacagctgtgtgaggtgcaattacacagaggccttccagactcagaccagaccctctggtggtaaagtaagcacttttttgttttttgttttgttttttgagatagcatcttgttctgtcacccaggctggagtgcagtggtgcgatcatggctcactgcgacctcaatcttctgggctcaagcgatcgttctacttcagcctcccaagcagctgggactacaggcatgagccaccagacctggctaatttttgtagtttttgtagaggggggtttcaccgtgttgctggtcttgaattccagtgctcaagcgatctgcctgcctcagcttcccaaagtgctgggattacaggtatgagccactgtatccgggcatagacacttttatgtatttggctaattgttgctgaaagctatgccctttgtttggggagcatggatgatgtgctgctcacacgggctggtaaatagctatgactcagagcttagagcaagatcccttggttcaaatcccattttcggctacttctctgttttgtgccttttgtaagtcagcatctctgggcctcagtttttccctaccagccaatggaagagaattggacttaaattatatcctggctttaaaactttatacttctctgattctgtaaattgtttagtgcccattccctaagtagacattggttggagacctaagttttcacagagtgagtaatgaaatacaaactaaaagggcaacacactaaggtatactgtttctgtactgcagtgttttgggaattgagagttccttgctttgcctttcagtggacattttcctacatcggcttccctgtagagctgaacacagtctatttcattggggcccataatattcctaatgcaaatatgaatgaagatggcccttccatgtctgtgaatttcacctcaccaggtaaacttcctcatttgtttattattctttgtcttgctgggatgcctgctttgcgatatgcacagagagagcccagggaaccctggataaggcttttggccttgctaaatctcagttcccttatctaaagcatggacacagtagtaaccatactttacccacagagcagagagaataaagtcaggtaaaatgtaggaaaaagtctgttcctgtatgccaggcactgtgctgaatacttgatatgcatcatctcacttaagcatctcagcaaccccaaggttgggatagctgcattttacagatgaagaaactgagaggttaagtcactttccctgggttatacacacataaaagtgaagctgacattcacactttggtccttctagagcaatgcacctgagccactctttatatcactgatgcaaaatgtttgttcgttcctatctcagctttctagagtgggctgcatatggctgggcctctgagaatctacagactccagttggcttgtccccaagctgtccatgagaggcagggtggtcctgagttggatgctgggcccttgccccagctttgtgacacaggaccagttctctggtaccacagctgcaatgtcacacacagggctgtgatgaggatgagacaggatggtgtgtgtgaagggtctatctgagccgagtcacccatcccataccaccatcctgtcatctgtcacaggcaaggcatcaaagccaaacggtaatttccaattcactgctggtcttggagattgtggtccagggtgtttttggtgctgcaccatttactacacgtggtttccaactttcttgatgagagcaaacctcattttgttttcaaataagcttttttattttggaattcttttattttattatttatttatttatttattttttagacggggttttgctcttgttgccctggctggagtgcagtggcaccatctcagctcactgcaacctccgcctcttggatttaagtgattctcctgcctcagcctcccaagaagctaggattacagtcatgagccaccacacccagctaatttttgtatttttagtagagacggggtttcactatgatggctaggctagtctcaaactcctaacctcgggtgatctgcctaccttggcctcccaaagtgctgggattacaggagtgagccaccgtacccagccttattttggaataattttagatttacagaaaagttgcaaagatagtacagtttccatatacctctcacccagcttctcctattaacgtcttgtattaccatgatacatttgtcaaaactaagaaaccaacattagtacgtgtctgttaactaaactccagactttatttggacttcacctgctttttcatgaatgtcctctttctgttccagttgcatttagtccctgtgtgtctctcctctggtctgtaacagtttcttagtctttgtttttcagaacgttgacagtcttgagttctgaccaggcatcctgtagaatgtcccccagtgtgggtttgtctgatgtttgtctcatgattagacagggaattcataccacagaggtgccgggcccttcttatcccatcaggggtccatggcacccacatgacaccaggctgggggtcaccatcaacactagattaatgtggggactgccagacttctccatgtaaatctactgtttttcccaactctcgtttttggaaacaagtcactaattctaccccaccctggggtgaggataggggagtgttaggcttcatgtccttgaaggggcagcatctacagatattaccaaatgtccttttcaaatgatggatggttttcgagtcctctcttagggatcaaagatactgttttgataaaggctgtatttaaattagactctggttatcacgtaatgggcagatgttctctgtttagcagtaaaatgttagagccccacaaaaaattagccgggcgtggtggcgggcgcctgtagtcccagctactcaggagcctgaggcaggagaatggcgtgaacctgggtggcagagctagcagtgagctgagattgcgccactgcactccagcctaggcgacagagcaagactccggctcaaaaaaaaaaaaaaaaaaaaaaaaattagagccccatttgaatttgccatcttacatctggaatgttttggcaatttgttacaggtgtggtatgcgtatgtgtgtgtgcacttggcaaagggggtggggcagagatacctttttctaaaatgtaaaaactttcattcaaatttccaggctgcctagaccacataatgaaatataaaaaaaagtgtgtcaaggccggtaagtaaatacggcatttgcttttattatttgaagaaacttgtaacttgaggcagcatagctctcttcatctttgcacagaagaactgagccctaggggagagttgaatatccaagcacccccgatggtggtggcagaagcacctatggctcctgatctccagccagtactttgcccactgagtgcagcagcctgtccagaaaggggtagaccctcagtacatttatatagtggagcaacagtcacaaagaaccacccccatccacttggttaacaacattttagcccaaatggctcagcagtgccaatcaaaggctcttcctgattgatgggagtcctacgagcccttccacctgctcagatgctagcaccacccacctgtggccatggggatcctaagaaccttctgtttggattagcaaacattcgaggtgggagtgtgagttcgctaaaggactggcccacaattacgctctcaatttgtgtcctcaaagaggatcacttttcacaggctagtgaattttaccccttgaattttgtagtaatcccctttaggattattagtccctagtgcccagtttccaagggtttgtgtaaatttctgagtaatatagtgttggaatgctaatgaggctagtggtatttggatcagcccagaactcttaggcacccttcactgcacaaggcatccctggtaccctttcagacagccgtccatgctgtccttgctagaaggcagatttggacgctgagcttcccaccaagggtacagagaacactgcaggtgtgaggaggtcagagggccttgaagtcagtcctgaacctgaactcctaaagacagttctgagccagggcctcaaatggtctcctcggtggagaagataatttctgctgttatacattgttgttcctggaaatcagtccagtccttatttgcaagtcacatgaatgaaacgactgactttttctgccagagcagacctatcagggtatatcctctaagctacgagccatttccttctttctttgcatctagtgaagctggcagaatggtctgatggatgaagctcctggaacacaaaatattctagtggttgtagtcctgattgtgagttcacttgctctataatcttagacatgttttccaacctgtagctctttctccccatcctgggaagtagaaaatactgaccctatcccttaactcaaaagagaggttgaaaacagcagtgagtagcagaaccaatccgtgcctcccaccatactcagcccagggaagctgtttttagcaaagcagcgatgtacggatccccaaactgtcttgggcagcaagtactttgagactttggaaacaatgataaaaagttcactatgtagcagcgtccctatctcttggacattgttcctgagaacttgggtttgtttccataaagccctgtggggaacttaaatgagggaagagttagcaagttcatctacatggttctctctcaactcacaggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgaggtactttttctcttcgtccccttcacctcgtcctccagctttccttagtgtgttgaaggaaaatggggacagtgttgtccaaacgtgctgggctactttgatgaattcagcagataaaaacaagtccctgtgggcatcctgagaggtgtcactgtgaacctcaaaccatagaaagaaggaagtctccgaagcaggaaatgagcccttctttacacatggtctagtgaaaggagtccttttgggaagcaaagctgctttgctggaagcctcgaaatctgctcactcctgtgcctcataatttttggggggcggaggttgacacagggtctcactctgtcatccaggctggaatgcagtggcacaatcacagcttagtgcagcctccacctcccgggctcaagtgatcctcccacctcagcctccccagatagctgggattacaggcatgtgccaccatgccgagctaattttttcatctttagtagagacggtttcgccatgttgcccaggctggtctcaaaatactgggctcaagccatctgcctgccttggcctcccaaagtgttgggattacaggggtgagccagtgcacctggcacctcataattcttgactctctctctcttaagccacaccagaagaaacaaacgcgagcttcagtggtgattccagtgactggggatagtgaaggtgctacggtgcaggtaaagttcagtgagctgctctggggagggaagggacatagaagactgttccatcattcattgcttttaaggatgagttctctcttgtcaaatgcacttctgccagcagacaccagttaagtggcgttcatgggggctctttcgctgcagcctccaccgtgctgaggtcaggaggccgacgtggcagttgtggtcccttttgcttgtattaatggctgctgaccttccaaagcactttttattttcattttctgtcacagacactcagggatagcagtaccattttacttccgcaagcctttaactgcaagatgaagctgcaaagggtttgaaatgggaaggtttgagttccaggcagcgtatgaactctggagaggggctgccagtcctctctgggccgcagcggacccagctggaacacaggaagttggagcagtaggtgctccttcacctctcagtatgtctctttcaactctagtttttgaggtggggacacaggaggtccagtgggacacagccactccccaaagagtaaggagcttccatgcttcattccctggcataaaaagtgctcaaacacaccagagggggcaggcaccagccagggtatgatggctactacccttttctggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagtttaggttcagaccccgggagtcttgggcacgtgggtctcgggtcactggttttgactttagggctttgttacagatgtgtgaccaaggggaaaatgtgcatgacaacactagaggtatgggcgaagccagaaagaagggaagttttggctgaagtaggagtcttggtgagattttgctctgatgcatggtgtgaactttctgagcctcttgtttttcctcagctgactccatattttcctacttgtggcagcgactgcatccgacataaaggaacagttgtgctctgcccacaaacaggcgtccctttccctctggataacagtaagtgcccagtaacttcaaccagatgatcaaagtggctcacacacagtcactgccccccactcagtatgtggaagggttgtgtgtatgtgggcagtgcaaggggtcgctgcctgtgtacactgaactggggtgcagagaaagccaacagtgctgtcccagagaacctagaatctgagtaagaacaggctttatttgtaaaaccactcgtgactctttacaaagcaggatacacagaagggaaaaaaatacacagtgcaaaatggatgttctgagtgccacaaggatctgctgaaaaaagccaaagatgtaagatggctgggtatatatgagaatgaatatttcactatattctgattcaattaccagtctcagtggcccaggatgagcttttggtgtggtcacatggccaacatttggataacaaatgaggaataatggtaccgcctcactagtgcctgagaacagcatgttctggaaaatgtctctggagttagagatgtgttagctttttcattacagatggagaaatacaatgtttacacaacagtccaggggtggggtcaaaagttggaaggtgtcattagacgcagccaaataaagtgaagacaacccaggtgactggcagccctgacttgtgcgtgggcgaagccttacagattcctgggcactctgtgcctgagcttacctgatgttcttgtgaggcgggtggcactatcctccatgtatgtcagtctaacaagacggcctgtaaaaatgtcatctatatgtgctatgtatgtaagcagttgtacccagaataacattaattccttaaagaaccaaaaaaactggacagaaaccctagttcctactgtgaaaatgccggtgcatatcaggacaaagaagccaaagagattttaggactgttcttaacttcctgggtcccatatcccttttgagaatctaatgcaagacctgcacactctagggaaaaagatatgattggcagactctctaaagagcttctgactgatggttttaaagggatctaaatctctacaaagtggctgggcgcggtgacacatgcctgtaatcccagctactcaggaggctgaggcagcattgcttgaacccgggagacggaggctgcagtgaaccgagattgcgccactgcactccagcctaggcaacaaagcgagactctgtctcaaaactaaaaaataataaaaaataaataaacctctataaagtataccaagtcttagtttttaaattaagagataagtgtggatttgttttccaaaggtgaataagctttgttttttccagacaaaagcaagccgggaggctggctgcctctcctcctgctgtctctgctggtggccacatgggtgctggtggcagggatctatctaatgtggaggcacggtaagggttataattctttaaagacatcctagtaaggaaataacattttgaatttttttttaaagaagattcctctggaggcaatcacatgttggcgtttcccagagttagatagcatttatgtaataccttcaagtgctcctacagagactgatatgagcatgactggattacacatgccaggtgaaagcagggtcaggacttccagatcttctgactgtcccgtttttatttttaccattgagccttctaccagtactgaaatgggcaaaagatggctgataacaaattacactttacctgtgatggttactctatgctagttcctgttttttaaaaaatagttcttatgaggtgttaagaaaagctttcgcttggattcatacacagttgacccttgaacaacacaggtttggactgcgcagagccacttacacctggattttttcaatacatatattggaaaattttttggagatttgtatcactttgaaaaaacttagatgaaactcggatgaacttttcaattaaaatattgaaaaaaatgaagaaaaaggtatgtcataaatgcagaaaatgtatacagatactagtctactttatcatttcctaccataccaatagttaactattttaactattaaaagttaaaaatttatcaaaacttaaacacacacataccaactgtacatggcaccattcacagttgagagaaacgtgagcataaagatgtggtattaaatcataactgcatacaattaattgcagtgcgtactgtcctgctgtgaataatttcctagccacctcctgttgctactgtggtgagctcaagggttgcaagtatcgacttaaaacaccctgtgatgctaaccatctccaaacgagcagttcctgtctccagtaaattacatatcacagtaaaaagtatctccagtggttctctggtatttttcgtgtttagtgcaatatcgtaaaccttcaataacaccttaggacccatacgaagtgccactagtaatgctggcagtgctcccaagaagcagtgtcatgaaaaaaagcaaaaaaaacttttttttttcattacaagaaaaaaagccaaattgcttgatatgtaccataaattgagggtctgcagctgtgattgttcaccatttcaagataaatgaatccagcgtaaggaccatagtcaaaaaagaaaaaaattcatgaagccatcactacagctacaccagcagacatgaaaaccttgcacattttgcagaataccttttaatcttgtattgaaaatgtagcttttatgtgggtgcaggattgctgtaagaaaggcatatctgtagactctaatatgatttgagaaaaagcaaagtcattatatgacaacttaaagcaaaaggaaggtgaagcatctaaagctggagaatttaatgccagtaaaggatggtttgataatttttaaaagtggtttggcttaaaaactgtcaagataacaggagaagcagcttctgctgaccaagaggcagcaggtgagttcccggatgccattaagaaaatcactgaggagaaaggatacctgcctgaacaggttttcagtgcagatgaaagtgtcctcttctgggaaaaaaatgctacaaaggacattgattagtaaggaagagaagcatgcatcaggatttaaggcaggaagggacaggctaactggactgctttgtacaaatgcaattgggtttatgatcaggactggccttatctataaagctgctaaccccctggccttgaagggaaaagataaacaccagctgccaatcttttggttgtacaataagaaggcctggacactgagaaaacttttctggattggttccactgatgctttgtccctgaagtcagaagtaccttcccaggaagcgactgccttttaaagttcttttgatattggacaatgcccccagccacccagagccccatgagttcaacactaaagtcctcagagtggtctccttgcccccaaacacatcataatttggcctctagattgggaggccataaggaccttcaaggctcattacacacagtactttatggaaaggattgtcaacactatggacgagaacaccaacagagagaacaacatggaagtctggaagaattacatcactgaagatgccatcattgtgacagagcaagccatgaaagccatcaagcctgaaacaataaattcctgcaggagaaaactgtccagatgatgtgcatgacttcacaggatttacaacagagccaatcaaggaaagagattgtagatgtggcaaaaaaggtggggggtgaagggtttcaagatacggatcttggagaaattcaagagctaacagataaccacactagaggaacaaagagaagacaacctgctggagacgagtgcttccccatcagtgtgaggtgatgatgaagacgacacagaagcagcagcatcagaaaacaaatcgacattaaacaatctggcaggtttctgattagtcaagactgcttttcacttcttttgtaacacagacccttctatgatacaagcattaaacctaaagcaagtggtggaggaaggattggtaccatatacaaatatttttagaaaaatgaaaaagcaaaaaagccagaaattatgatgtctttctgtaaagttacactgaggcgcccacctctcctgcctcctcttccaccgcttctgcctctgccacccctaagtcagcaagactaaccccttcctcctcttcctcgtcagcctactcaacaagatgatgacaagaataaagacctttctgatggtccacttccatttaatgaattagtaaatatattttctcatgattttaattacatttttttctctagcttactttattataatacagcacataatacacataacatgcaaaatatgtgttaattggctgtttatgttattggtaagacttccagtcaacagtaggctattagaagttaagttgtgggaaaatcaaaggttataggagattttcaactgcatgcagggccggtgcccctccccactgtgttgttcaagggtcagctgtactctctaagggctttgctaacttcaaaacatggagtatttgaatacagaaaccagagcatttacatactcagctcaaggcagagctattaaaaaaactcctcttctccatatgtaggaaaggaaatacaaatgcatcctttgagtcatttgtgatgttgtaaataaaatgagattaactccatgttctaagctaagaaagccacaggggcacctggacctcaggaattcttacatttagggatgctgtctgacctgtattcgttacagtagtttcaaacatggtttgttttacagcaccgtatagggcagaattccaggttaagttccaggggctgaaaaggggtgccacttaactttgggaactataaagaaactctaccacctgcaggtagaagacagtacaagcaactacctaattgacccgactcaaaatgtgaagtgcagaggtcaagtgtccctgttcatatacagcactaaaagtactgaggttacaatcacacacctcaaagtatttttttttttttttttttgagacagggtctcactctgttgcccaggctggagtggaatggtgtgatcttggctcactgcaacctctgcctcctgagctcaagtgaacctcccaccttagccgcctgagtagctgggaccacagatgcatgccatcaagcccagctaatatttgtactttttgttgagatggggtttcgccatgttgccctggctggtctggaactcctggactcaagtgatctaccagccttggcctcccaaagtgctgggattcctggtgtaagccaccacacctggccaacaaagtatcttaaacctaaagtttctatgaatttatctgaaaagagaaggcttggttgagaggattgttttagtgagagggacttagaaaatactgcttttaaaataaggtttaaaaagttaaggtttaaggcagggtgcggtggctcacgcctgtaatcccagcactctgggaggcccaggcgggcggaacacgaggtcaggagatcgagaccatcctggctaacagggtgaaaccccgtctctactaaaagtacaaaaattagccaggcgtggtggcgggcgcctgtagtcccagctactcgggaggctgaggcaggagaatggcgtgaacccaggaggcggaggttgtagtcagccgaggtcacgccactgcactccagcctgggcgacagagtgagactatgtctccaaaaaaaaaaaagttaaggtttaagcatcagtgtgtttcaggtgatgtgttcaaaaggaacatcaggatgtttttccttgctgtcactaacaaggcccttggtgctcagctgacattctctagcaagggatcatttgtcagggatggtttacagagtgaaagcctgctgtttgctgttcacagataacaaatgcttttctcctctcacagaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagttttaattgaaaactataaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaataaaaaacaggggtgggtgcagtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaattttttttttttgagacagagtttcactctgtcacccaggctggagtgcagtggcgtgacctcggctcactacaacctctgccttccgggttcacgccattctcctgcctcagcctcctgagtagctgggactacaggcacccaccaccacacccagctaactttttatatttttagtagagacggggtttcaccctgttagccaggatggtcttgatctcctgacctcatgatccacccacctcagcctctcaaagtgcagggattacaggtgtgagccacggcgcctggcctaaaagcatctttttctttaatgcagaggttatgttgtattattagcataaatgttttttttctgggaatgcttatttcacacagcacaatactgaatcttctctggaatgtggatcgatttcagatggatgactattaaaatgtgtatatttgcagattatccttaaagggccacctcatgccttctaatttatgtcttacggataaaaaatcaaaatgaagcataaagtaaaaactgtgtccagctttacaagtggacgcttagtaatggctgaggcaatatgtttaatgtagcaaattttacttatttgtcatgatcagttttcacagtgcttgtaagtgctggtaatagaagatggacatggtttaggtcaaaacttggaccagaaaccaacttcctttgaaacagctctaccagttataagagcaatatgctgttaggtgaagaactgtttaacagaaatatattatgtttttgcaaacaggcagctgatccaaaattgtgttgaaacacctcagaaacataaatgacatcaatactctataaattaatgctgttaacaaatttaaaaaataaaacatacaattttcaaattgaaggcacacatcccagttggtactggcaagtttaaattgtttctaatactggtggactcttcatttgtaacctactgagcagttacagagggtactcccattgatacaaaatgctcaggtaccggcatttctccacatccagagttctttctatattcccttctgatttccatcccttatctgttccctgcttttgtccttccccagtctcacccccatctct

SEQ ID NO: 17530 - DNA, 43095 bp, Human
cctttttcagtattagggtatacatctttccttttacgtcggaaagtacttagattttatataaattatatgctacggttattaaacctgtccttttatatatgtcgcaaatattttccttctttgtatttcctttactttgtatctttttcttttttgagacagggtctggctctgtctcccaggttggagtacagtggcacagacacggctcactgcgacctcaatctcccaaggctcaagcaatccaccttcctcagcctcctgagtagttgggactacaggcacatgccaccatgccctactaatttttaaatttttatttagtagtgacggggtctggctaagttgcccaggctgttcttcaacttttgagatcaagagatcctcttgcttctgccttccaaagttttgggattacaggcatgagccactgcatctggccatgctactttgtatctttttaaacatgtagatgttttcaaagaatttctagacctctctggctttgacattttttgtctcttaattgtattataaacacctagggatgtgattccatagtttacgtcctcctacacaggattaaggaggcagctgcttcttgggttttagcatatacaagtttcttcaaggtcttaaaggaaaaaaagtacttgttaggagggctacatgtcactgggcaacaggaacttttcagcttcattataatcctatagcaccaccgctgtatatgtggtcctataagattataatggagctgaaaagtgctagcgagcttcttaactgggataaaagtttgtttgtaaacgtatgtaaatgtatttacatgtgctagcccagggtcaacctaaaaggtagcgaaagtgtttagcccagaagtctacatagaaactagggttgtctacctccataccaccctgaatgtcccccgatctcggaagctaagcagggtcaggcctggttagtacttggatgggacaatagggctaaggtgagtagatttaatgctccaggataacgacctttaccgacaggtcattgtgtggcacgtggctgtatgtagttattaaaatgtaaatacatatatttacaaacaaactttttttcccagttaagaagctcgctagcacacagcattctgttgaaagccccctttatttcgcagtcctgaagggagtgagggaaggaagtaaaagggcagaggaaataatgaatgaatgcgagacgccgattgtacagggacttgtttccatactgctctctaccagaaacgttctcagtttccttccttctgctggacatgttccaagggccaaaacctcaaataatgtgactttgtagattggagagtgtgtgaccacagaaaggaaagggaggcagcacgtgccagccggcgacagaatgttaagtctgcagcatactccaccgcaatgaaacaaataatttgtgtatttcctccccttccttcgcccagagccactgtgagaatgggctacagaaagtttcgaggcagtaaagccagttgttcacccagaacatctgactgccataaaaattatggtgacgagaaagaacgtttgctcaaatgccggggtcgggttgagggctggagaaaggtcccaccccgcagcatctacctcccgggctcctcaccatgtgcatcgcctcctccatccacttttcggtctcctctgccgacaccgagcacgcgccgcttgcagctggcttgggtgccgccttcgcctccatacccagccaccactcagctacagagcccgcggcagaggaggagcgcgggcagcggaacgcggcgggcccgggaccccgtttccgggggtagtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggtgggtgacaacgtgcttgaaagggggcattgggagaagggggtgggagaggtgacttcttctaaaataaggacaggccgggcgatcctagtctgggatatgtagagggagttcgatcaaccatgggatgaaaagggaggtggccaacctccagggttctcccatctctgcagttgagaaatgcctctgtgccctttgccctgtcaccgactcttaactctgtttctcacctatccttttttctcacggacctttggagaactcatcacagtttaagtttctgtttcaaggcaccattctcttacaggaactttttaaaaaaaattctgctttcctgtgagattctgcatttctccttggcactcttgatactttggctctcacccttctcaggagtttaataataatctagggaagttacctataggctgcacttcgggtggtggttaaagtcgatttgaatttttgaaaacagcgcagttgtcctaaaggactgaaagatatggattagataaagaaaaacaaatcaatattttagctctgtttctgccattttagaatacaaactatggcagtaagaaaaatgcttgagggatgttgtgcaatcttcctcaggatcttcaaggttgggatcattgtaatctagctgacataactgagttgcacaggcccagaggagatttagaaacagataagataaaaatcttgagacgcttttccctcatacaatgctcatgtgataatattcagggatttgaaggagggaataaaagttttgtgaattatatgaaaaggacatctaggaactataaaagaggaaatttgttagaacttgagtttttgagaaatagtctcatcacttattacatgctatgtttacaaaagtacttaaaatcaagaacagagtttcccaaagaatttggttggcttttctcttagtattagattgtattctgttctccccaaacaatttgaaattaacagtacgtattagattgtattctgttctccccaaacaatttgcaattaatacctttagcatcaatagttcagattttggtgatgcttgaaagtttgaaacagagttcttgttgctgagccaaggatggtgttttgcatgtctctgaggtctatcacacatcaataataagcatatgtaaattttgaacaccttcgagaaatcctttatatataaaaggtattttctgatatcttcagtcgctagtatctaatgtatatttaaattatcctaagactacagagtccattttatttataaaagctaaaaatatatgtgtgattgaagaaatacaaataaagtatttttgcgtttactgaaggaaggaaaattatctctttagcgatctcagaaggaatactccttcagcttatggaacaactttgtagtagattagaaataatcacaggggaagcaaaagagtatacttaaacttataatttttttaaaaaactaacaagagctttatagttacagaataagaggaatgcaaaaaatagaaaagttcagacggccagaaagagaaaataatcctagtgttttatatcaaaaaaggagtcagtctgaaaagaaaggaagagtagatgaccgtggttggcatttgtttgagtctcatgttctttctgcttcagggagaaagttctacagtgtgttagattttaattagtctaacttaagaaatacctatcaagtgcctgtaatgctgaaggtaatataaatggaaatacaagatttatatatttttaatagtaacagctactatttattgggtgcccactttacgctgggcattgtgctaagctcttcctatttaagcagaatgacaagaagacaattattattatccccattcaaaaatgtggcagcaagaaccctaagaatttaagaaacttgcctcaggtctcagaattagtgaaggggaactggaattcaaacccaggtgtgttggaccacaaagcacattctatttccatattatatcactgtgctttcatggcctttatagtctgataggaaggaaaagcaagtatacatgtaattaagatacagaaaaacaagagaggtgaaaaaatgctgtacagatcacactggcaagtagcatatgcagttgtgaaaaatcaggaagaatttcatggaagaagagacacattttgacaggcttgaaagctgggtagtatatcaacaggcatgcgcagagaagtttgggcattcaatagtgggggaagtaagtaagtaaaaccttgagtagcaggccttcttaagtaacaatttctgtttcctcagattttgggtgggtaactaattggtttacgcgtttgtataatttgaccagtttggggggtttgggtgtgttcgggttttgtgtttttttgtttttttgtttttcagacaggatcttgctctgttacccacgctagaatacaatggtgtgatcgtagctcactgcagccttgttttctcctttgctagctttacaatgtaaggcaagtagaaaggcttccttatgaagatttgcctgacatcttcacactttcctcactcatgcgatcctctcacctcagcctcccaagtagctaggaccacaggtgtgcaccatcatgcttggctaatttttaattattttgtagagacaggggtctcactacattgctcagactggtcttgaactcctggcctcaagcaatcgtcctgcctcagcctcctaaagtgctggaattacaggcatgagccactgagcctggcataatttgaccagtttgtgaaaagactagagaattgactcccaaactttttgatctaaggtctcctttacactctgaaaaattaaggaccctcaaaagctttctaaattttatatctattaatagttatgatattcaaaattaaaatgaaattttttaaaatattaattcattttaaaataataaacctattacatattaacatacataacattttcaaaaaattaatgagtgtcattgttttacattttgcaaatctttttaatgtttggcttaattgaagaaagctggattctcatctctttctatattctgtcagttgtggtatcacacatcatgtaacctctcaattactccactgtatacgcatgagagaatgagaatgaaaaaggcaaataacattttagtattattacgaaaacagttttgattttatagactccctgaaatggtcttaaagaccccaggggtgcccatgccacactttgagaaccattgcactggaaaaagttttggagaacagagagcaaccagattgatatttattgacttactggtttctgaaaacctcagaacattgacttggatttataccttaaatcctgtaatctctggcttcacattttttattcattcattcattcattctgtcattgaacaaacatttgaatgagagtaagtgactgatctcactgtactttactctggaaatacaaaggaataagacagatcctgactttgaactcatggtacagaaatggaaataaaagtagtatgatagtatagtacaaaaatagagcagggtgttgtgggagcattgatgagaagaaagtgtgaagatgtcaggcaaagctccataaggaagaatttctgcttaagttgtagagctagcaaaggagaaaggacacagaaggaaaaagagcaattcaagaggttcagcaacattgctttttatgaatgaaactgtatttcactatggctatgcaaatgagaagtggcaaaagattaacttggaaaagtagctagagtacagattgtgaagggccttatgaagccattctacataatttggacattatcctttgtattggtgcttgctagagtttactatggataaaaaaatcacttagggagcttaataaaacataggatcctttattccagattctgattctttaggtttagagtgcagttcaagaattccttaattcagcaaatatttattgcgttctgagtcccagtcagagtttatgtactggggatgcagcatcatgcaagataagacatttgggggtattttcttttcttttcttttcttttcttttttcttttgagacggagtcttgctctgtcgcccaggctcgagtgcagtggctcgatctcggctcacggcaagctccgcctcctgggttcacgccattctcctgcctcagcctcttgagtagctgggactgcaggcgcccgccaccacgcccggctaatttttttttttttttttttttttttttttgtatttttagtagagacggggtttcaccatgttagctaggatggtctcgatttcctgacctcgtgatccgcccacctcggcctcccaaagtgctgggattacaggcatgagccaccgcgccctgcccatttaggggtattttcaaggagtgtctttaaaggctacatttttaattgtcccaagtgattctaatgtaagtggaacagggaaaccacattaagaaatgatggcaagatgttgaaggattctaaaaacatgagtgatatgagatttatgttttagaaaatcactttgcatatataagataggttaaacaggtgtgtgaccagaaagtgaagagttagggacctattgaaccagttcaagagcattaatttttagagtctaagtggtgacagtgataaagaagttgtagataattggcaagatttagaaaatgtgtctgaaatagaatcagaatactgtagtaggattttgtgatctgttggattgggaacaataggttattttcaaactttttttgaaattattaaccttgtgaaatagttgcattgtagggattttcatccagaaagagaagactaagagatggttttaaaacaactgaattgtggaaagactagaagtcttattttctagtaatgttattaatggaaaactcaaagcatttgacatttattttttaaggtatttagtaaatattttcattgttaatacataaagtcatagctacaaaagaaacattaaagctcatataatcccagtctttcatattgaggatgaagaaatttagacacagagggaggaagggactttctcaaaagtcacataactacttgataccagagccgtcaatatctcctgttttccaggctaggctgccagtcgagtatatagatagtcatgagctccatgttttagctaatgaattacctgtcctcattcttatttttctaagggaacaaatctgacaaaatcagaatttatgagcctggatgaattagaccttgtataagaacttagttcagtgctaaaatcaagaaaaataatggattgtgtgattttagcctgatttccaagtaccacaaaatgggcggcttaagcagcagaaatgtattatcttacaatcctgaaatttagaagtctaagatcaggattggttccttctgcagagtgtaagggaaagatctattccaaccctctcaccatggctcatagataggcatctcctctgtttttgctttgtcttccctctgcaattgtcgatgtccaagtttccttttataaggacaagtcttattgaattaggacccaccctaatgacctcattttaacttgattaccactgtaaagattctatttccaaataaggtcacattctgaggtgttggggctcccatggcaattcattttcttttttagtttagttagaatatcaaagtgtggctaactaactactctgtaatgttcacattctgatttcacgttcaggaaaatttcgcactcaggaaaactgacttcccctcagatatagaccaaatgtacacacttatatcatactgcctatgctgaaatgtgttaaatagcagttcctaaaaaaaatcatcagatttgttgagactctgattaaagcagtggaccttctccccagagaaacacaccaatcaaatttactattgttaaagaaaaaaattcttagctgtgcaaaaagtgtcatcttagtgttgattttacagtataatttgagaaataatcattttacatgtaactttcagtaagctgttgtgcaaataagatacaaacaattccttcagatctattatgtcagaattgcctgtcatagagtaactttgtgaaatgtaagtcagtttcctttgttggtattgtagcactatcatcagtttctttagaatggagtacaggaaaggtagccatgtagccacttatatgaactctcatttcttctttaagcttggttataatacattaattgcatataaacatagcaacagcaatcatactgtagttctaattgtttttagcacatacccttttactgaactactatttttaagaatatgtaatatcttatcagttcacctatagcacctgtattagtgaaaataattcaggatatgtatttgttttgcagttgctagagggctacccactttctacctgtgacagaccaaatctaattacttaggtcatgcacaattcttaggttatgtttagtagatactgggggtcacagacagtgggaggtaggtgagcattagttaattccttacagccttgctctcaggttataatgaaaccaagttctggcacacttaaaaacatctactggcaaacagagattaaaagtaacacaacctgttctgtaagcttattgaagtcccagtgttctgcccttgtttcatgctaccgcagaactgcttataaaagatttacctgaagaaaatgcaacaatattctagctgtaggatttggttggctacctggttaactcagttgactaagaatcctttgaactagcggctaaggatcccaggcaaaggtgaaggacttgcttgatttgtatattctagttcatatgaatattactaaaatgttttagctagtccagtatcttgaaaaccattaatctatgaaaatccattcctgataatcattatgctaatcaaaaatatttggtgctaaatcagtgataaaagctagttgaagagcttaagctttggaatgtggcttttgatcaagtgtggctaactaaccactctggaatgttcacattcccagctaggaaaactgactgcccctcagatatagactaaaatgtacacatatatatcatactgcctatgctgaaatctgttaaatcacaggccacatgacaccacctatattcttatcctgtggtgttagaatttaggagtttctgtaccctcttccctcttttttttccagttaagttactaatttttagatgagagagttgtattttctctccttatctcaaagagatttttctaacacatggatggataaatagacttctgcctgactaactacctttctttcattgttccttttaaaatttttatcttatagttttaaaaagcattttgtgttcattgaagaaaatatagaggacaaaatgacctgttatcccaccattcagcaatgatcattgtttgttatattttagaaattaaaactcacctattttttgtatctgtttccattaaaaaaagtaacatttctgggatcttattttatcacctaacagtataacatggatatttccttgagtcattatttagcaatgtggtttttaataactacataagatttcgttgtatggctagactatcatttatttaaacaattctccattgctggacatgtagaatatctctagtctactagtaaaggcactgccagactttttagatttaattcctttcccttcctcaaacctggtccttatgtgcccatcatttcctctgtcattggctgtaaaaatgctaatttccttttctttgggccaatcttacaaaattctttatttaggttttaaaaatgtaattttagctatccactaatataaaacttataattgcataaagtaggttaaaaatactgtgtagaatttttggtactctaatgaatatagtacttttttaatgattgtaggagtatatattctggggaaatatggacagaagaaaatcagagaaatacaggaaagggaggctgcagaatacattgcccaagcacgacgacaatatcattttgaaagtaaccagaggacttgcaatatgacaggtaagacagagaaatatttatacatgtgtaaagttgtttgacggttgtattaatttgcatatcaccgggatcaaatttagaggaaaaggcaaagaaaagatggtaaatctagcaagtgtttgaatgatttaactgaattacatcattttaatgtgaattttaaaaatcagttcattcattttatttattcatttagcaaatacttgtatccaggcctggggaagcaggaagtgaacaacaacaacaaaaagcccctgacctttggagtttatattctagggagaggaaaagatgataaacaacaaataagtaactttaggcagtgatggctgccatatggaacataaagccatgtgagggctggaacgttctttaagacaggggatcagtagagtcaggtttctttgaggtaacatttgagcagaaaccaaatgttacaatggagggagccatgtgaaatgcctgaggcgggaacaagcttggtactctcaggacacagcaaaaaggccatgtagctagagcagaatgaacaatggcagtgataggaaacaaggctgcagaagtaggcttgatcccatcgggcctgtgggccataggaaagagtcattaagtttattaaatttacagtaggcaactatagacctgtgagtcgtccacaatagtatacactcaggcaatgttaattaatggcaataatttaacctccagagctagaaacatagtcctgggagaatgccatcacaaaatcaacctgcccatatttgaagagaacagtgtgtcctaactggcataactgaagaattagttctcaaatccatgcaaagcctgtttttcttttctattgtttaaagcttactcatttctctaacattctttcaagaacaattaatttagaaacaatttataaaggtacattctccttatttaattttaaaattagaaattttttagagttaaaggcctttattattagtttacttacctcattttacttgaggctgagattaagaagggtaagaggcacatccaaaattacaattggagtatgatttttaatatttgaagtagtaatactcagaaaaataccttcattctgcaaagcgaatagtaatcataaatactatacataatgacaattctgagagtaaaatgaacattataaaagccacttcataaatgttttgtgaggccgtgatgagataatgcctatacagtgcttgatgtatgataaatacttggtaaatgataactttttaaatttacatttagcattcaatatattggcactgcctaggacattttaatgaatttttagggaatggtccatttctgcttattatttgaattttcaaaaaataataaaatgggccaggcatggtggctcacgcctgtaatcccagcactttgggaggccgaggctggtggatcacctgaggttaggaatttgagaccagcctgaccaacgtggagaaaccccatctccactaaaaatacaaaattagccgggcgtggtgttgcatgcctgtaatcccaactacttgggaggctgaggcaggagaatcacttgaacctgttaggtggaggttgcggtgagctgacatcacaccattgcactccagcctgggcaacaagagtgaaactctgtctcaaaaaaaaaaaaaaaaaaaagtaaaatgtagctgctggggtcttaaaatacatcgcagtttgacatggacccttgtgtcagtttgggtcccctgggaagcagatgctaggatgggattagatgtacaagagatctactagtagaaatgcctgtaaaggataaaggggaagggaggcagaagaaggcaagcgaagcatttaggccacagtgcaggtctgacatttgtgaagggaaaaagacaaggaaggaagaaagattaggcaagaagagtctcagactacagcacagttctaagaaagcattgggagaccatgaagagtctgcaagccaaagtttctggtagaggagacctgcagaaatgggcctgctttactgtgcccatacaagcagtgtcattggctgggagcagtgcaaacatggtgatggatccagagcagtggcagatggggttgtcaattatgtatgctcctccagcaaaagataggggtcacacgtttccatgatgcaaccctaagatgaacaaatagctgactataggcaattaaaagtaaaatatttaatctctaagagccaaaatataggttcagtgaaactttccaaattagctttctgcacattctgcattttttgtacaattcataacatgagcaatgataatggtgttacaaataatatcaaatttctattcctttggataagatgtaattgatatactagaaaaaaaaaaaagagtgctttggggtaaatataagtagttttcttacccaagaagttttcccttttagaatgtggtgttcatagccaggtgtggtggctcacacctgtaatcccagcactttgggaggcaaaggtgggaggattgctagagcccaggagttcaagacaagcttgagcaacatagtgagacctcatctgtacaaaaaatttaaaacattagctggtcatggaggcccacgcctctagtcctaactactcgggaatctgaggcaggaggatcgcttgagcccaggaggtcaaggctgcagtgagccgtgattgcaccactgcactccagcctgggtgacagtgtgagattctgtctcaaaaagaaaaggaatgtggtggtcttcatattttttcattttgttatcgttacttttttagggtttagagactcattttacatttttatatgtgtattcctccatttctttttttctctaatcccatgacagattcttattctccagcatttcttattccacatgtagagccataaataaactcctaaaaatcacatgaagtttttttcccatagattgctagtctcatttcatcttcacattattcctgggagtaagaaacaataacaaacaacagccactgacaaaactaaaactaaaactcagcaacttttagtttctaacccagtgcacttttatttatgttataataaatgtttattgctttgtagtattacaaacagtaaacatgtacaataaacagtaacaaataatacccactgacaaaactaaaactcagcaactcttagttcctaacccagtgcacttttgtctaggttataataaatgtttattactttgtagtatttaataaactttttaaaaattagaatgaaaaatgaaggaaaaagtatagctgaatataaaaatgcttttgatcattgtcattaaatcagaagtaaacacttttgtaaaaaatttggagagtatggaaaagaaaaaaaaggaattgttcataatccatagctcaaagaccaccactgttaaaatctgagaataattctttctattgtttcttctgtgtgtacttgtgttgctgtgatcataatgtttatataattttgttaaattacataagcagataaatgatttgttaggatataatcgttttataataataataataatttgaatcgtctagccctgactttcccttctgactcttgctagttgctagccctatcatatagcctaaaacaatgcgcatttcttagtgagggcagtcatatcacttgtgaccttttttattttttttgtttgtattacagtgctgtccatgcttccaacactgagagaggccttaatgcagcaactgaattccgagagcctcacagctctgctaaaaaacaggtaaatgcaagttacagcattttctgtttaagcactacacttaaagtttatagaatgaactgatagacttttcaaaaatctttgttatttttctatctaatgaaagtttatataggctcagtaagaaaaatactaactatatcatttaacctacatttaattttgtctatgctctacttttttgcataaagcattcaaggcaatgatatttgtatgtattgtttttcatataaatagaccttatagcactttgaaattgttcacaaatttaattatgcagtgcttgtgaaatgtgttcctgaaccagatgctgtgaagctaacaaagttacgttaaatattgtgcttctttctgaaagagcttacggtgtaatacagcatgtgaacatacgttttaaataaataagatatacaggacttatatcttaaattactaacaaaatgaaatacaaacataacatgagcatgcaatactaataatttacattgccatggcagtttgctgtttccaaaagcactttcacatatgtaaccttgtatattgcatgtagcatgtgttggggtattgtaatttggtatgatactgtattagtttgagaagacttccagcaggaaatggcttcttattttgatgacaatgatgggagggtgggcagggaaatggtttcactaaataaatgttaatcattgtggccttcctaaaataatcacttgcctttaatcacccttcaaatagccaggggaaaagtagttctatttctaaactgtctcactgtgctagccctggtgctaggtaccttccatatatgctcccacttaatttacacaatatccctgtgaggcggttactattattcattttgcagtaggaattgagtgctcagacaggctacataacaagtggggaatttttttaaaaacacttactatattcagagaatacttcccaaaataacagtggatttgtgtacttgagatttcttttatctgattaaaacagaatgctagtgatgggggttttccattttaaatttcttcattcttagaggtagacagaccttccttccttcttacagatataaggtttagcttataaattagttcatacagttttatgaagaagaaacatataagcagattgcttttgatcaaataaataattaccatttgtgtgtacataggtaggaattgaaaagaagtagattttaatttcctttttgtcatgatgagaaggcaagacaagttaaataagtgaatagcatttttatacaagcaacataatacagataaaataatcgtggtggcattcttccttcttggtgaatctgtttcctgcaaggccctatgttccatgtgctttaggggatttaatagttaagatcaagtctctttaagaccttttcatccaaaggaggaagtagactaaataaattatcgtaattccggacatatttagtgcaatgacaaaaagtaaaaggaaaatttaggagtatcaaaaaaaccaaaggattaattttgatagattatcctggacagctttaaagaaaagatgtgattctttttttcttaatcggtacacagggaggagaatttcttaaattctggagaatttaaggtgggccacagttctcctcattcagtttcctctttaaatatctcaatgttacttcttcttggctttcttttgatttgaaattactatttgtaatttggtggggggagaagggtaatatccatttgaaaaatatttgcataaataagggcttgatcccttacaaagtatcattaaataaggcctccaatcttatgactgcttttatattaattttatatgagactctggtctcatataagcctgttgagcaagtttttttttctttaaactatttgtgataataactaagataataactaatgagaaataagtagatgatttgatagtcttattttgccaacttcataacagcaaataaacagttatcactgtttttgatatttggcactcttcttgaagactgataatggcaatgaagtttcaatggcaaaaacaaaaaaatcttaaacatcctccatcataagagaagtagaacacttcgaaaagattcgtttaattctctttactttttatttctccatgaaggtattttagtgacattaaagagtctggttgtatttaacttgcagttgatttccatcaaacaaatcatttgaaaggaatatttgtgttgaaggtacttttctctgttctacatagatttggaatcttttatgtagattttggagttttttaaaaaaaaatagcatcagtatttaaaaatctacttttaaggtctaataatgttaagtgtaaacatgaagaaatgtcctgggtaactattactgtcttctcccaccaaaatcatcccaaataaaatacagttttttgttcgtttggttttggtttttttttagatagagtcttactctgtcgcccaagctggagtacagtggcacaatcatggctcactactaagcactttctatattgaaattttcggaaccactgttttcttatcttttttcttttagaatttttataagaagtacttagaaatttttctgagggagcattcaaaaagagatatgagtcacttaggatacattaaatacctcacctttgaattgtggttgattcccagtttaatccgaatacatatgacattctgccgtgagtcttgaacactagattagattaaggttgcagcagtgtcttgcatgagttactcaacacattttctgaacctgtgccatctaggaaagaggtaactgaaactatagagtctgctcattggcaaagaaagacaagaagctagtagtatctttaaaattgtaatagtaactcaatttcttgttggaatgcaaatttatgtctgaaagtaataataaagaatatggacttgtgttttctatatctgtggttttttttatttcatgttttctagtaatttatttttattgtatttaacaaaagtgctgctctgtgacagattggaaaggaaaaggaaaaaaaatggatccttccactagtggtttgaaaagcactaaactacctccacatagtacatccatacaatggtgtactacacgttggttagaagagaaaagtggctaccatctgtatacaatagtcccatccaccttatccatggtttcactttccaaggtttcagttagccatgacaaccatggtctaaaaatattaaatggaaaattccagaaataaacaattcctaagctttcagttgtgtgccattgtgaataacatgaagaaatctccctttgtccagcggatccatgctgtagatgctatctacctgttagtcacttagtagccatcttggccatcagattggatgttgaggtattgcagtgctttgtttttaaggaacctttattttacttaataatggccccaaagtgccagagtaatgatgctggcatattacggttgtgctattttattgtgagttattgttgttaattttttacactgcctagtttataaattaaactttaacataggtatatatgtataggataaaacatagtatatgtaggggttggtactatcttcagtttcaggcatctaccgagggtcttcaaacgtatcccccaaggataagaagggactactgtagtactatggaatgatttccacaagatatattgctatatttttaaaaaggtaaagaaaaatgtgtataatatttttcacttatctaagggggcagatataaatgtatatatacatattcacttatataaagcaaaacaatggaaagtttaagcattttttaagtcgtcatctatgaagaagggagaaaatgaagggggttaggaacagacttttttgaatatactgtattatataaatttgacttgggaaccatataaatatttaatattataaaactatagtgtttaaaaaataatgtccaaaaatatatagtaccataaatcaaattaacctaaatatgattcttgttggtagtgtaactacaaagacagaaactgtgctaaattactttgaaacagaaatttcatgtatatccttagtaggatatatactcttcacacacaaagaattggaaaaacagaaaccttaaactcttttacactgagactgttgtgtatagagtgagggatgaaacaaattagtaattatgttgctttcacctattttttatgtggacaaaaagaaacacagatgtaagatcaatgagattaagttaaaaaccttttgactaattttagactaattttctaaattttgactaatttagaaatatcagtatgaattcatgatgtatattacctttttgatcatatgcacatataaataaataaataaataaacatttattagcttagttcactgaaaaaatcttagaaataatgacctacccagtagcaatgaacattctgcatcgaaggttttggtctctaccatttcctgctatgagaaaacaggacccagtgaaattggtgatatcaagtctgcagcaagaattaaatgagatgaacccagaataagttttcatgtcagaaactgtagatactataaaagactaataaaagattatacaaatcaaaaggattcaggaggcaatgtgaatagtcttccagaagtgaaagatgggcagtttgaacatcgatagagataataactacagtggattgatacacatgaaatatatgtgtaaattcatgtgtttatgatcgtaaaacaaaaaaaacttcatatttacctttgaaggattataggacctacttcattatttctaaaacagcaagttagggaaaagaaagaaatatttcctctgcatttcctatatgattttgtaatctatctatacataacactcaaggagaaaaagattgtaagaatatataccagttaaagtggttgttattgattactggaattaaaatttttttttaccgtattttgtgggcttgcttttctgcagttatgctgtgttgcttttaattttttttaaaaagtaaaaatagatctataaaattcagagttttctattagattatctagattattattttcatatttttaaattttgttctttaggccttcaaacaagctagaaatatgggaggatctgaagataataagtaagcctgcatattctgtgtgacagcacatccttaaaatatttataaagggaaatgtttgcattctattaggatgactcttctttacctgccttttagaattgttgttagtattaaataatatagtacaggtaaagcaaatagatcaatgtctggtcatagaaagcattcagtaaatgttagtggtaatgctattgttattatgatgatgatggtaggtaaaattgtcctagactacatatgcctttattaggtactgatatctctaatgtgctttaaaggaagtttttattccaatccagatcatagatttactttgatattgtattgtaaatttttgttagtgataaaaaattgaaacaaaaagctaaactagggcctacgtatctgcttgtctcagaactgttatcctgttttcccatccattcagctaatccttgtcagcagaatgatgcttaagccttgcctatttgttttttgttgttgttgttgttgttgttttcatttttattatactttaagttctggggtacatgtgcacaacctgcaggtttgttacatatgtatacatgtgccatgttggtgtgctgcacccattaactcgtcatttacattaggtatatctcctaatgctatccccccccccccccccaccccacgacaggccccagtgtcgacaggccccagtgtgtgatgttccccaccctgtgttcaagtgttctcattgttcaattcccacctatgagtgagaacatgtggtgtttggttttctgtccttgcaatagtttgctcagaatgatggtttccagcttcatccatgtccctacaaaaggacatgaactcgtccttttttggggctgcatagtattccttggtgtatatgtgccacattttcttaatccagtctatcattgatggacatttgggttgaattccaagtctttgctattgtgaatagtgctgcaataaacatatgtgtgcatgtgtctttatagcagcatgatttataatcctttaggtatatacccagtaatgggatggctgggtcaaatggtatttctagttctagatccttgaggtatcaccacactgtcttccacaatggttgaactagtttacagtcccaccaacagtgtaaaagtgttcctatttctccacatcttttccagcacctgttgtttcctgactttttaatgatcgccattctaactggtgtgagatgatatctcattgtggttttgatttgcgtttctctgatgggcagtgatgatgagcattttttcatgtgtctgttggctgcataaatgtctgcttttgagaagtgtctgttcatatcctttgcccactttttgatggggttgtttgattttttcttgtaaatttgtttaagttctttgtagattctggatgatagccctttgtcagatgggtagattgtaaaaattttctcccattctgtaggttgcctgttcactctcatggtagtttcttttgctgtgcagaagctctttagtttaattagatgccatttgtccattttggcttttgttgccattgcttttggtgttttagtcatgaagtccttgcccatgccaatgtcctgaatggtattgcctaggttttcttctggggtttttatggttttaggtctaacatttaagtctttaatccatcttgaattaatttttgtataaggtgtgagaaagggatccaatttcagctaagccttgcctatttgaaaacaaacctttctagttccctgtagttcctttcagcttttatacttccttttctggggggtgaggggagatggagtcttgctctgttgccagggtagagtgcagtggtgcaatcttggctcactgcaacctccacctcctgggttcaagcgattctcttgccttagcctcccgagtagctggctctacaggtgcgtgctgccatgcccagctaatttttgtatttttggtagagacagggttttaccatgttggccaggatggtctcaatctcttgaccttgtgatccgcccgcctcggcctcccaaagtgctgggattacaggcataagccaccgtgcctagcctatgctttcttataatccttatgaccaagatttctacattccctttcttctcttcactccctcacgctttgatgtactacagccctgcagcctggcttccacacctgtgtcttcacctaagcaggtctctcaagcgtcagtaacaacttctgtgttaccagatctgctggacattttccttctgctaggactctcggcagcagtcaacaccttcactctctcctctgttttgaacaccctgtcctaagctactgggaggcctgtcttaccaggcttccccagtctttctgtactttcctgtagtccttaaacaggctcatcctcctcgggctgccattgaaggctagagttcttccacactcagccttcttctcttacttgaaaatagctccattgacaactaagagttctgaagctacaattctttgtgcttcccagacttttccttgttttcctttctaagctaatagtatatacctctttcacctaatatatttcattggttattgtttcaattaagggatcatacctaatttttattaaacaattgtgaggagagactgaaatattttgaattgatatatttttatactagaaacagttgtaaatatgtttttaaaagtcatcttacaaaaaaataaccttaggatggttcatgattttacacatttgtattaatcacagtaccaaatgcttttcttttctctgtgaaggtttcacaagaagtactgtggctgtatacagtacctgtatgctggttgttcttttgcgggtccagttaaacataattggtggatatatttacctggataatgcagcagttggcaaaaatggcactgtaagtttaatagacttaaatagacattgttctttccctcaggaggttcaaagtttaacttatttatcctgataacaatttctatgaaataaatatttttatatttcatgtgattgtgaacttttagtattatgaataatttttatatgttgaaactagaatttttggtgtgttaaaaattactatttttcccgtcatttcagatcttgaaaaatctcagccaaagttttattgaaaacatttcttatttaccagtttaaaacttggataattgaactgtatttctgttttatacagacaattcttgctcccccagatgtccaacagcagtatttatcaagtattcagcacctacttggagatggtaagattcttatttgtgacttttatactaattttaattcatttatttttattattgaggaatttttaaactaagcaaggcttttaggtttgttttttctttaataggcctgacagaattgatcactgtcattaaacaagctgtgcagaaggttttaggaaggtaaggcatttttctttgacttttctgacttcttgattctaatgagtgaaagaaaattagaattgttctagtgaaaccagtgacttgacaaacggtgatttgtgaaactctttgtaataaaatcagataccatcctaggatattgcattgtgggatccattttctttatctttttttttatacagaggggaaagttttaatgtttcattgttaattgattgatttcatacaaatcagaaatatttgggtcatgagataaaagacctactttaaaatctgcctctgaggcttttacctcccatttatactagtaatatctataattacagtaggaattctcttatggaatccagagaaatacttttcttggctctgtagtaatggcccttaactagtggctgatttcgtaatccattctattccagtcagcagttacaggtgtaagcagaagaaacaggattttagatagtagcctgttaagaaaagagtgtatataggatgtgttgtatagtttctatttatcccaattcccttttctctgtttctagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggtgcttaattcataaccatttaaccaaaccagttactctattcttttaaaattttactctcttgaaattttgatttctgagtctcttgaaaggtaagtgattgaaaagcatatatttcagtaattgaagtaaaacccattaatttagaaaaacagccattatgagtgatttctagtaagaagcacttaacaattttagatattcagtacatttttattatcaggtatgtgacagtagatactgtgatgtattctggagatgtaaaatgtgtaagacatgttcattacacctggggaactgaagatacaaattcaattggtgggctgcagcgtatttttgtatcagatcaagtagcagaacatagagctgaaggtcagggcaagattataaagagctttatatgccaagataacgagtctgaactccaatttgtagacaaagaaaggtagattttaaccagtccaataacacaatcacctttgctttttaaaaaagttaatgatgaaagtacaaaaatggactgaggaggttatagtcatccacttgagaaacaatgtctaatccaaaaattatcaactatagtgttgctaaacactggtgtgtcctgggtagttgttacgtaagttattcattgattaaaaataatagaaatgccagattgcaggttatggctcatttcctaaattagtaatttttcgtttgtctgctggtttgcactcattctttgtaattgggagaacagctcttacttgacaactggaaaagccttagaacagagaggccccctatgccatacctcagcagagaggccctgttagaacagaatgccttgttttcattgcctgcaggatttcccattgccagagacaaagatgaacctgtttgggtgctgagagatcctacattcatgagtaggccaaaaaaaaagttgcatcccatttaaggaaaccctgtaacttgaaagatagagactaaactgatcaaacagaacagatggaacagaattaatgaaacaggagacaacttacaaaatagaatctcaaggagacgcaataagagtattaagaaatctttttaggactctaaagtaatttacagttttcaaaattcaaaacaggaccaaaaagaaaacaaaagaacagatgaagagagaaatgatggaccagatcttactgaactgaattaaaacctgaaatttaagattgaaaggacacatagagtctcagactagattgatgaaaaaagacacacacatatcctgataaaatctcttactgataaaagaaaaaagcataggaggttgacggggaggatcacttgggtccaggagttcaggaccagcctgggcaacatagcgagatcctgtctctaaaaattaaaattaaaaaaatcagtcagatgggcatagtggtgcatggctatagtcccagctactcaggaggctgaggaggaaggattttttaagctcagcagttcgagtccgtggtgtgctatggttgcaccattgcactccagactgggcaacaccaatctgtctcttaaaaaaaaaatgctttgggaggccaaggcaagaggatggcttgaggccaggaatttgagaccagcctgggaagcataacaagaccctacccctacaaaaaaaaaaaaaatgaaaaattagtatggtggcccatgcctgtagtcctaactactacttaggaagctgaggcaggaggatcacttgagcccacgagttcgaggttgcctaagctatgatcatgccactgcactccagtctggatgacagagtgagaccctttctcaaaaaaataataatagtaaaattaaattaaaaaaaaaggccgggtgcggtggtgcacgcctgtaatcccagcactttgggaggccgaggcaggcggatcacgaggtcaggagttcgagaccagtctgaccaatatggtgaaaccctgtctctactaaaaatacaaataaaaatacaaacttagccggtcgtggtggcgcacgcttgtaatcccagctactcaggaggttgaggcaggagaatcacttgaacctcggaggcagaggtttcagggagccaagatcatgccattgcactccagcctgggcgacagagcgagactccgtctcaaaaaaaaaaaaaaaaacccagacctctgcaaactcaaaacctatttcttctttgtctgactatactagaaatctatccaagaagggccagataaacagagctcttactaagtataattttacttttactcatgtcttaaattctacttatttgcacacataaaccattacaggtttttattttggtgggggagggtctaactttttttattgttgatagaacatagacttagatttcctaaactctttatttatgaatgtgattagtttcatcataaccctgtgctaatgtttgaaaaccttaagtgtgacattttaattctataggcctgtggactttctcctcgagacattaccactattaaacttctcaatgaaactagagacatgttggaaaggtatgtatacttcatgtagcaggaaaaatatgtgtgtatgttgaatgtacttgagactattttttagtttttcttgaacaacatggtcggtataatattatattaaaattaaatttttgactctgttccccagcctttagataagatttcctactcaaactggagggaagcagggatttcttagggtaactcagctactaactctactatctgaattcatcgagttccagtcttttgtttttcctcagtaggattgtccacttttttgttattcagatttccacctcatcatttcatgaagctctggagaaggtcatcagtgatcttttgccatatccaatgaacctgtaatgttcatcttacttgacctttctctgatatttgacactgcctttcttgaaattctttgctcacatgactttcatgacagtataatctatatttttctcccacctctcaaatcatttcttagatttttctatctctgtctttcctttaaacatcagtgtttccaacctggtgcagcagctcatgcttgtaatcccagcactttgagtggccgaggcaggtagattgcttgagcctaggagttcaagaccagcctgggtaacatggcaaaaaccccatcttaaacaaaagaaaaaaaattagccaggcatggtggtgcacacctgtggtcccagttacttgggaggctgaggtggaaggatcacctgagccctggcaggttgaggctatggtgagccgtgattgcaccactgtactccagcctgggcaacagagtaagatcctgtctcaaacaaacaaaacaaaacaaaaaaggccatcagtgtttcccaggtatttgttctttcttcattggcaactgcctcccaggcaatgttttatactcccattactttactatgctagtagttaaagccaaatgtatagccctagtcctccaccctcaggagcttgtctggattgaaatttctacacttcatagatagaaataatttgttcattcacttaattcatttatctcattgaattattcatcaactatgtattggctgtctgtggtatattaggtactgttctaaatgctaggtcttcatccctactggaatgtgtatgttagtgggagagaaaaataatcaactaataaatttgatgtaatgtcaagtatgtataactttgttgatgaaacacaaagcagggtaaggggttagagagtgaccagggatgctgtttgtaataggttggtcagaaaaggcctctttgaggagatgtcatttgagcagagacctgaatatactgtggaagtgaaccttgtaacccagaagaatacagttcaaggcagaagaacagttgcagtgatcctaatgcttggcctgttcaaggaatagcaaggaggccattgttggctggagcacagtgaatgagaaaagtaatagggaagtgagattggagagatagatggaaactccagagtatgttgaaccttgtagtccatgataggaaatttgttttttattcttaatgtatgggaagccattggagaattttaagcagggcagtgacatcatctgtgtttataaaagatctcattgctctatggtaagctgactataaagagataagaatagaaggagggaaccaatttcaagagttgaagtagtctaatcaagagacagttgcagtttgaactgggtggtagcagtggtggcaataacaagtggctaaataatagatttatttttaaggttgaaccagtagtacttgtggaattatttagtgtgggttatgaaagaggaggcaaggatgactcctaggtattggggctgagcatttgaggaaataggaactgccatttacattttggcagtgttaagcatatccaagtggatatgcctattggcaattgaatatgcaagtctggaattcaagttagtttacaaatataatgttgggagtcatcactttgtatatggtatttaaagacatgggaataggaacagatagagactagaagacaactaagtcatagagcagtccaacatttagagtttgggatcgggggaagagccagcaaaggagactgagtaggagctgccagcgaaagaaaagaaacaccaaaagaatgaggtattttggaagacaattgaagaaatgtttcaaggagactgtgattgattgggtctaatgctcctgaaaggccaaaggagataaagacagagaaataacattagatggagttgttgattgatcttgttgagaagtttcagaggagcagtggagataagctaattcaaaagaattagagtttagcagagaccaagcacagacaactgttgcaacattttgctttgagagattctgagaaatagacagtatttaaggggaatgtgggagccaggagattttgactttaacacttttttatatacacctttctactaaactccatgagacgagtaatttttgtctgtttagctcaccaatgtatcttcagctcttagaacagtgccttgcatgtagtagatgctcaataagtatttactgaattgatagagggaaaaattgatgtagaaaagctcattaattttaagaacaaagtactttgaataggagaaaggaatgagattcaatacacagtaaaatagtttaggagtcaggtagggatggctgaggataggtcagatgcatgtaagtgggtagatgggtgggacaagtatgtggaagttctctttgcttctatttttatgtgtgtgaaataggaagcaagctcacctatttctcatttctttcattggcctaaatgaattcaattcaataataagaataaaaactaacatttttgagtgcttatgcagcaagcactgttctatactgctttatctatcttaactcacttaaaccttacagtaaccctaggaggtaggtactatgatgatcttttcttcagtttccatttcttcaactttcatccccttaatcatttttcttcttggaaccttaccatattacctttaaaagaataaagttcagcccaaattaccgtgcaacccagcaattccactcctaggtatctaccaaaaagaatgaaaacatctctagacaaaaacttgttcagatttttcacaacagcattattcacaatagccaaaaagtggaaacagtccagatttctattaactaacaaaaggataaaatctgatgtattcatataatggagccctatgtagcaaaaaaggggagcaaaccactgatacatgctacagcatagaagaaccttcaaaacatgctaagtgaaagaagccagacacaaaagaccacatatgtatgactgtttctatgaaatgtccagaaaactatatagaccaaaagtagattaatggttacctggggctaagactgagatgagaattggctggaaatgggcctagtgggtgatgaaaatgttctaaaattggattgtagcgatagttgcacaactatgcaaatttactcaaaatcattgacttgtgcatttaaaatgggtgaattttatgccctctaagtcctacttcaataaagccgttaaaatgcttttaaaatagagatgactaaggagaaaaggtaggtagatagaaagatacacacatacacatgcacactgtagtcaagaaattggaacataactaggtattttctagctttcttggcatctttatatattattctttatattaaagagttttgtgaggaactaagagagtataattaagatcaaaaaaccccggtctcatgtttgagctccccaatttactaatcacaggcctttcgtcaagcttcttcatccctcaagtatcatttcctcatctgtacacaataatattttctgtctcactgaaatatcatgctagaggatgtaaagccaactaatctatgactataaggaaatttaagagtttcctcaaaattagtagtactagtactgatattttttaaaaaattcattgtacaaagtgctgactagtataaaaaatctgaagtggatgaatattctcattatgttgtgctaaataagctcatttttaaatactttttaaagattgatttcttgatatattttacagtattagattatgactagaaatgttggtggctttcaaaggtaaccacgttattactgaatttgttttctcttccattcagagtctaaaaagtaacttatacttcttactttatatagcccagattttagtacagttttgaatacctgtttaaaccgaggttttagtagacttctagacaatatggctgagttctttcgacctactgaacaggacctgcaacatggtaactctatgaataggtaagatgacatataaaaatgttatactaatgaatgctctaaaaaaatggtgctttgcttgtctttttgttccagataacaacaacaaacctattaaatttgagtgcctcattttttaacaaattaaactctgttaaaccaacaacttcttcactagcagaagctccttcttggtttcagtattaaaacttggagtcttccagaaactttgccactatattgaagtactttagttgtaattacctttctataagttgaattccaattattgtttttttttaactctttagaatacaaaactcacaatatgttttaattttaatgcattctctaatgttattccattactgcaggccattttggtctgcatatttcaatattttgttccttataatacccgggcattgttggtatagattctcatttgatgaattagctccttatagttctacaaatgcttaaatgtattcattccagtccttattacagaattaggaacatgtattagtgcaattgttagtgattttaatcataactattactaaatcatggacttatgtatgccataaggtatcttacggttttttatatctttgttatcccaacacaaatatctttggtctcatattagaatttatactctttaaggatttctattttgcagttttttatgtcaaactcggaaaataatgggtactaaattaatgttgactgactgtaaactcattcattaaaatttgagacacatcctttgaagtagctttaaaattttttttttaattggggacacagtaattgataggcaatatgtatgtgcaatatccaatttaattcttaaatacatagggccagaagttacttaccagattctctgagacccttctttattgtagagaaaagattaatttgacattgacattaagcatttggaatgcttacagccataaagtatattctctgaagtaatttaaatatcaacataaaatctttaaaaaaattttaagttatacaaaaataaatttcagctcaagaccaatcctatatactgtataaatcaaggtgctccaattagtaaaatttcaccataatctgtatatagcaagatattcgttattttgcaagtagtgatacataattgtaatggttattttaacataaatacttgattttgtacactgaagaattgtaaaaattatactacagccacaacagccatgatagtgtttcttttctgaactatagtaatcattatctgtactttcatgtacaacctacatgtgctaccttgaattggagttttattcctcagttacattttaagcctcctctcaaaagtcaaaaactatcttgtgccctttcatgtctctttactcatacaaggcactcagtagatattttctatataagtttttctgtttcatctcaataaccaacttcatgctccatgattgaaccctagaaacatttccatcaagcctattgtcatcattgtttaatgtgttgtgaaagtctagccatcatagtaagtcaagaaaaaacaaatggctaaggcctgtaatcccagcaccttgggaggctgaggtgggtggattgcacgagcccaggagttcaagaccagcctgggaaacatagggagagaccctatctctacaacaaatacaaaaattagctgggcatgcggcacatgcctgtagtcccagctaattggaaggctgaggtgagaaaatcacctgagcccgggaagtcaaggctgcaatgagctgtgattgtgctactgcacttcatcctgggcgagggagtgagacccccctgcccccccaaaaaaagaagtaaggtttttaactattggcaaagacacaaagtatattatttacgtgtattataattaataagccagacctctgaagagaatcaactgaaaaatgaggtaaactaataaaggctttaatttatatatatatatataaaatatatatgcaacatatatgtattaatgtattatatgtattacatatgcatgtaatataatgtataatggatatttaaaagtcaaaagtgcaaaatgaaatccagaagtatattacaataataatagcagctaatactttttccatgtgctagtttgatgataggtatttttcagaatgtctctcattgaattcttaaaataatcctaggaaatacgtactagtattcttcattttccaggtgaggagactaagacacagaaaaattaaataacttcaggtcaagtggtaaagccagttgttcaataatgtctatctgagatagaaatttttctccaaatttttaattattctccaacactatgattaattaaggtttaagaatgtaaggagggttaaaactagaaaagctattttggtaatccataacattaataagctaataagataaaaaacattatcttcagtgttgctgaaaagacattcaataaaacaacatttattatggataaaacctcttactagaaataaaaaatacatttttatataataaaataatatttgagtcaggtatgatagctcacttctgtaatcctgatgcttttggaggccaaggcaggaagattgcttgaggcaggaattcaagaccagcctggggaatatagcaagactcctgtctctacaaaaatttttaaaaccaccaagaggattgcttgagccccagagttcaaggccacagtgagctatgatcatgccactgtactccagtctgagtgacagaataagaccctgtctcttaaaaaaatatataaaaaaagagtatttgaaatcaaaagcaaatatacttaatagtaaaactggaatgatttccattaagttcaaaaacagtataaagatggtcactattgacagattattcagcatcattctattattctatctaatggagtaaggctaggagaagaccaattttgagattcaattaaggaaagctgttgatttttttctatacttatatcttgaaaataggtaacttttactgttggatagcgaaaaaagaaagaaaatagacaatttactgagtgttcttaccattttaataaactgttagttgaccgttggttttctaagttaaactcatgctatctttaaaaatgatatcaattttgaaaagggagaagaaaaagctattgttatatgaaggggacagactttatacttagaaacccaagagagtcaactaaaaagtgtaaaattagccttccaaaattaatctaaaatataatcaaaatattatcaaaattctattggagattggaggatggttgatttttttcatcttaaacctgacaaatgataataaaggtaatatggaggaataatggaatgagaatgtttaagcagttattggaaaagaagagcaatggatatgcttttcctatataatatataatataaggtataattattgttactcataaaataataggtaagtcagtgaaatagaatgtaaaatccagaagtagccctaaaaattgtaggatgttagtaatgattgtgggcaaaatatatgttggtaagacgaataacaattagtcattttacaatgactaataaaattcaggaggtttaagcatttaaatatactaagtaaaaacaaatatactgatcgaaaacaggtgactatgtgacctcaagatggagaaggtatttctaagaatgaaagtaaagaactttatataaaagaagtctaggtttgactgtataatttttaaaacttcaagatcaaacaagctttttataagcttttcatcaatattaaatgcaaataatatacaggaggaaatgtttgctctctttatgtatatatatcatccatgagtgtaatgacattatatacagaacttttgcacatcagttaaggaagcaaacacctaaggaaagaaaaattttctttcttagaaaatgtgcatcaaagacacagataattcacaaaagagcagatggaaatggccagtttgttaatctaagatttattgaacacgtgttatgaatcaggcactgtattaggtttctgttcccatagatcttacaatctaattggggaaatagtaaatataattgtataaactatgagaagtgttataaaggagaagaacactgaacgtataatagaaaaatttaaacaaaagtagacagtcaagcagttttcctgaggaaataatttgaactactaagattggaagctattaaatatgaccctagactacagtgggacagttgacattctgggcagaagctacagggcaaaggttttgaagccacctaagtacattttaagacttataaagaggctggcatggtagctgaatacatagaacaagagtggtgtcagacaaagctggagaatgcagcatatacagatatggctgtcatctgagaacactggaaggctgctggagagttttgagcaggagagtgatgtaatggaatttacattgtatgatttctttgactggtttgtggaaaaggaattgggtaaacagggactggggcaggacagacaaatggatgaatgaagacttattaatcaattcaacaagtatgtattggatgtccactgtacacaagaccttttactatgtgctgggacaatacagtgcataagatagacatggtgtgtaacctcatggagcttgcatgatagtgaggggagacagagcaatcaagtaatcaaaatcatgatagattttgaaaaatgccacaaaggtaccatgaaaaaaaaaatgcctgcttccctcaggaatacataaatcttcccacttcctttattcttttttaagcattgcctcaaatctcagcatagcacactggttgtacaccctagcttcagcacttgcatgatatttaaaaggaaatttttagtgtagccctaggttgaaatgtatgagatgtcatatttaatgtaataagactaaatctacaaccccaacgcaaaaatgagtcttgttgtttaagtcattgcatcacatacatacagtgatacatacatgtattcatttatgcatccaacaaatgtttattgtgctctaacaagttaaaaagttattgctgtagtccaggcaagagataatgctcagcttggaatctgttgggcaacggggagaattcttggcacttatttgaatataggcaagggaaagaagtgccaaggattttcaaaagattttaagattattaaaagatttcttttgagaaatctttagaatatctgattgggtataggcaagagaaagaagtgccagggataatgcccatatttgctgcttctagaacctgatagataatggtgtggttcactggagtaggggggaaatactcaacattgttagtaattaagagaaatgcagatttaacctgtaagatactattttcacctatcagatgtgaaagattaaagaaaaggataatgttggatgttgaaagaaggcataatggagcagatacattcataccctttgacccagtgatttcatgtttatacaaaatcttacttagattaagaaaatttaggcaaaaactgaaatgcccaactctagggaactcatgatataaattgtcacagctagaggacagattactgtatagtcattaaaaaacaatcagacaaacactttagaacttttaataagatggaaaatactcataacaataaaaatgcaaaaacagtgtgcttaggaggttagaggtttttggtagacacaaaaaaacaaagatatgtgtaaaaaaacgccaaaagaaattggtcatgatgtcaattagagttgttatttctaagcgatagaattgtggggttttttttcctttttaatagatttccaaaaatattctacaatggctatgtattacttttataattaagatgttaaagtcctgtggggtcatttcagaaaataatcattactgtaatgatttttcagtctttccagtgtcagcctgcctttagctaagataattccaatagtaaacggacagatccattcagtttgcagtgaaacacctagtcattttgttcaggtaagaagaaagcttgggagtgttattaaaagcaaattatatttgtggtggtggtcatgtttgtctaacataaagttacattctctgctgagaggttttttcaaaaaatcacagaacttggaactacatgtagagtatggtagagtgtcccatgagagtaataacggaccatagcaaatgtgtaagtttggagtacctttctccgtgttgtagtccaacactgtgggactacattttagtccaggtgtattatagtggtcagttgaatttatatagcatgaatgtttgcattaagctgtgctagtaagaagattgatccttggggcagatcaaggatcctgttctacacattttgaggaaaactaaaaaaatttgtggagaagtaaagcattttagtgattaataaaatgtaacagttaatagtgcatcaataatatgctcactaaaagccacataaacagtgggtcatttaaatgttttatcagactacctataactccatcttatttcttcatttccatttggaatgcatggagtaattcagtaattcattgagtaattcagtaattcattgagtaagacaaatattataaacaaaataactttgaatttctgagtcatgtgcaaacttggaaactgtgttataagttaaaaaattgtttgcaatgccagttgcaaactgcttcaataatgtacaatgagaagagaccctatggcctaagcataaagctgacatcttcttagtgtaacttgtctcagacaatttagtgtatcctctctgtagactttttactcttgggaacgtggagagcactgagactaagagttcgtttcctcctttcactgtggtgtcatcagcctgtccttcacatgcacattttcccacactggactcttcagtcttctgtcctctttctcacccctaagagcttggcactcatattgcagaagaaatagtgaataagactgatctcattttactgaatgttaagcttcacatctatatcaatgtgagaaaaaggtcataacttggggcatttaaaccttacctttacctttgtcctcttctgtagaagtccctggcttggccagtaggctgttcattttgacagatgagtggaaattacaaccaagcataaagcatcatcagccttaatgcttaaataattttatgcactacactttaattaaaatcgatataattgataataaaaacaaatgtttcaatatggtaaaaacgccattgatactaatgtttagtaaagttttttactgtaactggatgtatattaaatgtatatactagaccattgattgacaaggctattacaattatagtttaattttttaaactataatttctatgagttaaaataccaagtggtcttcttaataaattgtcatatgctttactatttccacttatctttttataaagcctttgccttgattagaatgctaatttacataaaattagtcctttcgaattactgctactacttcaactacaatggtgtgtaggagagcctatggtgggaatgctgtagaacaggggtttggcaaactgtacagggccagatagtacatactttaggcttaatgcaacatacattctctacagaaactattcaactctgctctggcagtgtgaaagcagtcagaaacgtacatgaacaaaagagtatggctgtttcaacaaaactttatatacaaaaacaggcggcagtggatttggcctgcaggccatactttgctgacccctttggtagaagatattaggatggtagttggtaaaggtaggaaatgggagaatcagaaaacaatcgagaaaggtggtttttcaaattattttcaaatagctttcaaataacataagcaggagataaattatttcagattgctttcagataacataaggaaagagcttttatagtgtgaaccaaccctatgatacataatttttatctcagactactgaaacatcctagaagctgcatcaggatacagtatttgaacagattaaagtctttattataaagctgatataagttagctatgacctatgagccaaatccagccaagcaccagcttttgtaagttttattgggtgacagcatgcccattggtttatgtgttgtttatggctgcttttgcactacaatggtagtatttctcagatttgtccatacacctcacatacatatgtacacacatataccacagtcctccagtgtttaaatcatttttagtgtataaattaaaaactcaataagatccttaagattagagctttttcgtaactcaaaaccaaagcacttttattgtcaagtagaatctaaattacaaaaaaagattgttctataatatggctgacgtctactattaataatttgttgtgccaaagtgaatgtggacctgtctgctactgttcatgctgttgagcattcagcctgcattttctgaagctgacttgctagtatttttttttttatctactgtaactattctgaaagcttcatttgtatcatgtgttttacatgatttggtcttcatttgaaagattttctgcctctgttcttctctcattagcacaagacagttaaagtaatgttacttaaagccaataagaacataaatataaacaaatgccctaaaatcaggaacaatagtaggttatatattttatcttctcaataatcaagagcgtgtttgagttttctttacattttcatagaaatcaaaacacaaaatttcccctcaaattcttgggcccctgaaagtatgtctgtaaattctggtttgagaaacattgatctaaacctatgtttcattgaacacctagactgaatacttgaaactaaataacatcaaattctctgatgagataatttaaccatgaattgattgagattaggacatgtctaaacctcacttggattttccgatacttaagaaacagagatcactagggacaggtttacttcccatttctttgacactctcagaggctgtcaaccttttctatcatggaccctttcacagactggtgaagcctatggaccccttctcagaacaatatttataagtgcatacaataaaatacataatattataaaggaaaccaatcatatatagttttcaaaatttcttttaaaattaagtgtatgatatagcggtattgcttctttattcatgcattaaataccaagatataatgagagttctgataacttccacaactgtcatatgacatgaaaatgcctatgatttctattgaagacaaagtcatacaacctgctaatattatcacagtttgttgcctacattcataattgaaagagataccagattttggttagaagttaaagaaaatgaaggtgtaatttttttcttatcttcacattcgcaaatcccttggggtgttaataacccttacactatagtgtatatgtgtggttcatgtatgtgtgtatatgtaaaatatgcacttactacacatattcataccgtatgttagatcttctagaaagtaatacacccttaaccgtgttatgtcagcttccagcaaaagtacctttactcctacaattatttattcaacagatacctatctagcacttgacatacaccaaaattcatttgaagactatttggggtttttgtccctcaaagtcacacttgaacgcttatgataccatcatccctcatataagaacctaaataataactatctcctagaatttattacaagaaaaactactcattttcttaaatggtttgcctcttggcctttaccacaaaacttagagctgaattcatcgcttgattgcagaaattaattcaaattagctatatgttttgcaaactataatgttatattatcatctttgctaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaatctgagaatggattggaatttacaagctcaggctcagccaacactgagaccaccaaagtgacaggcagtctggaaaccaagtacagatagaccgaatatggcctgacatttgcaaagaaatggaacactgacaacacactaggcaccgagattactatggaagaccagttagcatgtggactgaagctgaccctccattcatccttctcgcctaacactgggggaaaagtgctaaaatcaagacaggatacaagtgggagcacattaacctgggctgcgacgtggatttggacattgctgagccttcagtccgaggcactcttaagtgctgggttatgaggattggctggccagctaccaggtcaattttgagaccacaaagtcctgagtgacccagagcaactttgcggttggccacaagactgatgaattccagcttcacactaatgtgaatgacgggacagagtttggcagctccaattagcagaaggtgagcaagaagttggagactgctgtcagtctcgctgggacagcaagaaacaggaacactcgcttcagaatagcagccaagtatcagatcgatcctaaagcccacttctccactaaagtgaacaactccagcctgataggtttaggatacacttaaaccctaaagccaggtttcatactgacactgtcagctctcctgggtggcaagaacatctatgctagtggccacaagcttggtctaggactggaatttcaagcataaatgaatgctgtagaattgtttaaattattttgcagcatagataccttcacaatttagtgtatcttttaatgttgtatggctgggatgcaagtattgctaaatgtcatattggacctccaggttaaagatgattcagctttaaggtgttaccctttcaggggtacagaagaaacccagttccaaaaaggtcccttcagtggtagatttggggaacttggtggcccctgtagagatgccaggtttcttttttatctagaaatggctgcaagtggaagctgataatatataggcaccttgtaaattcatattgagtaaatgaatgaaattgtgatttcctgagaattgaaccttggtttcctaaccctaactgatgagaggcttgttgcttgatggtgtgtacaaatttacctgaaagggaccttttaaagacagatcttcatgacttgttcccatcccaggtcttcattacctcttttacacaaaaagatctacagggtgtggtcactgtttcttttgtgctgttttggggtggagagggtggatgtgatgaagccaataattcaggacttaattccttcctgagttgtggtttttttgtccttgcatcagtgtataaaatagcttccaggagctctagctat

SEQ ID NO: 17531 - DNA, 18798 bp, Human
acctaggagtagaattggtgagtcatatggtaactctgtgtttaacctttcaaggaattgccagaccattttctaaagtggctgcatcattgtacttgatggtactcatggtttggtcagacaacacccagtttatcatgggcaggtcaggtcttaagaccacatgtatcacagtcattccgtttcagtaaataattacagcaagccaggagcttttcctcctggcaaattattattttttgtgtgtggaggtcttagctttaagtttatttcaaattccagagggctgaactgtgagtctcttattaaagcttggaaaaggctctgtgtagcatcctaatggggtatgccatctccagaaaatggcccactgagtgtcatgcttcttttttagcaagcagagggttccaagtaaggcaacttgtctttctctttggagggaccgtctcaacatgcctcagcccactgcatgcccaggaagttcactgaggtatcacctccctgaattttcaaggggcttctctctcaccttgtggtgaaatatttgccacttcctatgcatcaggtccactcagcatgatgtcttggggtacagtgagatgatcaaatcagttcccagggactcaattatgataatgtgccagaggcttcctttgttctttccttccattatcaccctcagtccttgagtcaggaagcccctctgggaatttatccagctaccaattgtgtttattacaagtatggattcaagaaccggggaaagagccacagggtggctgatagtgaaagggacgtgggctgactccacttctgaccattggaccaagtggcattctacttccccagtgattcacacgggctagtgcaagcccctggtaaatggccacgggtcccacgagaagggaggaggcaggctgaaagtacacacttgtagcgttacatgtgcctggcctcacctttacaggctcacctcacgggctctggcctgtggactgactagatctgggaattagatgaggcaccatgattttccattgtggtgattcaaggcagaatgcctttagccagacctagagttaccggggttatacagatcatgatggcttactacaggacactgtgatcaattagacaccaccaaagatccctggggagaaatcagtttggttccagcttccagccctgctgcctatcatgatacccaggctcatcctgtttctatgagatttagtgccagtgctttgtctctgctgtttggcgtgaagcccggtcgtagagttcaaattgaggtgtgctgtgagcataaacgcacacaccggaaagtctttgcggggacaaaaaaaaaaaccaatgtaaaataccccattcatactgttgtgttttgcctatatgtggaaatgataatatttcggatacgctgggttaaaaaaattcattataaatcattttcacctttttctttttactcttctttcatgttgctgctggaaaatttaaaagtcaacatgtggcacgcacactactcctattggccatctgctctagctggatgggaactgcaagcagcaaaggcctttcaacctctccgagcttcaacatgttcacttatgcatcaggactgatccaacagcaacctgaaagggtcggtgtgagaaagcaaagaaagaggtactgtttacggagcgttcagccgtgagcccaggcgcaggcgcggagctaaacccggaggtgaagcaactacagctggggccacgcccacagactccgggctgtcggggcgggcggcactcgcgcttccagcctgggccaaccaggctgcttgaggctcgaagcgcatgcgcggtctcgccctccgtactggccgagccagcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaaggtaagggctgcaggcttccgggccgtgctaactccgggcgactcggggaacgggggtggggggatggtatcggggcccgcgcacgcctccctctggttcccgccggcgtgtcggcctcttcaccgcccggccttaagccggccttgtctctcggccctggctccgtggcaagggcgcgagagtgggagcccctcgcggtgatttggcatgatggggctcggccctctcacctccctggggtccgggtcgccgtcgaaagacatctgccgtgctgcccaccccgcggtggcgtgggacgtggcagtgtctgtgctgctgccagcccggacgccgccgttacagctccatgcgactaggggagcaagggtagtggaaacgggccgagaagaaaaggagcggagggaccccggagcagggatagagctccgagttgcaagaaagttctagaggccacaagcccgcggggacagtcgagtggtcgcttatggaactttccggccccctgcgtgagcgcttctgtgggatgtttaagctctgccatagccacgtggtgaaccggaagggaagccgacacgtgcagtagcctacagtcagttacccagccatgggacccatacatttggccttacacaccttgttttctcgcttacctacggatatacgttctaagaaatgggtcgttaggcgatttcatcattgtgtgaacatcagagggctcttacacaaacctaggtggcataggctactacacacctaggctgtatatggtgtagcgtatggctcctaggcttcaaacctggacagcatggtattgtgcggaatgctgtaggcagttgggacacagcgtcgagagtttgtgtacttaaacatgtctaagcagaaaaaggacagtaaaaatatagcacagggccgggcgcggtggctcaggcctgtgatcccagcccaggctggcggatcacctgcggtcaggagttcaagaccagcctggccaacatggtgaaaccccgtctctactaaaaatacaaaaaatttaggtgggcgtggtggtatacgcctgtaatcccagctactcgggaggctgaggcaggagaattgcttgaacctggagaaggaggttgcagtgagccgagtttctgccactgcactccagcctggggaaagagtgtgaccgtctcaaaaaaaaaaaattatatatatataaatatgtgtgtgtatatatgtatattatatatgtatgtattatatgtatgtatattatatatatatagtacacaaggttataagtggtgcacccgaagaggagggcacttaccatgaatggagcttgctgagctggaagttgccctggttgagtcggtgactgaatgtgaaggcctcagacattacactactggagactttataatctgtacacctaggctacactaaatttataaaaatatatttttcttcagaataaatcaaccttagcttactgtaactttataaactttttacttcgactgttgtaataatacttagcttaaaacaaacacattatttagctgtacgtaaatattttctctgcttatctccttatttataagttttctattttaaaattttttaatttttttcttaaaaaatttttttttgttaactaagacacaaacacagcacacacagtagccttgacctacacagggtcaggatcatcaagacatcactaggagataggaatttttcagctctgttataatcttatgggggccaccatcacatacgcagtctgtacttgcaaaacattatgtggcatgtgactgtaattgtagacctaaaatccatttcctacctgccctaatttcggtctttattttaaacccttgtttcatttattcttggggaaaattcccaaatcctgtgtttgtttttttagtaattattttgccaaagaaacataagaagaaaaaggagcggaagtcattgccagaagaagatgtagccgtgagtagtaatgtgtttgacttcactttgactaaaaagaaagtttacttaaataacaaactaaaggaaagaagtgtttttaaaggtttccaaggaatgggccagcattggtagtcattgtgtagattcgaaaaagcactgaaatgacacagccccagacagtccaagtgtccttcaggcatagcttactaaatggtgctggccttaccaactgctgtctctgaatttgtcttccttatgccacccacagacccgccatccccctttctctttaaatgtttggacccatcttagtgacatttcacttcccctctgtactcctggttcatttcttctctctctttcccttggaggtcccagtgaaaaggcataggaagccttgttttctgtttaaaaggcatacatttccatggcagtaatggaattgttcaaaatcgggtgggaagtttaataggttatatttctgtcctgtcgaaggaaatacaacacgctgaagaatttcttatcaaacctgaatccaaagttgctaagttggacacgtctcagtggccccttttgctaaaggtatgtggttaaaatcgtgcatcagatgaatgcctgcttttacgttatttccaagtgttaaacaattgattgagaatgcttactgctggcatccttgactttgggaagtgcccactgatacagtttaaagcaggattccttaaggtatctgaaatgagaaccaagtttttaaaaaattggcagtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccctgttagtacattgaattcccagtgagaaagtgtcttcattctttcccacatcatcaccatgaaatctctcttaatgcaaattttatagaaacacaaggtcaaactgccgcttttcctgctgtgcaaaatgggagtgactgagcatataagaaatatggaaaacagaaaactcagtggccacacctgactactcttttgtcatttttcaggcaaagagtatgtggggattgtccggctgcacaatgctattgaaggggggacccagctttctagggtaagtctgcaattgtagggaggacaccctttgttgacttggatctctgagcccctaaacatctggagatgggttagctgtcctgactgactccttttgtccccttttcagtcggctgctgcagccagcctggaccagtgactgcacatgtacattctgatgaggtgtttgttttcatttgtgtttgttcttaggccctagaaactctgacaggtgccttattccagcgacccccacttattgctgcagtaaagaggcagctccgagtgaggaccatctacgagagcaaaatgattgaatacgatcctgaaagaagattaggtgagtcattaggcctgtgagtgggtatgaacacattcttcaggattctgttctcttattaaaagtagatgcccttgaagttgaagactttctaaaacctgccctacagctgggatattgtctgtgggcgatagtttttgttatcttttgttgaaaaagtgaacagtgcctagtaaagtgagatggcttttacaccttttatgatgactgcttctgctggagttgaaatgttttcattctgcatttgtgtagttcggtgctttgttcaaaggtaagtgttttcaccaaagtatgttttgcatgtgttttttatttgctgcaattttgactgcttagaagtttctgttgtcagaagtaaatttaagacaatgccaattttcctcccatccatgaaacataccatgctgaatatacctgcaacttaagtgttaaaaattctgctaatatcagaattacagatctttttttttttttttttttttttgagacggagtctcgctctgtcgcccaggctggagtgcggtggcatgatctcggctcactgcaaactctgtctcccgggttcacaccattttcctgcctcagcctcccaagtagctgggactataggcgcccgccatcatgcccggctaattttttgtacatttagtagagacggggtttcaccatgttagccaggatggtcttgacctcctgacgtcgtgatccacccgcctctgcctcccaaagtgctggaattacaggcgtgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggtatgtgttacggggctagaagttttagagctggttcttaccatctgccagcctttgatggcactccacttgcttcatgtcgtgggaaagatgctttccaaagtgttgagttcagtccagggcagcttccctgttctgttaattaaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttcaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaagttccgggttaggagtttatatttggaaagaacgtactccaaagatgaggcttgctctttttattgttttccttgggttttattttatttttttcaagtccaaaccaagtatattaatttaaagtaaaagtttaatggtaggcatacttaaaaataaggcacattaggccaggcacagtggctgatgcctataatcctagcactttggcaggctgaggcaagaggatcacttgagtccaggaaggagtttgagaccagcttgagcccaggagatcaaggctgtgagctgtgtttttatgatgatcagagagttggccttttataaattaaaacattgtctttttctctaacttgagggataaaaatttctggatatttaaaatgtttgtagttggtaattatttatattcaaatcttgtatagatgttcacattttttgtatgtgtataggctgtaataaatactgaaagatggcaccataatagttgaaaaaactcagtcacaaaacagtggacaacataaatgtgatgtcctctccttatcaaaccattggcttctgggtgaatgtaaagggaggggagaatgtgatcaaaagaggtctaggtgagtggagatggtatgaggcagatgggtgcattgggtaccattgaacctctggagaggtagccttaacttgtacccactgacctataaattctgcaccaagacttttgtgtgattggttcaacagggctcagtaatcttgttttcaagttctttaagagcctgttattgcctggatctccagtaaatctgttctttctcctcataaggaggagagaggagtaattaaggaatgccaaggctatttttatgtttcaaatgaaaatatggaccacgtgcggtggctcacacccataatcccagcgctttgggaggccgggccaggcaaattgcttgagctcaggagtttgagaccagcctgggcaatatggtgaaaccctgtctctattaaaaatacaaaaattagctgggcgtggtggcacgtgcctgtaatcccagctccttgggaggctgagaatcacttgaacttgggagatggaggttgcagtgagccgagaatgtgccactgcactccaccctggacaacagagggaggttctgcctgaaaattaaaaaaaaaaaaaaaaaaaaagaaaatacttgtgagtctctagaacctgaaaacctgaaagtcttctttactacttttgagtcgtgtgtaatgtgcggagagtggtacctatagcacagtgaggtggctcttctgagtaccactcatgccccttgcagctagtgggctataagtgtcatccctgtttcctggtgtcaggccccactcccttgttgtcctcctttactctggtgtgggagtggggtggagggcagcagctgggccccttacacttggtgccatctctgcaggtaaatgccatctgctatggggccaagattatgcttccaggtgttcttcgatatgaggacggcattgaggtcaatcaggagattgtggttatcaccaccaaaggagaagcaatctgcatgggtaagaggggatgtttattttttaaattctaaatgtttgtggttacatactaggtgtatatatttatggggttcatgagatgttttgatacaggcatgcaatacataataatcacatcatggagaatggggcatccatcttaagcatttatcctttgtgttacaaacaatcctattttactgttagttatttatcaccttagttattttaaaatatacacttaagttattattgattatagtcaccccgttgtgctattaaatagtctcactcttcttgttcattcttttggttttttggtggtggtgttttttttttttttttttttttgagacagtcttgctcttttcacccagactgcagtgcagagacgtgacctcggctcactgcaacttctgcttcccaggttcaagcgattctcgtgcctcagccttccgagtagctaggattacaggtgcacaccatgacacctggctaattttttgtatttttagtagagacagggttttgtcatgttggtcaggctggtctcgaacttctgacctcaggtgatctgccctcccaaagtgctgggattacaggtgtgagccaccatgccgggcctgattttttttttttttgtacccattaaccatccctacctccctgccagccccccactaccctcccagtctctggtaaccattcttttactcttctctgtccatgagttcaattgtttcgattcttagctcccacaaataagtgagaacatgcaatgtttgtctttctgtgactggccgattacacttaatataacgatcttcagttccatccatgttgttggaaatgacaggatctcattcttttttaaggctgaatagtaatccatcgtgtatatgtaccacattttctttatccatttatctgtcgatgggcacttcggttgcttccaaatcttggctactgtgatctctttgataacactgatttcctttatttggggtatatacccagcagtgggattgctggatcctatggtagctcaatttagtttttcgaggaacctccaaactgttcttcatagtggttatactaatttacattcccatcaacaatgtacaaaggttcccttttctccacatccttgccagcacttgtcattgcctgccttttggatataaaccattttaactggagtgaaatgatatttcattgtagttttgatttgcatttctctcgtgatcagcattgagcactttttcatatgcctgtttgccatttatttgtcttcttttgagaagtgtctgttcaaatcttttgcctgttttttgatcagattattagattttttttcctatagtgctgagttccttatatattctggttattaatcccttgtcagatgggtagtttgcggatattttctcccattcttatgcatatggatatctagttttcccagcaccatttattgaagagactggtttttacccagtgtatgttcttggcacctttgtcaaaaatgagttaaatgtaggtgtgtgcatttgtttctgggttccttattctgttccattggtttatgtgcctgtttttatgccagtaccatactgttttggttactgtagctctatactataatttgaagtcaggtaatgtgattcctccaggtttgttctttttgcttaggatagctttggctattttgagtcttttgtggttccatgtaaagtaccagtgttttttaacttgtgaaagcttagctactgttggattgtctcttaagactttaaatgctctgcgcaccctcttagtgaatgaaccttagagctattcatttaatgggtctaatttgtaccagaagtaagcatgtcatcaggattccttagctctgtgagcaggcaaggcagccacggcttatggacagcagcagaaaaggaatccttaaaacttcaaaggttctgtggccccaaagggagtgtgcatgccgttcttatagacgtcttgagctgcaagcctgttatgtgtatcgttaggtgctttggttaggtgttttttaacttcagaagtttaacgtcatttcaaaggcctccttctcataatggagtatttcctccatatgcacatcctgagcaaaggtaaccccaattaaagtagtagctcagagttttaaaagttttaaagtggcatacaacagtagaattggggctcatcaattatcaattctttcacccttcaaataattcttttctttattcaatgcctgtagctattgcattaatgaccacagcggtcatctctacctgcgaccatggtatagtagccaagatcaagagagtgatcatggagagagacacttaccctcggaagtggggtttaggtccaaaggtaagtggtactgggttgcgtgccctgccaggttcttttttttttttttttttttttaaatttatttttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagagtttttcttagtgcagaacaaaatgaaaagtctcccatgtctacttctctccacacagacacggcaaccatccgatttctcaatcttttccccacctttcccgcctttctattccacaaaaccgccattgccatcctggcccgttctcaatgagctgttgggcacacctcccagacggggtggcggccgggcagaggggctcctcacttcccagtaggggcggccgggcagaggcgcccctcacctcccggacggggcggctggccgggcgggggggctgacccccccccacctccctcccggatggggcggctcctgccaggttcttttgtttggcattgttgaatacttgggcagctcttggtgtgtttcaccaccacagccttgtattgtgctgggctctgggttgtcgatgagtggaaacaggccctgtcttgggccttagagatttcagtctaatgaggggaaacagttgggcattactcacgtaatcacacagtggaatggcgaatttcatgcacgttagtggctaccaaggagtgcagagaggtgtctgtcacctggagtgtccacagtggtcaaggagtctggtcaagggattgtctgttaagccacaccggtgtgaagagtgggttaggtgttggtgaagtgaagaggggaggggagagttcagggcattgggagcaagcagcatgtgcaaaggcaaaaaagtagagtggctgcggtggggacgttatgtctgcagaggctctcactaataagctttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgtgtcaattctggcccccgccctgggtcaaatggtaggacagatgtgttgaaatcagaggccatggctgttggacattcgaggccatacaaaattcagcagagagcagaattgcatcttaacctggcaccacccagtgttgaaagagtcagtcaagcatgggttggcaactccaccccatggagctgctggcattagagcacagaatgacaggtctgcactcagaaaccgggggcggtactgagtatcctgcacaggctgtgtgggaggagcttctgacttgtcagatgtgaattcctgctttgcctgctttctgtgagaggtccttgcagtcatgagagaaacagctcctccgggcctttccaccccaagccccgtgctgctgctgtgctccttctcttgtgcctgcctcaaggcttcttggatttgggggatgagactgtcttcaaatcctcagtaaactaaggccctgtccgggtttgtagtcagaaaacgtcctgttagattcagttgggatctttcttggtgccttgctaccttttgactcactgaacctttcttgtccattattgcccaagatctaacacttaaccaattgctttcatctcagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggtgtgtggaaacacgttcaggttccttgggctggcttagtccctgcgtggggaaagaattacccaggtggtaccagctttgttactcttcttggaggagctgtggcctgggggtgggatgccaccgagtgcctttagtgcttccccatgttcctggagtgcttttgccctccctgtggaatggacagatagaggcacccgacctctaccacttatacttagagctctattgatggtgggtggagaggatgtgtaggatggtgatctgaatgtttccacttccaaaagtagaccactagggtgtcactgaaaggtttacagaactttgtgtcacatgcagcatttaacccaaaatatccttacaggtcctgaaaaaggcttgcttgactgtggacctttaccagatttccttctgggagagtcatagctttgttagtggatggtatctgtgagctttcattctctttctttctaggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtgatgcttttatgtttgttttctggtttttacatttttgttctgtatcttacacaatccaccttgggccctgtcatctgatgtgagatcaagtactcagaggcagtgattaccacaaaaccactgatctctagaagaacagagaaggagagggttaatgtatttatacatagtgggcctggcaggagcggggggcagggtgagtcgggagaacgaagctgagggtggggacatgcaggaatctgaaggccttggtgacagattagtggaagaaaggtctagggttgcttccgatttggtattaagaaccaagaaagaggccgggtgcaatggctcacacctataatcccagtgctttgggaggctgaggcgggcagatcacccgaggtcaggagtctgagaccagcctgggccaacatggcaaaacccatctctactacaaatacaaaaattagccaggtgtggtggcgtgtgcctgtaatcccagctactcgggaggctgaggcaggagaatcccctggaacctgggaggtggaggttgcagtgagccgagatcctgccactgcactccagcctggcaaaacagactgtctcaaaaaaaaaaaaaaaaaaaaaaaaaaaaaagcgctcttggatgcagcgaggcgaggccctgagctgtagccatatcatgagccaggcatgcagggtgggccccagccctggctcagcgaccggcctccactgtaccacgggaccccaggcttggattttctctcgttctaaatatgtgcccacaatgagcgctccactagctacaacaaccttaagggtgtttttctacatgggcactagccagtagagccctgcagtgggggcagagaatggggactcttccagggcaccagtgtttatcatctgaacacaagagaggcatcttgtgttaatgctgttgtccaggagcttaagtgaaatgggccacatttctttttgtgtggaaacccagagttacaaggtcattggcatttcaacacagcatttttattgcttttgaaggtttccctagagcagacatcattctattgcacagatgtgtcattttggcattatagaaagttgcagttaaaaacgctttctccaaaataaaaagacaaatgaaatacccagcatatacagttgaaggcaaaggagggcaggctttagagggatggggtccattgcttttgctgtgcatcacccttgattagcagttacattttggtagtacttcttacccccaatttctagaaatccttttcaaatccagatcagtggggccccatctatcaggagaatcaacccttcaggagcctgagcaagaagactgaaccttactggctgaattaggatagctgcagagagctggaagctgacacaaaactagttggagcagccctgtttgtcttaaagcaaggcgggtggaattccaaatgctggagaggggcatacagtgggttcccccattctacaagcttagtaaacccaggagacaggcacccactgtggagaactgcacgcttggtcgaaggcttcttgtaatttcttaagggtttcatcaacaccattattgaccagtgagaggtcaaagtagtgagcgtactggctgcggatggcctcagagtccttctgcagctgctgcagggcttctgtctgcaaagaagaaagccacagatgaagcaagctgcaccacccccagcccagagaggccagtgacagattttaaacagcaattgttagcgttgctcagctgtgcatcatacttgacgagtcaaattcagaagacattgtgaaagaatgttaatgtagggcatgaagaggcaatctcaaaagaccatggcaattctcagaggatctcaagctaaccctgactaatcagagtcctctggaggaccaatagctatgcagagacagcatggacttcaccagcatctcccacttaatgccctttgaacatggaagagccatttcaacaaccaccagagctg

SEQ ID NO: 17532 - DNA, 31444 bp, Human
  misc_feature (1)...(31444): n = A,T,C or G
cctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctnnnnnnnnnnnnnnnnnnnnnnnnnnnnnnnnnnnnnnnnnnnnnnnnnnnnnnnnnnnnnnnnttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagtcaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaagggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcagcaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaacccaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggcctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttacagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggagctaacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttaataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcaggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagggcccctcagggtgtggggccctgtagacctgcatagatcaaactcccatgaagccaatcctgagtcccaggcaagctgggacttttggtcatcctagcaatagtcatgtgagtgcaccatcttggaagtagatcctccagtacagtcaagctttcagatgactgcagtcccagcagatacatgactccaatctcatcatccactccaaaactaacctacagaaactataaggtaataaatgttttcttcacagttgctaagttggaggtcatttttcattcagctaaagttaacttatatgacagccatattctttttacaatggaaaagtcagacaggcatacaatgctcattttcagcttattcacattgtcactattttgtggggttacctggtgggcacaggacagtgaccaagtttgcaggtcctccagctcctgctggatcttttagcttctccaaatcctagaaaagttgtgtgtttagctctttcagaaaacacctgaccttctcatgcatgttactccaccatcgaagttagaagcttggagataacatgagactgatgcaggttttagtccatttcatgggctcttctcttttcaggcttccagtgtatacttgctttctccacttcacctcacctttccttccacagaaaggtcagggtatggagctcatatgagggtttagaggaatttggctcaagggccagggccagcttcctccagtgtttcgggtcacaacctagatacacctttatcagcgcctgggaatgttcaaggtcctaattttcattcaggcctgttggctgggtcacagaatgatcaagccactccatgattttctagcatgacacagcaagaaactgggggagactggaggactctacaaaaactttcattttatgtatttcctggtagctctgttttctgatagaacctaactgagataccatttttgccagttcttctatggataagtattatttttttaatttttttaat

SEQ ID NO: 17533 - DNA, 128723 bp, Human
tgttactgtgtcagctactccactaggaatctttgaaactttggcaactgatgatttttttcgcaaacacgttttcaagctttggaaggctttaaagagtttggtaataagcaagaaacgtagtagtacacaacgccgagggtaaaacggccctgtgcccccttcttggggtgtaatagcctcaagcggatttcccggcttctgcgggcgcagcacattgttttatttgttttgaaggctcagagtttgaggctggtcgtagacacccacgtgctctgactctcatcagcgtaatgatcgacttagccagagtcgtgtctatataaaccacaaaaacctaatcattagaaatcccagcctccaaaaaccacattttaggtaaaaagtgccgctttttttccgcgctccttcatcctctcgaccacaactttttgggggatccaaagtcgctttttaaacccacactaggaaataaatacataaataaacagccacggaagcattttgaattttttagttcgtatttttaatttttccccgtgagcgctggggaagacagacacgaaacttagtcttagatgtagaatagacttaataaaatatttaaattcatggaaaacggctggtgcttttccccagcaagggttttgcaacttattttaatcacaaagctgacagtttttcagtccttaaaacaaaaacaaacaaacaaacacctcattcttgttctctaggaatgacaagattgaatatataagaaaaaagaaatgtccagctatgcacttgagttcctaaaaactattttgactagatctccctccaccccccctcctcattttttttgtgtcacttaaaacaaaaaacacccaaaccctgcaaaatctttttcccttgggagtcgctcagacagaggtgggggtagaggtgggagggtgaagagtgctgagaagtcagcacagaggctcaagaattttctttcctcctctcctgaagttacaacgaaaaatagcgacagtcagatcagccgggggctctctggtgtctcggcttcaatctcttcctacaaagagggggttccttgtcctaggggtggggagagcaagaggacgcgacctggcgagattgcccctagtctggggccgcctctaggcttcggaaactgcacacggcgcgcggggggctccttctcgcggccggctggcggcggcagcggctgcgattcgcaggctcgagattcgttgccccgagatccgctgcccacgacttacctcttggcaccttgaagcgcgagagacaggggagctttgcaaattgcaggagggagtggatgcaaagaggtggctgtgagagggcgagaagaaaagaagggaaaggaaggagcctagccggggagccgggctggcagccgccgcgggaggaatctgagcgtgcagcccgcgcggggggagcggcggccgccgcggaggcggcggcgcgggagggcggaggcgcggccgcctgcagctgggtagcagcgcgcggcgcggcgcggcggtggcgggcagcgcgcggcaatgccggccccggggctggactgctgaacccacaccgcttcaccaccggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcatcaaacttgatttctcacctcctcagccccatcacctccatcctctttccccccgtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtaagaggctacaccgccccccgcccccggccgggagcggcggaacctgcccgccggtgtcttcctgcccacggggctgggccccggacgtcctccaagacctcctgccttggcggctctaaccccagaaacccccggccgggcctccctccggatgccctggcgggctcggggctcagtccctccgcgcaaatccctccctctcccacctgtgcccgctgccaccccgacttcagccctagtccccctgacccgttcagcactcctcatgcctcctgcctggccttgattctcactcactccttcgcgccgtctccctttcccccaggatccccaaagtacccactcttgcactgcgagcggacttgctccaccccgcccctttcccgggggcgaggatccccggcattgtcccctggggctcccgcgtccttccgggacatcccggcctggccgcattgcgggctgcccgcgcagcctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcagggggcctgggcgctgaaccctcgagtgctgggaggcgcgggccaggggacggggcgggagctcgggccgcttcttccagccgggaccgagctctgcgcctcgccccgccagggagggatgagggaaacctgtggaacaactttagttcgcccaacttgaaaacggaggtgaaattttgtatttttgctttattattatttttaaaggacttaaatctaaaaaagatccctcctgcttctgaaaggtggtgagaggctcctgctggtggcctgagcacggagtgagctcgaaggcttgagagcggcctctgcgcgccccgcagactcttgtgcctgcccggcccgttagtttgagggcgggtggcagccgcgggagtcgcaggcaggtgctccgcaggttgaggttttaggatctggagcctctcacagtagcccgatggctctccataacccgatccagatttcccggggtagccctctacaggggggagacgcggagcccccagggcccagcgcacactgggttgatggggaaacgggttcccaggctgtccacactcgcaggactgtccacactcgcaagacgccagggatgcaggggtggtaagccagacgtggagatgagactctcagaaaggtgctttgggcccttgctaacctctgaacttgagtaggtgggcctgggtcccctgggttctgaggtctgtggagagcagggcaagcaaggccttgggggaggttaaaaaaaaaagttgggggaggaatcatgccagtttctccgctggggaccctggggccaaactcccacgggccactgacagttcccagttgttgatcacccccaccccacgcaccaattcagattccgtgtgtgggtgggatggaaagaaagaggagtccaggtcaattagacctggttatctcgctaggacttatatcagaacagaaatcagaatgaattgttatggaaaggggatgttgcattctggggcaagtttcattttgcagttggctcaagaaatttttttttttaaccgtcacatttctccttttataaaccacccattttgtaggttaatgtttgcttccttgaaataggaaaagctcagaatacatgtgaattgtataaatttaaatttccatacaatatatatcttttacaatgtccatcgtccaagggcccagaatttttaaattagtcttatatgagaatggaaatttgtttccaccaacgccctccaatcccccaaaccaaaagcccccaaaaaccccaaacctggatgaaaacagcaaaaaatacaaataagtagataccttgtctgcacaatgccacaaatcagaatatgtgaaaatataagaacagatgcttacatttttaaagtgttccatataccattctgctaaacatatttaaggtctatcttgaactgttctcttgcatttatgcggctgaattgatttgaacatgagcattttggatggaaaggttgttttttgcactttagcttgagctagtctcagatattttggctgtcatctaagatttttcactaccaccctttaaaaattattttgaaaataaattttgctctttgttattaatcaacttgttaatcacacagagtacatttttgtatcttaagcagtaaacagaccgtaggtaacaagaccatattaaattgactattttaattcatatcaattgaataatgaattgagttaacctacaacctgactgtcaatgtctttctatcaacatacctgtgttaaacaattcaaaaagtgggtgatagctaagatctactcagtatagaaaatactctactgagaaaaaatgtatggatgtttggaacatccagattgtgacaacctctctttaccctacttttggaataaaagcctgagagcactagactttctatactcttacaatataatcaaatacatctgcaatgaagaaataatatgaagaagtctcccttttaaaagtggtgacagcaatttggccatgatatttagagctatgtaaaaaatagattatagtggttgtcaggtcaatagcagataggtaaatggatttaaacacacacatacacacacacacacacaacttatttgttgtgaagtctgatattcaaatcaatacaatatttattgagcccgtattttgtatctgtcacactgagcttgacaccgcagagaatcagaaatgaattcaatagactgttttgaaatgtcagtttaaactcgtgtttaaacacgatattgtcaatctatttcattaagaatgtattagcgttgttcatctactcttgtttcgagatgatataaaatttatttatttttacatgtaaaaatgcaaaaacaactggtatactttatataaagttgtttattaacattgtatttttaacaaagttctgcagttttgaaatgttcggtccccccaggtgtcaaggaaacggaaataaatatttttaacattttcaggtgtatctcactgaaaccttaaaatagttagggcatactattagaggatcccagaccctttctatcctagataattctagtgacaaagaagtaatttgcaaattcagctcattagctgatggtcaggtaacggtggagagagcgtgtcaaccatgcatccagtagcacccttttagttaggggtctgtcagcatttccactgtgaagcctggtgttcagggttcgtaacttagttgccttaaatagcttcaagctgaaacactatgcagaaattttaagtccagatgtatattttaaaactaaaagtagttcaagtctattctgctgttttaagttagagaacactggactacatatatttatcagtatcatatgtttttctggcagtgttaaagaaagaaaacacatttttagatatataagctagcactcatagttaattctgtatatttaataatacctttcagtgcttgtcaaaaggaggggtttcaaaatgacagagcaatttctgtttgaaaataaatttttggcatcactagccatttttctctcttcgaaaacaaatatacaactggtaaatacttgataccagtgagtagtatttttcttacatagttaatgatcagattttatgtttatattttttgaatctcattgtatctaaactagggaaaataggttgttaagcctgttaaatccttattaaccgtaatataaattattatgcaaaattatgtaaatcaatagatttcaagttgtgtgaagacagacacatttttgtgttatgcctttgaattcaagaaaacttatttaaagttaaatattttgggactgaatatataaaacttctaagtaaggaagttggaacaaagaatttcaggtggaaaataaatacttataaaattttttagaaaacttctattaaatatttgaaaataggtatggtagatatctttcattattttttcctctttggcattattgtttgtatcctttcaaaattccagaatatctattgttagatgatctaaaccaccatgatacatggcccacaaattgctgctttacattgaaataatttttatcaaaatttatctttgacatatatagttttaaaattatgaaatgacatattgtgttttttctctaaaattcaatgggcttttcctaagttctaggataaattcaaaatattaactgtagtatttgttgaaatgttttgatactgtatttgaagttatctttaagtaattgtgataggaataacatttttgctttttgcaattagtctcacttctctttttattgcaaagaaagatttgatcagattttatcttgaaaaataattatatttcaattataccgcaagtacaatatcctgaattattttggcctataagagtaattgattagttaagactagacttctgtccatggaaatgtcataggcaattttaatttccatataaaaagatgagaaactgttttaagggtttgagttaattctccattcctcttcttttagtgattcacagatttagtcataaggagtctcatacaaaatttcaatagcattactacagttaaatatccttctactttattttgtgcaagccacatatcatgtgatttaaatgctagttatggtgaggtgcgctaaataaaggaacgtctttctctattctgaaatgtcaggacagaaaattacttctccttttctcatggagtttcttgaatttgtagattttatattttaaaaacacctagaaatgtaattgttaagatcatcacaaattattctttgcagagcagtacttttgtattgggtaggatggaagcaaattttaatttgtgcttattcctaactagttaaagagcgagttttgactgcactttaccccttcaaatgtttttccattgcttggttttggtacagatgaaatgtgtaaaaatttcttgattcttttggttttcttttagataaacacagttgagaatctccaagggaaactttttagcttcagagatctacttaaagaaaaaacctctcaaacatataattatacttctgattgatataaagtcaaatacagtacttcccccaactcccaaccttttctccccctcagaaaaacatcgggcaatctgatttggtagagtgaatagcagaaaaaaaaccaatatatttagccattaaactagagttcagctttaacaggaaagattgtcactaccttgcattagcattttttttcaggtcttgctctcagcctcatagaaggctcacacatcttgtgattatttatttgttttgtaaaatgtgatacgtaaaacacactaatattgaatatggtcattattatactgcttaagcacagtaaaatggatgtatgtatttcactcttagggatcttttctttcatattttcccatattgaatcaattttccatttcttctaactaaaaaaaaattcattatgttaaaaatatgcagtaaaataataatgtcccagagctcttgaaaacctttatattggggcagattgctttttttttttttttttcggaaatgtagccagacttgagtgaaatccaccagcagtcatcctgtatctctcaacaacatcaaagaacatctcagaacatgaagtgaggaagtacgtactcagttgaaccctttaagaatgcttataagtaaaagcctatgtttaacagacagcagatttggaacagaacactgtgttaccctcctcatcttacaaaaagcacatcattataattacactctatacttatatagtatcttctacattttgcagactttccaattcatattggaaaactgtggttcctggagatgaagttattttgtgtgaggtcatagcagatatgtagcagaagtggggaaaaagtggagcctcttgattttggtatattcattctcttctaaacagtacaacttttctcctgcctttattaatatgcttactgggtccatatttactttgacatagaaagccacgcagcaggtgttaaaatacaatatgctgagtgtacaaaatgtcaaacattcagatgaatcctggcgaatgtagtcaattattgcagtattttcaaatgttcacatttttggcatggtgaatttgaaaaattgaaaagcacattgcctccatcaggagtacagcattacctgtattcagtagccgcttgagatatgagatgacgtgtacagagaggaagtcttattttcaagggattttacttttgatccaggagacttctcatattgagaataactatattctccagggaaagggaggcagcatggttccgtctcctctgagatgaaaacaatgtcagaaaacaagctgggggcaagggcacattgctgttagcaaggggtgctgactcaacattaactggccctctcagagttttagtgggtagccccacagacttctgtctctgcgaagtggggctctttatggagctctttcatttatttcaaaaatgtttacctggctgggctcggtggctcacgcctgtaatcccagcactttgggaggctgaggcgggcggatcacctgaggtcaggggttcaagaccagcctggccaacatggtgaaaccccttctctactaaaaatacaaaaattagccaggtgtggtggtgcacacctgtaatcccagctactcgggaggctgaggcaggagagtcacttgaacctgggaggtggaggttgcagtgagccgagatcgtgccactgcactctagcctgggtgatagactaagactccatctcaaaaaaaaaaaaaaattaataaaacacttaccatgtgctggacacttttgggagcagggttgataagtggtgaacaagacagatgagatgaaggcccttctctcgtgtagtttcctaactcatataatctggactcctaggagtgagtccctcagctttggcctggtatatttaaagtagtcatagaccattaatattaacatatgtacgttgaaatgaggatcacttgagtacattgggaggctggggaaagtggggcctgtaatttaaggaaggctttattgattttgaactgaataacacagtactaaatggaaggaatggaactgagaaacagcctaagagaaaagtaagggtgacaaaaatattgacaagttttttgtttgattgttttcctggctggaggagaggacatagtgaaggcgtgttgcagtagggttcatggatgggggaaattcagccctaaaatataggtatagtgtgtattatcacactgttaagaaatctactgtaatatgccaattgtattgggaacatggaattaaatgcttaggtttgtcttatggaaatcttgacaaaggagggagtagcactagaaggagaaaaagataagtgggaggttcaccagacaggcaagcacacaggggtattattgtcagacagctgtgggctacttgagctgcggtcattgctgagttaccatgagggcatctggaagctgaatgaggaagacatggaaataatctgaatatagagtcctggaagttcgttgagagaagggattgttaccaaggggcaggatcttggcaatggattaggaggagtgtttcatatatgacagtgaaggatctgcaccagcatctccttactgggctctgtgttaatcaaaggcacacatttgcatgttagctgactcaggttaaagtgttatctctagtcttagagcagagaaaatgtttgtttgttccaaagatggattaatctagatcttttcttgattgagttaatttgcttcagattaactgttgaagattaagcagtcaagtatgtcattccaggatggcagatgggacacaagacataatagaactgaggctaagggtatatattgtttttttcttatttatcatcaattattttcaccttcagtttcttgatgactttggatatcacactgggtcccaccgcagtgtggttttcagtaaatatactttattaaaagctgaagtgctagcccaaagtaaggagataaaacagactacacgatatctaggctctatgtagtgaggagccccagggtttcacttaaaaatcttctcccataaagttgaccagacttgatattttttagcctgtgatgggataagaccacacctcagggctctccctgagagaaagcctgcagacaggtggtgccttgatctgtatgatgcaatctgcagatggggcatccctcttccttctgtggcataattcctacggacagcttaacatggggatttaataaaaatgtacatattttctgtgaagaatccaacaacaaatgaaagaagtttttgcctgcctttgaaatgggtggaccctgaaacattggtctgtttgaagtggcatcacaacccatacacagatgcttcattcctgtcggccattactggactggactagaacactaagtcctgataagacacatcatttgcaatgagaatatattctgtttgtaagcctttctgatgtgccattattgctgctgtgtttcctgttttatgtaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggtaggtctctgacttttgatactgataatagaataagcacattaggctcctttgatgaaatgtagactagtctgtatacaaatcagcaccttctttttctgaatagaattactgaagatttgatttaaatacatccagatgaagttgagtgtttttctgagtactcaggcctttttcatttattttatgatattgaaaattcaaacaatgttttcagaaaaactagctcctaatttcactgggtgtgagcatataaggtagagaaaagaacagttggaggatcaacttctgaattatgaggagtcaaataactgagtaaattgagtggtaaaggggaaagaaaaatggatatgttggatcaatttcctggtaatatcaattttggtctaagttgtagcaaggacagctggcataatgctcttcacttatcacaggttacctctatatgatttaatttactctcatagtaagaatttattaaaaaccatggtttttttttaacataaggcttttcatttgaataagtgaataatgtattacttatgttagagtgactatgtaaggttgcctagacagatgaatgattagtactctaatattaatagttccatactatgtaaggattcccatcatctgagtccatattcaaaaattagagatccttaaatagaaaattatcccttttagggtttttgtaactgtttgataaatgaggttaatgttttttaaaaaagtctttaaggaggccaatattttggcttttatttacttattctacagaaagacttttactagttactcactattagaagcattatgcttatttatttacttaactgaatctaatatttccattttaagtattttgataagaagaaagaaaatagaccactttagaactgaggtgaaataaagccttatggaatcattgcaacccaggtttgaataggaaatgaggagcaccactttttaaaccatgtctaataattgctctttagtttggatcagatgtcaaattattaccattgtaaaaacttgataagggaaattcaagcaaggctgtttccgatgagtagtgttagtttactttctaggaacagggccaagaagttgtactttttaacttaaaaaaaatgattcatgctaatgagatactgtcactgacatgttgtttgaaataaaaagaggctcacagcctccggtagaatcaaaactaagggagttatctctgcatcaggtttagttaactttcataaaaagaagaaaaaaagacacatcctatatcactattgactgattaggtttggagtatgtgtgtgtgtgtattcattcttcctttttctcatttacttatgcaggtccactatgcaattaaagttttcctttttttctagttagaatcaagaaaaatgtgaacatgatgatttacctgtatgctctgaattgcatctttcttcttatgtaataatactttttttttttaactagagtaatgaattttagtttttaaaggattgggtgccatgcttaattttacattacagattcaaactagtgttttcatttatcttacttttgtattatatagatgctgcataacttttttctgatcaatttaagtagaaagtatggcaaagtgatagtgtactttgtaaaccctcaacatatttatttaagaaacttcaaagagaaacaaagggtgtgcactgttttactatattggctttctgagttttggctggtttcccaaatagcaatttttatatttaaaaaaaaagacagacttaactgcttgcagacttttcacgcatggaagatgaagaaagcttcttttgatgaagtgtaattatgtccaaacagagctgaccccctccccctatatttcttatgatcttaactgaagaaagtaggatttttcctttgaagcagccgggacttggtggaggatctgaaatgctacagtctgctgccagaggcaggatggagaaattggtccagacttgtcttcaagacttagatggggggtagggggagtgggtggagagagaaagaaaaattgatttatcactaataatatatttttatatcactgcattaacattgtatgaaaggaaacagtaatatcaagctgagatgaagaggaaaaaaggacagagaacactgataacagatcacactctgaaaaaaaaatgggtcagtttttcagtggcaggaaaccctttaacctgcctttgtaccctttgtacctgacctgctttataacagactcttccagcttcctctttgattttcacacttctacatttctcttaagctattaagtctggatcaacatgctgctaccattgtattttctttcccggctttaaatatttctattttcagtagtgttataaaaaaacaccaagttcctcaaatattgcacttttttttttctttccactggtagaaacataaactctcagaaactgaaaaacaatcttagattataaaggagtcatgtcactactgactttgactttatgggtcatcttatgaccacaacttttgaaagtgctagaataaaagtagagcatcagtggaacttgcattaagttaggagaggcttaaggtttttcatggtttttccttttttttatccttaatcttttaaagagaagtgtttaaaatgattttggtccttaaatttttttttggtatgctttctttttcctgatgaagccatggatgacacaattagttatctactgactgctagctccctatttgagagcctacattttaaaataacaggctgtattttatcacttatggaaagtgataaaaaggggatttttgagaaaaaattaatttaaggaaatcatgaatgcccacataaacatttgacttaagaggtgcattattattataggatgaagaaccaattactaaattggttggtaatttctgaaaatttcttcaacattgcatacatatttcttctgaaggggcaataagaagcagaaggagcctcattcacttttgctgtagttgttaattacatcttgatccttagggtctgattttggcagatcatagttatacttaactacttgtttcctcccccaaacccatctctttttaaaagcagttttttatagagaactcattctactctgaaaatttaaatgctttatacttgaagggtgaattttatttttggcttttgttcctacatgaggcgtcaccctgaatttaggggaagcatagatgacttttaatatcctaagtaagttgtaaaggtctcaagtagaactgttaccaaaactggtttaaataaatttatggacaatctattttatctttttttcttttttgagatggagtctcactctgccacccaggctggagtgcggtggcaccatctcggctcactataacctccgcctcctgagttcaagtgattcttgtgcctcagcctcttgagtagctgggattacaggcgtgcgtcaccacgcccagctaatttttatatttttagtagagacagggtttcaccaggttggccaggctagtcttgaactcctgacctcaggcgatctgccctcctccacctcccaaagtgttgggattacaggcgtgagccaccgcgcccagccgacaatctttctaccaggttatttagagacattaaggataactgagatctgtatatatccttgatttattaagatgagtgccatagatgaaaactgactctgaaacacagccatgggagccactgttagaaaggcaatcctgggcccatagaccactaatctgaccccaaaatggcactttaaaatgttttagtgtaaattaactttcaatctagagattcagctcttttactttttgcgatctttccattgttttgaggttctaacttggacccagtggcttcctattcaagtttctggtttctaattctgtaggcttttagttttctgtaactagtttagactcctggctggtttattcttctggttagtcttaacgtttataataaagcctctctttgctaaccaattataaattatttaaatccgtgtaatagccaatatagtggataaaatatatcaatgacactttaaaaatagatgctttcatcatcctgagatattgcattagtccatttatgtttactgtttcttgggcacatagagctgattgggacgcatctagaaataaattacttattaatttttttaaatggcaagtgatcaagccacttaaggaagtggccaagtgacagaatatttaaaaaaaaaagagcattaattttagggtctgaaaaatgaggttcagatcttcattttttcatttattagttgtatgaacttgggtaaattactaagtctcttgaggcttcagcctccttatttgtgcaatgggggtgagagatctaagcggggaggattaattgagataatgtgtatgaagtggcacttaatatgtttctaattgttattcacctttccctattcaaactgcacccaccccattcctgtcttttctttcctgtttttttccccttggctatagaaaagtatagccaaggagacttaaaactatttatactcagtaacaaatgatgtgcgtcttaaacagattttaggaacttacatggtctaggttgaaaagaaaacccattcactagacttgacagccaaagacctgttctccattaagccttgtatataacctgttccatattaagctttgaaaagactgcattaaactttgcattggtgcatattgtcaaagatttgtgttttggtttaatactctcagttttcagtaagggaaaaagaatctctgaccaaaaaacaaagcaaaacaaaatgagctttttaaaggtctgttacaggagcagactgaatgagtactctggcctgagattgctgaatgttttattgagtcactgtttcacgcccacctcttcctgtcttgtaacagtttgcagttttgactatctgacatgattaaccgttgcaaatctaactgattacaactgttagtaagtctgtgcaacagagaatggtatcttcttctggagaaaacagacatccaaatatgctaccaaacttttccctgtctcttttccccttcttattcgtcgcttttagctcattaatttgaagcatcagatgtaatatttcaatgaagcacaccttctgctaaaagcaaaatttgagtttatactgagagatgtcatgttcatttagcaaaaagtaagtcgctgtcagggggttatttcaagatttaacagcaaggatgtatgttaggggaggggtggacagggaggagaaaaactttgttccagtaatgatgaaatcatcataccacaggcacattacggccaggacaggagacactggctcctgttaaaatgattcccataagaactttcctcttttatcttcttattgtagtgcagctaagcaaatgaaatgctaaagctatgtgaagtaaataacataatcaacaatgatttactattgttctctcgtgaggtcatgacccaaccctaaataaagacttctaaaattgtctgtgcttggatgtgttcctgatgttggagaaaactgaaagaaaaagaaccttcctcaagtggaccagggttttgttttcattacaactgttgctactgaggagcttttttggaattggagtcttcctgtgtagcactacaatgaggacgatgatcttgactctaagcaaatttggaaatgtcctaaagtggtcatcggagggtttccaatttagaagaaggagtcctgcctcttgtctttgtttcattgcctccttagagatgcttaaatgcaatttggaaatctatgctgctgtgtaatcatcaacactgttttttaatattcactgtatattttccccttttatatctgcaggcaagagtttcaccttgaccataaccgtcttcacaaatcctccccaagtagctacctatcacagagcaattaaagttacagtagatggacctcgggaacccagaagtaagtactcccctttttattgaagaaagtaatagagtttccagagaccctatgaggaatttattccaaatgagttagtgtcactttcatgtccatagtgtctttgtggactttgctatctgcatatattttttttagtgagggagagttagtcaaacttcagagttagtagaaaataaaactacggttttaacctttgccacacaatcactaaggcctccgtagctttgggaaatgagtgaataattattcagtcactgttaactatttgctaagaaattttgctcatgtactgaacataatggggcagaatagacccatgagagctgaggaagaaaagagcaaacttaaaaatcttgagcttagtcaaaaagcactggcatgtgtttcccatggcctaagaatgtgttttagctttttaactcgcccactcaattccctttatgaagagcacactgcttaattacaaagaatttatttgcaaatgataacttgcttgattgttacaacactgttgtttggtcatgctctagtaattgttataggtagttttcttttaacagatagagtcaaaccacgtttaaatccatcttggtttatttgtctgtctggacatccagaaggtttcaccggcaatcagtttcaggtagcgcacataatctacttgggccaatatgtatgttccttctaaatctaaaatgaccgaggtttgcttcccccacccccaccaaaaaactgctttgaacaaactcagcatagcggtatttgaatatatttagagattaaagattatttgatatataaaccattaacaattgtgtgccaatggaaacatcatatagaactctgcctttgctgagtgaatacattggaatcctaaccactgcatttagggaggtcagtttggtttgtggtggaggcatagctggcagaagtacttgttctataacaatcaacctgcatagaccatgagagtggcatatcttttcttcccctaaaatgagagaaaaggtctcataaagttttgcctctacccaagcagcataccttcctagcagtgggagcatatggtgggtcccgtcccttttgctgctgtctcttttcacaaaggctgactgcttgcctgaactagggaggtttcctgcctcaaaagcaagtctttgaggtttttgttttcttctcctttcatgtgtgtggcattcttccaggttcataatgttgagtcagtgctggccctgtctgttcagtttgggaatgtcctgttaggtgattgctgtacacatgtgtgtaagcaccaagtctctagtcctaagggctagtggttatggagtgcaggtgaatagaacagagctttgcctggtttggggctttgcctgccttttctggatagccataagttggggatgatgccttatgatggaagatgtcttctaacttttggtcagactagccccggaattcctgaaaaggcaggacgtccattttagtaatgcacatagcaggatagttggtttttaaaatgtagcaccgctaatacttatctcttaaagatatttcctgctgatctcagctgcttttctcagttcttggaaaaaccatttgcgtgtgtttgtgtgcgtgtgtgtgtgtgtgtatgtgtgtgtgtatgtttgtgtgtgtatatgtgtacatacacacaagagttgatgctcaaaagttgatggctgggagaggaaagagggaaggataggtgctccctgttctgaacgatatgacaataagtgagaaggcagggtagctttggaaaagtcacttctgtttcaagtgtgcatagcagtaccttatttcagagaggtttttgtccaaattagtcaatagactaatttgtaaaggcagagaattgccttgtaaaggcagagaagtgctctgaaagcagtgagagttaggagtagaggggccaggtggtatacgtgggacctgagttcaagctttgtgtggtgcccagggtgggcggtggaagcagatacagatctgcaagtggtaggccacctgccctagataagcctgagtaacatttcttattaactgaaaatatcggtgaaaatgcggggtcattttcctgacatcatagggtgacttgacgaagtcagtgtctggagagaagcatgggtctgctttgagcgacagctgaatcctataacctggattctgtgctggattatttttttcctccctgttcttggccatcctgggcattgaatatttgtagcatagccctcttctcaatatggttctttaattttgacactcccaggtgtgggaaatgcacaatatttccaattttcttaaacagtgagtataataggagtttgattagttggtgcatataatgttaaatgggagatcctctagaacacagactggcacacgttttctacggagtgccagatagcaaatcctttagactctgtgggccgtatggtggtctctgtcacaaccactcaactctgccattgtagctcaaaagcagcataagcaaatacatacattcatggtcatggctatacaggttgagtatcccttatccaaaatgcttgggaccagaagtgtttcggatttcaattttttttttttaatttttggaatatttgcgtatataatgagataccttggggatgagacccaaatctaaacatgaaattcatgtatgtttcatatacaccttatgcacacagtttgaagataattttatacaatatgtaaataatttcgtggaagaaacaaagtttgtgttatgtacttatgtgtggaattttctacttgtggcatcatattggtgctcaaaactttcagattttggagcatttcggattttcagattaaggatactcgatctgtattccactaaaattttacttataaaaataattggtgggccaagttgtagtttgtcaacccttgcttattcaaagtggcttattttattgatccttaacagagaagggctttagtaaaaggctttcctggggcagtgttggggcagggggagtggaacaatttatatgcaattgtttagcctcctctcccccaaattataattccttaattagtggttattagtcataaaagtagtatacttctgtttatcacttatagtggcttgaagttgaggattttgtactatcggttcctgttgttggaatttcactccttcctctaaagatctgaatatatattgaaaagcctgcttctggtagctcagctgtttgaacaaggacaaattctgggttaactggttgggtctttatgtcggactgcttggatcgaaatcccaactccatcatttattaactgtatggaggcaggcaagttacctaacttctctttgccttggttttctcatcttttatgtgagaatgataataccttcctcatcagttgctgcaagaatgttaaatattgtaatgtatgtaaaatgggtagcacagtgactgtcatgtagtaagtgttcattaagtgtcagctattattacatcaattttctttagtgtcagacgttggctgtagagttttgcttatggtatgcctctaggaaacagataacatctatagattctgttctctagtatattacttttttccccctgcagatgactttactaatttttgctcattagtaaatgacactaataagtattataaattatgcctgagcagatattcatgctcctcagggaaagctgtgcagaactgatgataaatttaatttgtttgcagcaaagtccaagagcagatgctatggcactagtaccccactgtgaggccttgcctatcaacacatctgccaagacttgcttttcactcaaaaatccaaaaggtttcatccttctatgttttctgtctctggcagctgaaccagtgctgtcacatcacaaacaacttcttttcttaatatacacatctggcgttggcagttggactaacttcataagagcacatgatcatcactcattacaagattaaaaagtaccctatggcatcattgatgttttttaactttgatcttttgcagttgtgattcatctcggttataaaacttccctttaaaggaacatagccgatgacttattagaaccttcatcttaagtagcgtaaacatgaaaatggtacacatctttacaaaatgccatttattttctttgccagcttatcattttaagacatgacatcatacttaagatcccaaatttgtaagtcttgtgtttaggcaaggcattttgaccttctgttggcaagctagctctgaagaacaactgtcagccggagaagtggtgtagcagcagcagcaatagtaatgcatttagatacctagctctttgaaacatcggtttctattaggatcccttgttccatctgtggacttggttccacctccagtctgatttaaataatttctacaggaatgtgaaaacttggttagcaacatcatattctatagaagtggttcagagttagggaagaggactgatgggagaaggtattatttgttgtgcagaggatggaaaaagtaaataagcttacataggatactttaaattctcttgctgtattttttagttgtctattactaaataataaactaccctcgaatataacatccagtttattatttcttatgattctgtgggttgattggggttcatctggatggtttttctatttgtcaggcttggggtctatcatgtagctgcaatcagatagtggctggtgctggaacatcccacatgcttcatttatgtgtctgatgccttggtgggatggctgcatggttgggctcagctggaatgatgcaacagcaggccccactgcatctctttccatataatcctggatcctcttcctctccacgtggcctctccatgtggtctttcccgctgagtctgacttctcacatggcggcagctcagggctccctaaggtacaaaagtgagagttctcaggccttgctttttttttttttttttttttttttttgagatgaggtcttgccctgtcatccaggctggagtacagtgccatgatcatagctaactccaacctcaaactcctgggctcaagtgatccatcctctcacctcagcctcctgagtagctgggactacaagtaagtgccactatacctggctaatgtttacattttttgtagagatggggtctcactatgtttcctaggctggtcttgaactcctggcctcaagtgatcctcctgctttggcctcctgagcagctggaattataggtgtgagccactgcacccaaggatgttgggccttcttaaggattaggctcagaactggcatggaattgcttcctctagatttgattggttgaagcaagacacaggtgcagcctggatttaagggaaaaaaaccaccaatggtgtgaatgttgggggatgtggttcatgacaccaatgtcatcaacttacataagtgcttagctggcagttgtcattgtcacaacaggaaaaataattcttttcaaggtgccatcttctgaaaggactcttggctttttcaatctaggggacattcaaagaaaatactccaaatttactagtctaatcgtagtgtcattctgaattgaacagatttggtaaatatcagatgaattagtggtgggtattcccttgtggtgcttggtattagcagatcactactcaagtgagaagaacattagatgtttgaacaaaaagaagtatgagccttgcccagcaacatgacaagtctgtagcagaaatatcttatgaatcctcagatggttaagattagaggttttttttcaatttttaaaattttttttcgagatggagtggcatgatcttgatctaggctcactgcaacctccatcttccagattcaagcaattaccctgcctcagcctcccaaatagctaggattacaggtgtgtaccaccatgcctggctaatttttatatttttagtagagacgggattttgccatgttggccgactgatatcgacctcctgacctcaggtgatctgcccgcctcggcctcccaaagtgctgggattacaggcgtgagccactgcgcctggccaagattagaggttttatactttgtatcatccaactttgaaattcttgcttgctggcaccttggcaaacctactgcctgacacatgtgagtgggtttctaaaaatttttgtgtgtcgggtctcaggtaggtaaaccatatttactctcaaggagagaccaaagctgtgaattgtgtacttcctgccagggcactggcattcaccactgatcagccagccacctgtctcaacctggtgggaaaaaggagaagctctgcctttttccctccggtgatctagctcctttcttgcaagctcagagtacatggctgcaacatttctctgcttgtctttgtgtgtagcttcagtaagggtctggggcttaggttagtgagaggttatctggaagtatagggtactgttggtatttctaggcttgccttagtatcctgcttcactcagcttgttaggcttaggtcctgcagctaaactattttcttttcctgtttgcttattctcagttgtgcccaattcatcaacaaatctgtaattgttcagagaagttttatttctctgtatttttgaggcatgtccaattgcagaagttttaccttaacaaacttgagtgaacagacttaacgaaacaggtggtgtaggcaagacatcatctcatttttctcttacgctgttccacctagttctgggactgctttccagcctggtgaagggtggagagaatggaggggttgacatttttctcttcctcattccagctgatgtcagcggcagctcacttttatcctccattacttttcatcttagttgggtgaaggaatagactttttatgccaaaggctagcccatgacttttgcttatttaccaaaagaggatgcttattttattttattttatttcagatggagtcttgctctgtctcccaggctggagtgcagtggcgggatctcggctcactgcaacctccacctcctgggttcaagcgattctcctgcctcagcctcctgagtagctgggattacaagtgtgtgccaccacacctggctaattttttgtatttttagtggagacgggatttcaccatgttggccaggctggtctcaaactcctgacctggtgattcacccgcctcagcttcccaaaatgttgggattataggtgtgagccaccgcgcccggcccaggaagatgcttatttagagattggtcacatgtgaaataaggtgagggtacatgtaaaatatgttggatagagggacagcagatgtattttttaagattatttgattcttctggacacagttcttgcattcacattcttgcagtctgtgaggatgatttgaaaaaaccttgatagcctttgtgccatgccccagatgctgcaggcctgggttttagtccttagcacaaagcattagtagagaagcccttaacttcctgactttcagacttcccctgggttcttcactgtctccgaagtgcccaaggaatagaatttatgggtaaatgccatgttttgatatttacaagttggcaaatacaagcagcaatttgattgtcatagatattaatcacttggctaccagtatataaaacatcgttgaaaatctttaacttaagagaataataacagtaagaaaaccccactgttctctgtttccctttcttcaagaaggatgaggggggcggggggatgggtcagaagcgctggtggaggttatgtctggtggttggtggaatgtgctcttgagaagaccagttttaaatatctttcagtcctttttttttgttgactggctgtcaggagctgggaagatagccaagaaggaaatgacacatcgagaggcattttgtgttgtgcaacattctgtggaactgatgcaaggatatatggcctgtttacacattccttcgctcgcagactgcatggcagtaatttaattcagcagcacatggcatgctgcagcaaggagctatggcattaacatcctttcatggcaaattatcacagccgttaaaacatgctcgtgtccctcctttgcactcttccctggcttcccagctctgaatatgcgttttcattgtattggacttgtgttaacaaggtgctgtagctttcacagcaagagcacagtttccacatgcatatgttccagttgatatatttacttctaactaaatatagcatggcaagttttcaagtgatatgtgttctaaaaacacatacatgcttgatccaaatgtgtcagtagtttgtatcttagtgtaagtcagagatcattcattctgaaaatagtgttagggacttgacagggacttgagagaaagaggttcccctccccccctttttttgtctctcttttttttttttttaaataataatgacctttcgttctcaagaaagataattcctgatagatcactgaaatattctgttcacctctattttgtttgtgccatggcaatttcttcaaggaagactagaccagtgaataggacatacttaaaaatagcagggaaaaaaaagatttgttgtattgcttttcccattcatacctgtccatacctagcatttttataggatacatttatgatgtcaactaaagaacatctttggccttcacataaaatctctaaagtttttatttaagcaggtataaaaaataattaattgctcttgtttgttcaagtaattttggaaattaagaaaaggcataaaaaccatttaggtctaaaatattaattcaagatcatatgtaacagttaaaataaaagactgtgtttgtaagtagcaaaggaagggctccagttctcataatttctctgctactgcacactggtggtgaaaatctatttgttggaagaccaaaactcttcattaaaatttaggtttaaggcttaaacccaagcacccctggaaaaggtaactcagacttaaattcttattaagataaaaacaagtgacatagaatcattttttgggaagtaggttttggaagataggggaggagtggtcagtgaaatcctgggtactagaaagtaaacagtgagtggcagtgtgcagcaggcaggacctttgccggccttgaggccagtggttgccaacttcaggcatcacagttttgctgcaggtcaactgtagcaatgagcattcctgatgctttccagttctgatatactcttaagagtgcaagattttgttattgaaaggtgagagttttagggttctgtatttccatatctctctcttttgcaaatgttttcctttcagagtattccttttctgttgttctagatacatgctagctttcctactctattggtttgcaagttatcattgaatgtgtttcttttattttagtattatctttaccattttaatatgtatatttgtcttattaaaattaatcatgatctctgtccatacaagaactttagcattctttaaactgcagtctcaccccctctcttctaatgtcgttatctgatattttagtagatccttgttttatatttcctggattagtcattatcggtgtttaaaaaatgtttatacttgtatttatccattatgtttattgattcatttgcttatcattccttctttcaccttagttcttccttttaagttgagtttgcttttttcttgatgtagatccttcagtaattccttcaatgagaaactgttagtgtgaaactctcagagagtttttattcctgaaaatgttagcagttgtgtgtgttagctgctgccaacatgcggtgatgtgagaggcgttctgctgaaagcctgtctgctttgagtgcctgagatccacacttccagtcattcctttgtattgaaactttcaggtcattattatcaggttagctggagtagtatttaaggaaatggaacacaggacagataatattcatgaaagatggtggaagggaaatgtttctaagctcctgtcactctggagaactctggagaggtctagggtcagtgagtggggaggaggtcagagggaatgttcctgcagaggagaaagcaaacggggaggaaattaaatcccttattttacacttttgccatgggcaggcactgagttgctttggaactttttatccaaatttatgttaaagaactccaccattacacttgctctgcagaggtcatgtggctgttgctccctgagcaaccggagcaggaatccttagatattggtgtccacacgtttctgtcattttggtgagagtacaggactcagaaccacaagagctgtcttttgtagggtaaacgaatcaacgaattaagaagagggaagaaaataatgtgtggactagaggaacatggtttaaaagggccaggagaccacgatctggggtgagactagctctgggcaaggtggatggggtgactccagtgctggctcggtgtgtgtcttcctggggttgtgcagtagttggcaggtggggaagacatcagatgacactgaagcaagctggtgctttctgccttgccgtgaactctcagaatgcatatgcaccctccacaacatgcattctcatcttctcatttacctccttggagttaaattttatgagatacaatctgggtaaaaacgctagcatgtattttggttgcgggggatactcaggatgattaatctgggccttatgcctccttaggattggcccaggaaattattagtaggcaaagatgggcccttcaaggagatgatgaaggtaccaaatgcaggttgttctacaagaagtgaggagaaatatagatgtgtaaaaagaagggtgagtgtgaagtctgggttactaattctagagctttggtttctgtttcaccccctcactgtttactccagcctacaaaaacaagtgacaatgtgttttctaccatgaaggctatttcagagtagcttaacagggaattaatctgtaagggtagtttgtgtttaagaggtggattcccttatggctaaggggattggaggactcaggaattcttcttttgagacctcattgccatctttgtgaccttaagcaaaccactaaacttttctctacttctatttcttcatctttcaaatggaaatagacatgaaggcaacttcacaaagtagctgggagtaactcctaaggaatgatcataaagtacttggcacacatgaagggcagcttaaataccaattagtaattatgtagcgcctttctgccaaggagttccaaatgcttagacattacctcagtgattctctgtacatctctctgagggaggcgttatgcattttacacataggtaaactgaggcatggacacctgagaactcatttgtcctatgttactctgcaagtcagcagatgatttatagagacaggcaaggattccagatattttcctgtttatcctgttgccgtttgtcaagtctgtgtaagtgttgggcccaggggattcttggttgatgtgatgaagcagtgttacataagaagcatgcttaatgctgcagtagcatcgctgaatagtacagaagtcaaagttataaggcctggcacagagtgggcatgcagttcatggacataggcatgtttgttgaatgagtattgaattcattttaacagctgaaaacactgaattttgtgagatgaaaataatacattgtataacttaacctcaatagaatcttactttgaataccagtgaaatgaatttagtacttaaaaaaaattaactttaaaaaattgcacaagtgaaaaaattgcacactagaaaataaaaactaataataacaaagaagaagacagagatcactcataattgcatctcccaagattaccactactaacatcgtgatgtgtatctcccagatattctgtgatagataatgctggtactgttatgaaagataacagaagttggggaaataacatcaggaaaatgatggaatgctacagaatggcatgaccacattgaagctcaaaggagagcgaataactggaaatgaggataattgctgtaaggaaaaggagcatgacaatagaaccgacaattgtttccagttaatggctgcctctgtgatgtgaagggcctgtgctgcctgaatgatgtgggactagatggatctgagaaagatccgttcctcccccaaccctgtcccaccactgaaaataccatctccctttaaaatagctgacagagccttttttttggtgacaattagagatgtgttttaaaatgtaaatatttccggcatgggaacatttattcattcaaaaaattacttttgagtgcttactgttagccaggtgccaggcaggcgtgatcctccctttgaggagcctacattctgtagagaaaaaaggcaagaaacaagtaaacaaacatttctctataatcacatctaattgcaaattgtgataagtgctgtaaagggaactgatgtcatagtaaagagtaatggagtgggagggaacaggatggaacctattgaagagtggtccaaggaaggcctgtctggggagatgacatcggagcacagacctaaagggtgagaagaagccagtttgaggaagagttgggggaagagacatcaaggcaaaaggtacattgtgtgcaaaccttgaacacagtcagtatcagaatctaatatctaattttgcaaggtgagagggcattagcaatgcctacatggttgggaagaggttgcaaaaaaagtagactggactcacacacccaaaagtggctgtttataattgtacccaaggctggtgtggtgtaattagaggagcacaaaaggactcttcatgttcatccctcctggccccaaaccactctcttatcattctcaccaggtgcctgagattcttcttcgagttaaggcttcgaggacaggatgttcatagatgttatctacaaaggataacacattctaagccatttttggtgaacaacttggtttaaataagtgaatcaaatcagattagctagatacttattttatagcagaggaccacaagacccaaattggtagggaaagcaggttgagaaagaccttgaagagctctggtgagaaaaatcgagtgggaggaggtggagggggaatggcttgtctgtagctggggctccgtaagaattctgggtcccgaataacatgttttcttagatgaagagcaataggagtgggcttgtactaaaaataacccaaacaaagctgtaggctacctatataagtagattctcttaggactatgtatcatgcagtaaagccttggcttatgtggacaatgagaagcaatcccgaaggtgatctgggtttcaaaacataagagcaacatggaaaacttcagaatgtttagcgaagagcattgatgatgattaaaggcttgtaaaattgaacctatgaggataagttgaaagacttgggatcgtttagcttcaagaagaggagactgaaaaatgacttaataacagactcaaaattatgagagttattaagctatgtatggtgaccagctgttttgtttctggcaaggtcagagaaagaataggtttcaactgaattaggttagatttaaagaagaacttcttgactataagaattgttaaatagtacaggttgctgaaggatgagggcttgaatggagggcttttcaaataccttccattttagtgattctctgtgtgtttataaagtgcaacaaagtgccacctttctgctttcaaaatcaaaggcatgatttctgttttccattataattctgaagctcagactcgcagaggtttgtggacataaataatgagggtaatttgtcttgactctgtggccattagaatctttaattgagaaaaatatgaccaaaaagagaaacagatctgccatatgatcaaaaaattgttactgataatcagaataggtgcattattaattttggactgagggggataatgttttattgttagaaaaacccacgttcatttgatttgtatattccagatagaaaaggtagggggctttatgaaattgattcatttttgtctgttcctccctatggggagaaattaaaaacatttccaggtgacaccaaagttcgtataacctggagcttgagtgatgcaatccaaaaatcaacctcaaggaatttattgtcacagggaaggaaacagagaggaaataggcaggatttatttctgaaaacagaaaccttcatgcatttaaagactggcagagaagtgaagttgagcagagcaagtctgagaaaggctggctgaacacaccattcctttcagctttggagctggagctgcaggaaagaaagagccctgttttcagggttaacttttcttggagaagccaagcatcagagtttgtatttttaagtttattttttaattcattcttttgcttattaaatacctgtctgagcaacttttgtaataattaattagtacacctgcacatggtttgctttaagcactcactgatagctcattgatgaaacgatgagaaacaaagcatgtacacacacacacagacacacacatgcacacgagcacagtgttttagatgagttcttgttttgaactaagtgcatacaattttctctaagggaaaaaaataatcaagagaccaaagaaacagacttcgaaacaggtgacacaacaaggaagaaggctgagtgggtgtggtgccaggctaggggaaaggaaaaatactcagaaagcctatttttctttcctcccaaaataacttgggctccatggctcattaagaacatttagacccttagccactacactttacccttccaaagcaccatcactggtggagaaccacccacagttgaagatgggtcagaagtcacaacttgctttcttccactgccctcctttcttcattgtccatgacattttcttagtggtccttggcacttctgatgtccttcttatgatttttacatttgggtctcccccacctctccccccaagatgatttattttcaaacctcttctaaagatttgtaaaagctacagctgtctcttcatgggaaaagccaacctaaaggggattagtggccctccttttttgctgtgaggccacaggattgatagtgggaaggaaaatcagctggagagaggtttggtttcctcctgttgtttatctttataaaaaagaaccctcttctcaaacacgttgctataggaaaggtctcttcattacctatgtggggacagtggagggccagttccatattttctgcagtaactgaggctggctctgttttcctgaggaataagctgtgaaactgaggatatactaggttatctgaagcaacagaacacccactggtatacccacaaaaagtgtttgattatctgttctcccctgaggactttacttaagacttataaaccagtctccctttccttaagaggtactgtgatagagacagagtgagagctttcagtggtcagggctttctagaaggctggacacatggccatgataatgcctaaagcacaatcaagaaggatggaggcttttatgaaggtcttgagattcaaagggaacaaaagtggatggtttggagagtgtgtcagtgaaggtcctgtgctttgatcatgtctcaggagattccccacattgactctctttgggtatttatgaaagtctacattgttggcacagatctgatatagcaaggaaatttgctggggccagggatccaagagtttttggattgtataattaggaaagcattgatggtccaaaacgcaggatgaacattcattttattttttacagaacatatttttgtcccctttctgtatattatatattggttctatattttgtgagacctggtgcagcagttccttggtagagccaaatagcctgaatgaagagaaggagagatgcctcttcctttgctttcattctagattgtgttggagctatgctgaggatggtgaatagagaaactgattgtagttaatttgtcacctcgtagcccagtggtagcatttgaatggaagtaagttaatggaaaaggactttgcaagacataccagccccaaccactcattcttgctgagggtcaacccactgtcagatataggtggagaagcccttctgtggtatggaggcaccatttctttattctcttgttaggaaaactgaaatataaataaataaaaatttgcaactgaattggaaaaaatctgacactgaaggatgaaatgtagctttcgtagcatgagatttgtggcacaaactgaccagaggaaggaaatctgatgatctagatagatgcctttggttattaccacttttgctaaatgcctctctgctaagaactcaacaggatgagtcatctcttagctgtaaacaaaaacttttatggggaagggagaaatccttgtgtttgaaggaataggtggcatttccggctaatttataaatgtctcctttcattcctttctaaattgggacaaattgctccaaaaagtctatcagaagattatgtatgtatgtaggtatttatctatgtatgtgtgtgtgtatgtacttttgttacagcaatgaggtcctccagctgaaccatagctgagttctattcctacttctattcctggtgctatttggtcagttcttagaatggattttgatagttttcacttcaggaaaacacagtctcaggccgggcatgctggctcatgcctgtaatcccagtactttgggaggctgaggcaggtggatcacttgaggtcaggagttcgagaccagccttgccaacatagtgaaaccccgtctctactaaaaatataaaaatttgctgggcatggtggcaggcgactgtagtcccaactacttaggaggttgaggcaggagaatcgcttgaacctgggaggtggaggctgcagtgagccgagatcgtgccattgcactccagcctgggcgacagtgagactttgggaagaaaaaaaagaaaagaaaacatagtctcaccgttctcctccacataaatgtggccaggctgttggaaagctcgtggtttagaaattatttaaaacaactgcgttagaaaatattatttgtacaatagcatcttaaatcccaagacctctatacaacttacaaagtaactgtagaaattcagggaaattcttcttttttaagttttatttcatttttaattgacaaataattatattccagtaaaattctaatgttgatatttagatgcttttgttcttggtgagcttggtaattaaaagaaggtaattttaggaaagaaaatcagctttaataacgtatccatattgtttatttctacgttaattgagcaaacatttgcaccatggctgctctgtccagggcttttgagaatgctaagtgctgctgaaataactttgagagtctaacttgaaagggcctccagcagaattgagtataaacccgagattagcacccgtaaaggtccataaagggcttaatttgtagtccttttatttatctttagcacagtgtgaagtgtgatggactagggtggaaggtgaaggagcaaggtaaagagagactcccgtgacaatcagcaatacgcctttaagttcattgggctttgcttatctttactaagccatcttttcttcttagagaaactgcaattattattggtcacaagaaatgaatattctcatgtaccttacaggatttgtttatcctgttagtctttaatagcattgtagataaatgccctgccattgtagagaggtaatcatacttttagtttttgataatttagattatgtggaaaaaattctgttttggtgaaaatacgacattgttaggactagtaacaaaagcatatatatgatgctcagtgctgccaattatttctttttacatttgaaataacatttacttaatttaattagtatacaggaagatctgttgtaaacatttcagaaaattcagaaagcattgaaaaaaaggtaaaaagtcatttgaaactcaacaccaaagataatctcagttaatattttgacataattccttttactactttttcctaaatgtatttgtatgtatgaatatatattcacatatactttttattttatacatttttgcattttctaaactgattttattttttaattattcaaaggaattgactgacctataccctgagtcttaatcgcaaaatggtaaatcctgttcgattaaaaatgaacattttgaaaattgatttacaaaaattggtataaaatctattcctttaaaaacattacagcccactgcattattttctgatatggttgcctgcctcagaagacaactcatatgaagtgtacattcttctccttgcttttcttcttgtctcttttttccttttatctctgttctgttttataggtgctcacaagatgtttggtatgctaatcgaataagaatatgctatgttgggcactctaagcatgctttgagggtctcttgggtttcctcttcagacttcctcaaggctccatctctttatgtcatcttttggagtggcttatgtataccttagcaaaggatgctcagacctgccctatgggctgggttttcagaaaataatatattctgtatttgcatagcatacaaagtttgtaataacattgatgacttcacaacaactctgtaaagcagacagagaagatgccctttttcaagtgataaagaaggctggagaaattagagaacttgcccaggatcacacatctgtgttgaacatttcatatttgaaattggttagtatgattcaaatcaaattcaagttgaaaaaaggttcctgctgtgaatttgaagaaaaatgtgtaagatgtcactattttaccacatccaaaataatttcagattactctaactagaagctagccaatttttatatgcatttttttgggaggagggggcaaaagtaagtaggaatcagatacatgtgaagaaaaaaaaattcaaatcaattttgggggttacatagttgtagtttttgttctgaattgctctggtggaggatcaaagaaaagcagaattaatggagaaaaagagatatgtagaaaaaaagaaaacattgcctttttagtgtagcagcttgttcattactaaggatggaagggaaaggtaatgcttaacctttcccaacagaagaaggctgcaagtcagggcagggatggctgaatcagcaggtaaggtagttcttttttcctcctggaccatctccataggagatagggtgactggagaagggaaggtggaaggaagatcccatgtcagacaatgctttttcctatttttggaattctagaaacatgaaagatgagaggatgtagatttgaagactctaaaaatcctgaaaagtataacattttcagttcataagtatatctggaaaagaagaagcattcttcttggcacatgctttgccttaagctactaaaagtctacctgaaaatgcaatttgaattattattattttttattcaacgcttgtaaaaactaaagcagcctttctagtgtgacttttgacatcaaggaggctaagtgaagtagagaaaagtaggagactaggttggggaggctggcccatagaacaaagtagaagaaataagccagggcaatggcagcttggctgatgagagcctgggactgagtggaaaaacatagaggcccagtcagccattgtggttaaaagctttgtgaaaagtgtgcagaggtggctctaaaatgcatttgtctggttaatatgacaaggaagctcacaggcatatgaaggtttaacaggcaatgaaggctctctgacagtctatatgggatctaatcaaatgcaatgataaattctgggataggattttttttttttttttttttttgacagagtttcactcttgttgcctagcctggaggctggagtgcaatggcgcgatctcagctcactgcagcctccgcctcctgggttcaagagattctcctgcctcagcctcctgagtagctgggattacaggtgcctgccaccatgcctggctaatttttgtatttttagtagggacggggtttccccatgttggtcaggctggtctcaaactcccgacctcaggtgatccacccacctcagcctcccaaagtgctgggattacaggcatgagccaccgtgcccggcttggggtaggaaattaaaaacaaaaacagtgccaacttttaggcaatgaagagtatttgttaagcatcttacattcttgatgaaactacctagagtctgtgtttcacttttgtaacattgagaaatcagatagaaatattgggttactaaggaatcagctgtgacaattttgataaactatacatttattccgtgtcaccaatgtgttaactggcaaatacattatgatctccttcagtttctaatcctttttgccaagtaaataaattaaatcaacaataaaattttgattatttttcctctctggtataagacatttcagtaaaaatatatgaaaaataaactgcgaatggaatcttccagttagctgaatggacctttcaaggttcatatattcattctacataaaactcatatgtaataatctgtggcaggagggaaaaagtggctctaagtatgatctggaaacatacagaacctcttgactccttcaaattcctgaggtgctcttttgttaatgtctctggtttcagagggcaaatgttatggatgcaaaacctcaaggtccacaatctgtcctcttggaaaaaacttgccaacagaaatgcgtagctgtattctctgtttctaaaacctgacagtaacctgaagctttgagccacttgccttcttccttcccctctcctgattaatttccttttccctgtgtgtatgtgacattaagcagcccttatttctgtctggatttcttgacatcccatattctctctttagtctcaacccttactcttctttcagttgaatttactttagcttgggttcttgccataaagaaccccagagcttgacatgtttatagttatttgtacacattcttatggtcacatacatcatgatcttccattttcagtatcaaaaaccgtattcccacagagcagagatataacagttaattttctttgtaaaaatcatagaattacctaaaaataactgaatatacttgaattgctgaatatacttgaaattctgatcctgcttttctctacgttgctcacatcaaccaggcagccacagtatttactgagcacctgctgtgtgcctacaagtatgccagctacacacaagtttggaatataaggcacaaagttttactttggaagaattaaaatatggtcctggagatagtgctataattaataaacaattagatggcactgtgtattcaattcggctatcacatgttcattctttcaacaagtgtttattgagccctgccatatgacagacattcttctatgtgttaggaatatagcctttaacaaaatgtacaaaattgtttccctcttggaacttgtgttctattgaaagagggagacaataagcaaacaaatgaatatatataatatgcaaatatgcagatagtgataagtactttaaagaaaaaagaaccagggtaaggggacagagggagggaggtggatgatttttcatgtaggtcagtcaggccttgctgatggggcaacatttgagcggaggcttgaattaaatagggagcgagccatctatcaatatctaggtagcagaatgtcaagagcaaaggcattgaggcccagctctttggcatggttatgggatagcaagcaggccagtgtggctgcagcagagtgagtgaatgggaaagtggtatgacatgaggccacagagatagttgggggcagagaatggtgcgtggaaggcacagatcaagtaggagctagaccatgagttggccttcaggctctaggtcaaatctggtgtggtatttaaagtcataggactggaataaataattttagatagagaagagggccaaggacagatccctgggggtaattctcaacattggaaatagggattaggaagaggagccaatgtgggaccctgagtaggtacaaccagtgagataggaagagtcccaaagaatgtggtattcaggcagcaaaggactctgttcaagaagaatgtcaccaactgtgtcaaattttgctgaccaaggactgtcattgagtttggcggtgtggaaggcattgatgatcttggcaaaaaagatgtcagtgcaaggatagattcaaaagatcatttgttgaaaattaagagaaatggaggctaggaggtgagtacaatgaatttagaaagtgaacacactttcaggatgtttaaagggagcagggaaatggggcagtaaccggaaggggatatggcataatggagctcttgtgctgaactgttaagaacgagtgacccttgagctgggtttggtggcatgcacctgtagtcccatctacttgggaggctgaggcaggaggatcacttgaggccaggagttcgaggctgtcatgtgctatgattgcacttgttaatagccactgcactccagcctgggcagtatagcaagaccccaactcttaaaaaaaaaaagagtgagtgacccttgacaaaccactttgtctctcagagccttggcatcttcagcagaaaaatagaaatataataacacctacctataatggttattttagaggatagtgtatagtaaaattttgtcatttgtaaaatgcaacataaatgtaaaagtcatactatccttagcgtgtaatagaaattttgaaagaaagacaagatcacttggaggaaattaggtcctgaagaaaatggttatgatggattaggtggactgaaggcatgtgttacaggcacagggaagggaaagaccagggaatgtgaagaagtaagaacagctggtttggaacagaggatgaatgttggggagaagaggaaaatcacattgaataggtagaatcaggctaatgatgcagggctgtaaaagctattcagaaaagtctcagttaatggagcaggcagtagggtggcctcatgaactccccaacaagatagttgaagggagggctttggattgccacctgacagggaattacagggactggatccattctacctctgtccacagaagtgctccagtgttgtgaagcaacagagatattttgatttggtggggaaaacaagaggaaccaaatataaggaagacgtagaagggaagggatgtatagaggcaaagaagccagctggaaaagtactcgcacaaccccagtgtgatgagacccaggaaatatatatgccatttaaagtcagtatcaacatcatggagaaggaaagtgcaaaaggaaggaatgtcttaagatggggaaacactcatgaaatgagtctgaagtcaatcgacaagaatattaagcacctactatgtaccattgctgttcttggcactagtctgggcactcttctaagctctgttctaagcatggactacaaacatgcttaagggcaggaaatgtgtgggaggaagccaaatagtgatagaatgaggcttactattttttttttttgttttttgagggattaggtccattagattttgtatttcttcggtgcctactacataatttgctaagtgaattaatgatttttattaaatgaattatcgatattaattggttgctgcaacttttttttaaatgtgatttgacaatataaattactagctttaaaaatgttcccagggcagctgtggctagaacacatgaccagatttggcttgtccagctgctaaagaattctgtcaaatataagccccccagccattcgtgtgaccctcatacaaacaaataataaaaaagacattcagataaataaagcaaaatgtacagagaaaccctgattaaaaataaagagagaaaaaagaggttccattcctgacagtctgctttaaggaaattgccttaaatacatgaaaggatttagaatcaatgaggtgcactgcagttatttatatccatatgttaagcaacccatgtttctacttctaattcagtgaaagtgctgcttggatcctttccagggaaataagaagggggcggcattggtactccaccgtttactcaacattaagctgatggggtatgacagttctgctattgcttctcattgacatcgatagtcttataggtcttatgtgtatctgtgggagggatgtataagaagaccacagaacattgtacctggagatttaggtgagaataaacagatacatgaataaatgagctctcaaactggctgaaaacaaaccttaagcatgaaataatgtgcttactaatttctgaactgtagttttgaataattcgtcagggctaggactctggttttaatgatttgtgtggtgaaaatatgccactattcacaatagagtttttaaaacagtatatttgtaattgatgttgttaaaatgacggacttgggtttgggttttaaagcacatgttcagtggttaagattaatttctagcaatggttttggaggttgaaatcaaagtgtgtacaaaagtaaacagttccctttcagagcaaataatttgaacttgaatgaaacttaagcaagtgagcatcaattgcaagttaattttgacatggatgtctggaaggcatcatcaattaccacagtgagtcgtagtgtagtattgtccctctgtgctcatgtgagtaaaggaacaagttgcttgtctaaccccagagttctgctggctgggcagaacctgaggctgaagttgtccccatctggccctatgtgaaggatgcatacagtggcacaggcacctttacagaccagcagccacttgggtatctgacctgaaaggagcacatcgcaggcagtttctctttctaccaaatattgatcaatgacttttaaaaagaaggagtctttaccaaatggtttagttcctgggtcacttttctttttggtcttgtaagcacaggaaataaaatacatgctgatactttccaatggaaataaaatgcataccattactctccaacagaaataaaatctttccatacagaaacaagaggaaaagtctgtacaaggaggcatttatatcatcctcaggcatattaaaaacagaatgaattgactaagacatcaaatattaaagtaatgttataaggtggaccatatgctaaatagactgccattaaggcattttaggtgaccttattattccaaaacaaggagatattttctttctagctggggagaaaaattctttccaactttagtctttatttcatttggtgtatgctggtttttttccttttgtcttgccagtagaactaaaactgatggattttctcagtgtaagtatgataatgtaaagcaaagaaatctatacagcgatactcaaatttgtttaaatgcttttttaaaaaaaatgaattctccctccttttatttttgttccctttttctttcagtttacttttccctggaaagaatagggtatctcagtttattcattattctgggtcagctttgagacagtacagtgagggatttgcatccagatctttactttgtcttggaaatacacatattaatggaaatgtttctatcttcattaatttgtgagataagactaatttgacaatgagttggactcattgtggactgtgtttgaaattagaaaaatgttcacaacatcagccgggcacggtggctcacgcctgtaatcccagcacattgggaggctgaggcaggtgaatcacgaggtcaggagatcgagaccatcctggttaacacagtgaaaccccgtccctactaaaaatacaaaaaattagccaggcgtggtggcaggtgcctgtagtcccagctactcaggaggctgaggcaggagaatggcgtgaacccgggaggtggagcttgcagtgagccgagatcacgcccctgcattccagcctgggcgacagagcgagactccgtctaaaaaaaaaaaaaatgtttacaacatcagagacagtttggctcctaagtgatcatttattggttctctgtgtatcagggactgtgtcttttcacccttatgtgcaaggtcccagcccagtatctgtcaggtagtagttaacagtaaagttttcaaatgaataagtgaactgttaattgattgctaaacccaagacatttataccctaaatataaacttttttttttctttttagtgatgatgggctagaatgatgacatgagaataatgtaaagtgaaatacaaatcctttacttctttttgataagtgtcagcattctaaaactctatctacagtggcccttgggttgcatgagctgcttcaaaccagatttttctatctgttgctttactctctacagagctggaaaaaccagcttaggtcaatgtccgagcattatccaaaactcactttcttacagaaaacaaaggaatttcctctttcagaatctgtatatgattgagcagctaggtagcctgttcattcacttttctcattttaccctaatgaatattttcctatcagtcacatcagaagctgtcattttcataaccataggtatttaactgtgccttggtaggatttaagctttttaaagttgtctggacaaaccctctggtgggtgtgaatcacaatatctcttgatgcacagtgggattgtggcagctgcttaagtgtctggaacatttatctatcatatggccagttcactgctttcaaacacaaggaaactctgggagtggtgctgattcttgagtatatacaagatttgccatcttttgagccttataagaaaaaatgtttataagctggggaaatactttagaatttatatgtgactctttcttttgtctctgccatggttccttataaatcactcggtggctcagggagagcagtatgcttctgaaataaggttacctgctttttgatgtatttataagccttggccaatccatccatttcttgtaggcattccatagatactctgaaaactccaagttcctgttataatcccagaggatctttcagagacattgctcagcaagatcatctaagggcagtgaaatggaaatatgacaactcttatttcatccttctgaaatattaatccttcatggttaattatatgatattttgagggtgttctgcctggataataaatattattggtcaagagtcctattctcaaaggactctaattttagtactatgcataccttatataataaatattaatatttaattaatctgaacaagtataaacttttcagttaattaaaaagtggccttgtctagttgatatggtcatatggtcatatgatgttttagaaatttgccttctggtctgtatctgtaggaacttgatgaaaactacttaatttttctgtttttatttttatttttttctttttggttttttttttttagacaagatctcatttcaattgcccaggctggagttcagaagtacaattttggctcactgaagcctctaggctcaggtgattctcccacctcagcctcttgagtagctgggactacaggcacataccaccacgcctggctaatttttttttttttttgtatctttagtggagacagggtttcaccatgttgcccaggctggtttcgaactgctggacgcaagcaatacacccaccttggcctctcaaatttctgggattataggcgtgagcgactgtaccccgccctacttcttttttctatgccttagttccatgcctgctaaattgcagcagtagctctaatcttgagatgttaagaaaactaaaaataggccgagtgcagtggctcatgcctgtaatcccagcactttgggaagccgaggcgggcggatcacttgaggcggggagttcgagaccaacctggccaacatggtgaaatcctatctctactaaaaatacaaaaaaattagccgagtgtggtgggcgcctgtaatcctagctactcaggaggctgaggcaggagaatcgcttgaaccagggaggctgaggttgcagtgagccgagatcccgccattgcactccagcctgggcaacaagagtgaaactccgtcttaaaaaaaaaaagaaaactaaaaataataactaatattataaagtatttacgataaccctctgaggtactagtgtgatttcaatttaaatgtgaagaaaaaaatggggagaagttaggtagtgtgcccaagtcctcaaacccagtgacctgcagagtcaggattggaatccagcatcaacatccaagcctgagcccttgccaggctacaatacagctcccagtctggttgtgtgatgatctttcaggtctccaagaagggtggccaggatggcattgacatctcttcacaggtggccttggtgagagaccttccagtattctaatgctgtgtagtttttagtaggattccagtaggagtacgtaatttatcttttcccctctttctgtctcctggagagataaatcctatttccattaaacagatttttgttaggaatgcttcatttcttaaccagtgtaatttgtatgcctgagtagctcatcatagaaccttagagttgtaacaaaggctgctttgattcagttcatttattcgacagataagaaactgacaaacaattcctgcaatgctttaatatttatttggtcagattgtgctaaaacatccctttcctttcttactcttttgagatgatattttatttttcttgctcctaaccaccaaacttctggaaagagtcacttagacttgtcgccttcatttcctcattgcctactcacgctgagcctcctgcagtctggcttctgctcccacggcttgactgttgtcttgaaggttgcttagccatggtccatgccttactctggccgactttcagtcctcatgatccttggcctctttgcaggtataatcctgttggtgaccccttctgcctccatccttggtctcttccatatcatattctaattttctcctgcctgtatgactggtcctctttctcttttgctttatcttttatttatttatttatttacttttattttttgagacgaagtctccctctgtcgctcaggctggagtgcagtggcgtgatctcagctgactgcaacctctgcctcccgggttcaagcgattcacctacctcagcctcccaagtaactgggactacagacgcacaccaccacacctggctaatttgtgtatttttagtagaggtggggtttcactatgttggccaggctggtctcgaactcctgacctcaagtgatccacctgcttcggcctcccaaagtgttgggattataggcatgaaacactgcaccaggcctgctttatcttttagaaccgccacccccaccgcccccagccactcatctacctcctacaagtggacaaatggacattgccaaaagttctgacttggctttcctttcttcctgtttccttgcttgctcatcaaagacactatcatgtgagcagtcaccttgacttaatgaacaactcccaaatctttatctttcattctagccgtcttcaatgtcccatctcccttatgcctaaaactaatgccacaaaatccttttgatctttaaataatatatctctgtaaaaactaacctttccttaccttaatatagggaattgtagtgattaccaattattcttctagctaccagcctctttctccttaaagttcttttcatgcagtgctgtaactcagttttcctcgatctcagctttgatcatgtcaacctgaggccttcatgttgtgaaactctctgtggtgccccacatgctactcaaccaagtacaggcttctcaggctgtttccctatgcccagaataacttagcccagtcttatcattacaactgcagtcactttcttacacacattttagccccgtacttctcaaatgtattagggccaacacctcctttttgtaacgaatactcaataatctctctttactatcctcaatgaaatctgtagattttctaaatatatccacacaatttctgaaagatcactctgatgccattaccatagtataaaagaaaaataaaggaacctaatttaaaacaaaattatattcatatattttaatatctaaatacttagagaacatgctagaaaacacaatgaactagccagcttcttgaacatgtgtaaaaccaccttgaatatgacagctacaaatcaagattgatgcaggtgcatattagtaactcaaacactaagaatgatgttactgttagtgaagattttctgaaatgtagagcaactcttgttgaagctcctaatgaaacaaaatatgctttgtctttggtttctagatggttttattcctagaaaacccaatgtgttaaaactttagggaaaaaaatccctttatatttaagtagaactaggttctaggctcaggtaattataaccagattttttttcacctacttgaatgtctggtgtatgtcccaaaagtcatgaggaatgtggaaaaacttttcattctgtaggactgtcccattgcaggacaactggcatcattagcctatgcccaccagattacagctgcacacccccaatcatgtaacaatcaaaactgcctccacatatttcccaaactcccaaggagtttgtactacctgagctgagaaccactgctttagccaaactgctctcactgttggtgaacatgccttgccttttcccaattgcacatctcttttcatgtggcaccttttgatttgaatatatttctttcatttctgccttttgaaattttatctctttagcttgaatggcatacaccccattaaattttccttcagtctaaaattttgcagcatccagatgtggcacttagaattcttaaaacatactgcttcatgttagttatttgtgtacagctattacctaccagcttgtaaggtccttggggatatagaccctttatgttatttacatgttataagaggttatattccccagtgtttctattaatagcaaagtgtcttgcacatagtaggtgcccagtgaatgtttatcgggtaaatgaatggttaattttaaaagaatatttgtaaagaaaaaagaaaaggttggtttttattttaacatttaaaacttacttttgtttttataacatttacattttatcctcatgtcataaacttctaatagtacaaaataatatcagaaaagcacatagcctataggcctatggtttggtctgtacacatacttatgaatatgtgtccactggaattattattaaagataagatcattctctacacatagcaagaaccagcattcaaacactgtagagaaaatacggagaaagtgcttctttttcattcaattctgaaatgtacagatcaaatcaacttgtgaagtcaattgggatgcctgtacaatttccctgttttctccctttattcaaaaacctcaaaaccactatgggtaattccctcaagatctccttctaacacatagagtctaaagagtaagcgagatttccaagaactgaaagctttcaacttttttgagtatccctctccaatgacatgagctaggaaagcccagtgctcactccacccacctttcatctctaactagaggagcatcaagcatttgtgcagtctttcctgccatggcttcattttctgtcatcttaactccgtcacgaaccctcagcctcctaacaatatccatatgaaagaaatcagacccctttgacaatgaaaaacacatttaagctactgcacacactatcgccactggaaaagtagatattttttctgccaatccaactgcagtactctggcaatgtgtagttttcatggttgtgttttcatttattaaataattagtcgaaccataggtgctaatcaacaaaagttcgttactatttacaagaagaaacttaacagctctttgtttataattttttctgaagtaggaagtatttgtctttgaatgtagagaccatgtaaagtgatccaagaaaatgatatggccaaatgacatgattaattttcattactttctttccatctcttgcctcagatgcatttgagcctcgcccagagcccagcttgatagaaaaatgccagacttgggttgaatcagtcaattaaaaaccagctcttcttgtagtttgagagacacaatggagtataaagatgtactctgccttcaaggattttacgtagaactgggaagttaagcatctgccagaggagattacaaagaagtgtatgataaatgtcacatgagtgatacagacaagagtaccacagatttgggggatgagatcactgtggaccctgatactcagaaaaagcaacctggcctccatgtgagtccaagattgtcttttgatcagattgtcctttctttggtaccggaaatacttctcctggtctctatgaggttttcccttgggactcagaaactgtgcctttttgtagcaccatggttgggcattaaaatgtctcactaacaggcctgtttccccttgtaatatatttctctgaagacatgcctcaaactcttgtagctcttatacttgttagctcaagactctggcgagtcctgtggcttttgtgagggcaaaaaagtttccatagaaattaaactgattcattttaacccatttcctctaccactctgtcccagagaaattggcttagactttgtggattcaaggccccaaatttgagatttgacaaaagcttacataataatggcattgtgggaataataacggtatagcttttcagttttgctagttagagccaagatgatagaaagccaacccaggagccatcttgggacgtggacacttgggggttgggaatgggggtggaaaattactaccgcattttttcccattctttttagcaaaggtgcctcaacttttaaatttgataaagtgatttccactcattgatgtcaccagatttgttacattaaaaagtaggtccagaacaaataagttcctggttgtaaggagtgtgtatgacttcctaacaaagtgctagcgtttgggagatatttatggatataagtcagggaatcatcctctttctaagttcctgaaaagcagggtgttttgtgcatattttttcctgtgcatgtagaactcaagtggtacctacatccctcgccccagacattttctttctttctttttttttttttttgagatggagtctcgctgtgtcgcccaggctggagtgtggtggcgcgatctcggctcactgcaagctccgcctcccaggttcatgccattctcctgcctcagcctccccagcagctgggactacaggcgcccaccaccacgcccagctaattttttgtatttttaatagagatggggtttcaccttgttagccaggatggtcttgatctcctgacctcgtcctcctcggcctcccaaagtgctgggattacaggcgtgagccaccgctgcccggccaacattttcaaagctatttaaataggataatcatgaagacagtgtcctattattccatcaaaatcggaagttaggtattgtctattaatggttaatttctcagatttaccttccttttctctattaagcgctgagtttttcctttgaagggcatatagtagaggctggtcttttttctttgatagagccctgtttttgttttactgttttaaccagtatactattaaagttaaactttgatactgcttatgctttaagaaaataaatctgatgaatgaaggtaagtgggttcttggttcttcttttttttaatttaagaaaattaactgaagcttgtttgatagtaattctcatgcacgactaggccattttttaattgtttctgtttttaagaaatttcaagatttttagtttattttttatctaaatagtcccctggattgttaaaaacaaaatagccttagtgctgcctggtgcaaaaactagatgtaaaggtattactggaaaggaaagtgagcagagggctttctctacccaataagtaagcagacatcagaaacggatagcaaaagtgagaaacaaaatttaagtctgggtgtcaggaacaaaggcaaagtttcagtcagatgtatatgatgttggaattacattcccctctcccccagaaagaacatccttaggttttctcccattctgccaaatattccctcctaggctttcgatatgttctgcaggccacacacacaggagcggggctgtctgtcactgaacccagatgcccagctgtggaagatattctttcagcagcatccgtctgtttcttggcaggacttttaggcagtctaaagaaaacagtcccggagcagcctttgggcctgccttgtggttaatactgtgctggcttgtatctggttcctgctctgaccctgtggcctggacactgctttccttatagtctttgtctctgtctctctcttttaaagagtattcgtgattttggttcgatttagtgaaacacccgtggacatctagagaaactgtaattttttttgcttgtttctgtattgattcaaagagaggtgggtgggtattagaaagcaaagatcttatgggaggaaaagggtatctttctgcaatgggccaagtatgttggcaaaataaaagcctgttttcaccagttcattttcaagctcaataatctttagtcgtctgaaagggagaaccagttcatttcatacccagctagtgtaataaaattgagattcaggggcaacctggtgtgagttagcatatttgttcttaagggaatattcttaggcttaaagggtggtctttcttgaaagaacctatttatagtggtattccttggttttaatttttatttaatccgcctttgtgttgttcagcctttgcgctgaaaggattttattttcctattctcttgattattttaaggttagcagttgaatgttgctagaatttacacaagggagtggttccccacaccccccagctccaccctcccccattcctcccacctgccaattgtgtctgaagtaatttcccagcagtgctgttgactttgggagatgtagtatttccagttcgtgtgtatgtgcgcgtgtatgtgtgtttgtgtgtatgtttgccttaatatctaactgataataagttgttacttaacttggaagatggacacatctctctccttttctttgacccactctgagaattaacatgtggtactcaaaggtgggggagcggtggcggcggtgttgccttatgcttgacgacaggtgctaatcttcaaggaaatttaccttacattccacccattaagggtatggtacataaaaatggcttaatgtctctttgaaggtgtcagcaggcatgtgtggaccacacagaatgggtttcactgaaagtaatagagtgaaattgtctgcataattattttcgttggattgagaatcagcagccctctttgggttcaggaaataaacctctgttaaaaccatatggcactattctcagaagagatgttattacagggccacttccctctgaaattttgagtcaggagttcttgaaaggagtcacatatgtgggaatgaatgtcaagttttcttcctcggtcatagttgtgaaagttagatgttttctttccgttttcacaaatgccaccatggtcaccaggtcctggaaagaagcaggctcagctgccgcagcaccgccacttcaggtgtaaatgtctgaattattatctgcgccaaatgattttgtctttaaaagaaaagaaaaattgcccttaatccagtgaaatatgatttgtcaaccctgaaaacacatcttaaggtcaggttaattgcattctgtctgtccaaacccttagtgcagatttagttggcttttctgttttctttttttttttttccctttgcccagcatcaggggctataaaactttctctgaactaatttgtcacagtgctattgtgccctagagataggtatagtagagtaaaaggtaaagtgaataaaagtttagtttgtataatggctagggaatatttgggaataaactaagttaggaaaagatattaaacaatggccaccatatttttatgttttatatatgtgtgtgtgtgtgtgtgtatttcagtagacaatacaatgtgtgcattgtgagaaatcattgtggattttatctttttttttgagaggagtgggcagtcttcctggttagtctttgctgtagaagaaatataaacaaaccatcgatgtttgttcacatctgttaataagcctgggatcttatcagagtctgtagagtttagtctggctgttggtaatgctggggagttgaaatgtccctttgagcatcagactctcggggagtacttaatagatgttgagtccagcttttcatttcttatcctagaggaagaaggcaaaataatccatgactgtgaatggttgagatggctttttctattgccttatttgtttttgtagtgagagctgcttttattaagtagaatggttgctagcacatagaacctttggtcactgaatcacactctgaattcaataatttatttattcaacaaacacttactgggtacctaccataggcactttaagaaagggctgtgggaattcagagatgatgactgagttctgacccatctctggcccatcacatgggctagaaagaagcttaatctccgggtgtggtggcacgtgcctgtaatcccagctactgaggaggctgaggcaggagagtcgcttgaacctgggaggtggaggctgcaatgagccaagattgcaccactgcactccagcctgggcgacagagtaagactccatcttaaaaaaaaaaaaaaaaaagaagcttaatctgttttaggagataagacatgggtattaataactatgattatgtgacagaaagtgatagaacatgagaaagggcataagaaagtggcaactggagtgacatggaagttcagaaacatttttacttctatttgagggtggaggggaggttttattgaagtcaaggcgtttgagctgaatcttgaagattagaaattagacttattggcagaaattcttggttataaaattctaggtagatagatgatgacttttaggagactaacactatatgtctttcactgtcttgtccctggctccatgtgcaggtatactgatggaaggtatggcatggagatataatatcacatgccttagtgctttagcttaggtggttccttccacctcagtggtgatctgctctattaatctagggcctattcaacattcagagctaattttaaatgccactttctctagtactttaacaattctgtcattttttagttctgtatttattgatctcccctactagagctgtaccactacaatatgataacgttttgcacattctagatattcaactgatatgattcagttgaacaaagtagatcaggtatctgaattagtcttttaaatacatattgaagtttgttttcagattagtgttaaggaataacaatttatacggtgaactggtacataaaattatagccctagggcctgatcttgaaatactagaaaataagcccattacaaaacgatgataatcatgttttttcaagggacattctaaattgttctagattttagcaacctctggtgttctgttttttatagggaaaagtaagaggtccaaaaatcttcaggccaacttggtggctcagactttctttctcaagcccttttatatgtgtttattagttaagtttgcagctctataaatgatatcatttgtactagttgcattggatccctgccatttctccatccataacagatggattctgttcttccattccactatacgttgctcagggtttgttactttctgatagacaacagaaatgagaatgcagaaatgggatggaaaagagggagtgagtctgttttattttgtttccatatttctcctaagcttactggagtggcaaatggtaggataagtggtcagctatactgccccatgagatttaaggagcctttggggaggaaggaaccttgctcagaagataggctggggaggatggttaattttggagattttgttgttgcttcatgttttcttttgatttccctcatctttgatgctgactctgatgttggctttccctatataatatttggacgagaacaaattttgcctactctctggcctgtgcaagtgacacgtacagagccattgtctgacttgtgacttggcccagaaagggctgattgtcatgcagttgggagggcttttagactgggtaaaaaattctcccatttgtttaaaataacatgactaagattgaactcagaagacactgtgcatgcatttcttttcaaattagtgttaagaaataaaagtttatactgcgacctggtatataaaattatagaccagtctagggctccattttgaaatattagaaaataatacatctttgtataagaatacctctaatagtatttagacatttttcccttctaaatctatctttccctttaaataatgaatatcattagaggtattcttatgcaaggatgtacaggaagcatttagaaatatgaatctgaagcttggtagaaactggaaatgcattttccatagtcataggaacttgaagccattgggattgatgaggctgcatgaggaatgggtatggaatgaatgaaggagagttatcctttttaccattgtgacctaactttgtgtcccttgcctggacacagacaaaggttctcttgctaagctcccctgggtccctgaagcagcagaagagcagattcagaaccgtttcagtggccactgcatgggttgtctccgccactggctcctcatctttctctttcctagatcactttttgtgttcctcttccttgcctagccaccctaggtgtgtttgcttctcagggttcccttttagacacttttctccactcgttctgtacccattccctgagtgtcctcattgacactattaacttcgtgttcccatgaccactgaaaatgcatcttcagtctcttctgaacttcagactggtatttctaggttgcttcctgggtgtctgcacctgaatatgtcccatgggtacttcaaactcatggccaacacagcgttagggattccccacctctacttcaaccaaacttctctgcccaaacatgaacctcctccagttttaccagttttgagtgccctacagttcacccaggtgaccaaaccagaaacctgagactcaccttctctgccttacttctgacatctaattattccactgtactgttgtctgtacctctattctatgtctcacattcactccctcaaatcttttagtgctgatttagcttagtatactctctcagtgtttatcttctgacttataacgtaaaaacaatttcctaactggttttatgtctctaactgcactcccttctaaatctatcttcccctgtaagtaaagcaatcttcctaaactgtaaaccaatgcatggcacacccttgcttaaaatacttcagtgtctccctgttatttgcaggatgaagttcagacttggtggcacactgacaaggcccttcagcatctgctctgcccaactgccttccacccacacacctgtggctgagctccagcgatgccaaattgcttcactctatactttctcatctcggtgtctttgcacctgctgttccttctggttggaatgttatcttcttctgcatttgcttgactaaattctactcattctttaagtctactcaaacgctgtctcctctgggagcccttcctgactgctcttgaaagtcaagtatttaatctttggctcctctttggtttccttttcatactttaattatattatttatcacactgctgtaattatttgtttttatgatgcctccagtataccgtgagcaccctagtttagcatagttcatgaaacataataatgcttaggatattttaattgataagtgaagattacatttgcatagtggttttacctgtgtaggacattttcacctcttattacattttgtcctgacgacatccctgtgttgtagatactttgtttttttctgacagatgaggaagttgagtcataggaggaaattgaatcatagagatgatagatatttgcctacagcctcacaactaacttagtagcagagctaggaatagactcccaagttttcctgctccttgtatagtcaggcccagaattagaaatgagattctcctttttaatcagacactgccttggtcttttaactattccattaagttcactaattgtgtgtaaatgtgtgtgtgtgtgtgtgtgtgtgtatttgtggaactcatagtgacaggtgaggaatccatagctttattgattcttaggattgcaaattaggtcacctgttattttacagatgagaaaattctgtacctgagaagttcacacttgctattagtagcagaacccatgtctcctttcagtcacatgttctctttcatactgcattttgggcagtcatcaattccataggacagactttttttttcttttcttttcttttctttttattttaagatggagtctctctgtcgcccaggctggagtgcagtggcaccatctcggctcactgcaacctccacctcctgggttcaagctgttctcctgcctcagcctccagagtagctgagattaaggtgcacgcaataggacagactttctgtgttgaattgcaagggttgttagtaggatttgttgagacattaggcaagttaaatcttgagaagagcccatcctctgagcagaaagaatgccattcctgagaacattctcaatgaaaggtccatgaaagagataggacccagaagagaaagaattaaatgataatattctttcagggattatcccattcttccagattgcattacttcttttccagtgagcttcataggttcttcggtatgtatcattttgaactaaaatgaaggcatctaattaggctgaaggatgagaacttcctattgcaaagaaaggtacgtttctattgcaaagaaaggtatgcttgtgatcagaagtgtttgtgatgtcatggggcagagtataaagcatgtggggccttgagaggacggtatccctaattacctggatagagacatggaactaatgttagtagtaacgctgttcctctggctggattattcctctctgtacacataggtatgcatataatagagataatataaatttataaccacatatatgtacgtatatgtggaaaagggaatatatttcatatggaccaaagaaaaacattttgccaaactgtcattattgattaaataattcagcatgaagccagcaggcagatatccacaaaacttaacactacacttgcttttgaaaaacaaaaaaaggttttaaatgtaatcgctcgaaggatgttttttaatattaacccacaccaacctgcttcctttggcttgagaataatacactttaaaaaaatctgttgtgccttgaaaagaagagtaaaacttgctatcttctaactccatttaacactacatttgattcctttttatataacgataacttgatcctactcaaaatacttggcacctttagtgacagagtggcatgtaagaacactttaacagatttgaatgtgagtaaactccagtagttctgaaatgaagaggtagagttttcagttccttattcagagttcacagaagataagaatactgggattaacacaatagactccccttcattacacctggctgaataaagcaattatctgtctatcaagactagcaacttgtgcaacagcattaagaaagagtggatggataggtggataaacgctattccattggaaagcggtgctgatatatgaggtaatcctttgagtttaacttgtaaaaacagttttattttggagtttatatcatgttactcttgcagcttagagagaaatgatttttcaaaatattgttgactgcatttttcagttctttacccatctgaattttattaggggggttatttcaaagacgtctcttgtttaatcatgtttaaacaatctgtttaagacctgttgtgtagatataaacacaatagtcctttaatgtcgtaaaacagacttctgacagacatagcacgtaacagacatgcatccattattgcttaagctgctgttccttccatgcctgacctgagagggtaaccacagagctcagctgaaagcgttcactggttagaagacactgacatgtgcctatgcactgtattaatgtctagcaagcagagaattgcagagcagcatacaattgaaaaggtcttagactagattaaaactaagtaccttaaatctgttttaatggctgtgtttacatctccttcttcttcattcctttaaaaaaagtaatcaggttttgcaggcgttaagaaaaccacctcttcttgccagctggactaggtccagtttaagcaagaaattctccgcctccttttttctgtctttttcttttttcttcctctgtgatcttctctgccattcagcacagcaagaccaggctgtgggagttggctgactttttctttggttattactttttaacattttcttcctgttacagaaatgagaaaattgagaatgatgttctgctgctgcagcagtgaatgtcaagagaggagccctttgcctttttaattacatctgtgtagtgtttctttttgcttaaaacactctgtctctctgtttctctgtctctgtctctgtctcactctctgtctcacataaaatatgcacaaaaccttaataatgaaagagaaatagaaaggatcgcatgctaaggaaattgagccaggatccaggaattgcgtgacagtctgtttgtaggctagttgtcactgcactctttgaagaataatgccatccatgtttagctggattggcaaataaacagtgatgctttttgttcaactacgaaaactgctatttccattgctaaaaatgttaccgctaaaaaaatctttgcatctctcagtggggtctctataagtgctcgaaacacaaagaactgtggtatgtgtgaacatgttacagaaaaagaaggcaaagaaaatgtttttggaactaaaacactcaagttttactaagttttggaagtaaagtgtagacatagagaaagagtttttttgttcatttcccataaagtcaagggagagataaagattcacatggtccaggatggtgtgaatgttcagttgtaattagtaggagaacaagtgataaaacggagtcagagagactgggcataatgtaataacatctttgaagtaagcttctgcactttttcttaatgtctccttctggtctctttgctccacgttttcttctttccctcagtggcagcctggtataggaaaaaggaggctcaggcagtttaggggactgcctcccagtgtcactgcctagttccatgactttaaagctagtctcagtatttttctgggcattaattatttctctaaaatgaagaacccagtctgatgaaatctatattctcttacaactctgaaaaatcctaattcatataattttactttgaattggagtaaggagggatggaagcatcccttggaaacaacaggcagacaaatttgagtagtaggtctgaaatgagaaaataccagtagagttgtaataaagaagcatagtaggttagaggtgtattaggacatgggagaggagctacggcgaagttagccggattcccggttagctctttttttcctgcctgcaaaaagtattacttctcatcttgtatatttccatgatgctttcatccaatctttttaaaaaattttttaatccttttttgcttcctacctcctatgaagtttctttttcttcagacgtctcaagtttttttagtccattatctgaagaaaagggattatactgtaagcacgtgtttattataatttatttcctgaagtttgactgatattggcgtagcctgataactgtcctttctcccagacactgtatgctttgattgttgtgattcgccacagcctaaaacctaaaagttataaaggaacttgcatttatagacattcaaattaacattgtacaattcttttatttatttatgaatttattcaaagatctcgaattcttcaatccttagaagcctaaattttgaaaggagcaggccttcacttctctctcacacacatctaattgtatttaaatatgactacatatgagattgagatagtgaactttatgtcactggtctaaatgggtgccttttagtattaaaagaaatcaaactcagcttttaacattttttctatgaaatggagtccctagaatatttctatggagtctatggtttaaccatgtaattatgtctcttgagtagattatatttttcttcccataattatgtttcacccaagagactggaaaggctttagacctgtcttgggtgaaattgttcttcctctcttctctcttgataaacgccgaatcttacgtgcctgactctgtttaagagctgaaaggggactcttgaagatatgtggtagtgattatgatttttttcctttagaaattggtttatgtattaagaagggcccttagagagaagctctgttagctcatttttgaaatgccatcagagaagaatcttctggaagcagatttgtttatgatctgtggtcctgtgtctgaagccacacactaacattgttctagggctgtctctactcacgagctatcctgtatcatattgcatggctattaatttccagcggctcaaagggctagaggccttaaacatgaagacagtttcttagcccatttcattattctagtccagaaatagtttctgacctgaatcagacagtgcactcttagggaaaaagatgacgcagcagcctttcccagcaaagattatagactcatcaattttactgtgggaaatgtttcccaataaccagcttttttttttctgtcttctttgtctttactggacaaaagtacagataattttaaatttatccatgttcttattttttaattcagcaatcatttgttgtgtgacttctctgtacctaggctccaagtttgtgctagacataaaatgtgacacccatccttaaggggctctcagtcaagtctaggaaaatctaaaatattagggtttgaaattttgtataaatattttatgtcaattcatagtaagtgaatgcttactggatgcctactgcacataagcataaccacatgtagtagacaaaacatagttgtcgctgctgtcagcttgctgggatataaatcagagggatcatcaaggctctcgagacaggaaacaccagaacaatgtgatgaccaagttgagcttggaagggattttgccaaacggagttgatgcggagagggtgttccaagtggaggggacagcttgagcaaaggcacagggtgtatttggactgtcgatagaccagtgtgagtagagcacaagctgggagcagtacagttgtagccattggaaatgagagtgacaacgcatattgcgaccatattttccaggtccttatttgctgggctcagggggctctatttaattcaatagacaatggaagacaattgaaaggttttgagcaggtaagtgacatgaatgttaggatttgggggcagaaagaatttcagaaattatggaaactaactcttcattttttggtagatgaggaagctaagaccaacagggttccattttggtgcccttccaaatatgccaggctgctactctgttgtattagccacaggccagaggttaggagggttctagtggaggcccattcctgaagaaactgtagaaatgggctggagtggatgatgggggtctaggaaaggaggtgacaaagatatgcctaagctggattttgagtctgagagactagaaaatgatgatgatgaaaataaggaaatcagaagagaagctggttgggatggtttgaggaggaagggaggggcaaagggcttaattaaacattacaagagtataggtctttgattcctagacattcacaaaccaccagtgaaatgtagtcatctgaacgtaaacagaggagcagactttcacttttctccgtagtatcttcatttttacatgtatgtaggaatgcagaaaatcaaagtttttaaatttagagcctcaatagttataataaagtatgtggatgagaactttgcgtggctttcctaagaatgtacttgagtctgggtaatcttccttgtgctattgcttttgctggaaaccatcgactgaactccctaagatacagtaaggctcatccttagaagtagaaatgcaacaattacatgtggaatgcaatcgtgactttaaaattagtcaacctgttccctaacgcttccctacaaacacactccttcatgtagcacttttaggatagattagaagtgaaggatctcattatttttttccaaaactgctgtggaatagcagctctgtggacatataaccaattttctctgagaaatagtaattctgatgcaagtcctctcctctcttcctttttactccagggatcattgtcacaacattctgaaactgttacatcctgtggcttgagccctagagtattggaccagactttattcaatcacatacttggtgacagcaaaattagctcatgtctccccagttacccctctcttccagtgaagtctgaatgcatggtggatgaggctcatggactgccaaagtatggttttattcattaagagagctgtctttttcctttcttttctttctttctttttttttttttttcttttttgagacggagttttgcacttgttgcccagtttctcacttgttgcagtggcttgatctcagctcaccgcaacctctgcctcctgtgttcaagcgattctcctgcctcagcctcccgagtagctgggattacaggcatgtgccatcacgcctggctaatttcatatttttagtagaaacggggtttctcaatgttggtcaggctggtctcgaactcccgacctcaggtgatctgctcgcctcggcctcccaaagtgttgggattacaggtgtgagccactgtgcctggctgagagctgtctttaaagggcagattcccataggtactgcatagcttagaagaattaatgtatagtagtaagactagagttataaagtggtttgaagaatggtgtgcgtctgtttagattgatatcacacacatatatagataagcgtatatatatgtgtgcatggatatgtatgtgtgtgtgtgtgtgtgtgtgtgtatatatatatatatatatacacatatttagcatcatcttatctcacaagatatttattatcaggttttcatcatttttcttccagctaactttccttgtttcttctctgcttatcaaaatcctagtcaaccttcaaggacaggcatcatgattttgtcagtgaggtttcctctttccccttagtcaaaatcaattgctcccctgcacttcctataatacttcaatactttttaaattttttattatgaaaaatttcaaacataaaaataaagattatattgaatacaatactatctacccatcaccttttatttattttttggcatatttcctcacctactattttgcccaaatattgtaaagcaaatactggttgccatgatatttaacccctaactatatgttagcccttctgaataagaaggacatttttctacataatcacagaaagtaccacttccttaatatttaaaaacagttcatattcagattttctcaattgatccgcaatcatggcattttagtgattgccctcaccacagcctctcttcagttatatttaattgctttcttccccactagactgtgaactccttgagggcaaggatattatcttatatatttttctatcctctcctcctcacaatacctagtgaggcttgcatgtagtagataaccagtacacattagctgcactaactgacccaaatatggacatggtactgcttccttattgatgctctattacagatcttcttttaaactttattttatttaaaaattatgttttcatgatacttaggatacaggtaaatacctagggaatttttaaaatcaagttaaaatactactccaaaaagatgagctgccaaacatcatgccctagtgatcagcaaaatgattctgctgtgccatattagggtagactgggcatcacatggcacactcttcatgaaaagtgccttgttttttgtaagtgcattttgacattcttcagggtgcgctgactggtgcagtgcatcaggttgtggatataatacagagaatgtaagtttctggctggggagccacgtagctctccgaagttgttaaatgtttctcaatcaactttcataaaaatgggcaaaatgggtcacatcacacagagtcaagtttactttcatagttcacagaccacattttcagagtcttcgtgtgccagtttcagatgtgtgatttttgaaagcagaagttataatggtagtattactaactttcattgtgggtagggcacaatggggtgattcgctagactatggcttagggacttaactgtttctcatttgtctttgctctaaggatgtgtgaatgctgtgaccttttgattatgctttcttcttgtgcccctgaatttattgcaacaaaagtcgtattcagctaaacacactcaactttttgaaagaaatcttttctggaaaccacttttttgtttttaattttaaattgatttttgatcatgatttcccctgaatgactgctgctgaactattatgagctgaaataagctggttggcaatgggagagaaaacagccccaggccagcaatcaggaaaactgagtctggtcctgccactaactatatgactttaggtaaggcatgtcccctctcagggactcagggtcctcatccataaaagaagcatgttactctaaactttagagtctaaatgatttctattgccctttcatctctctgattcccagtgactttcaacaatgcttaagaattacagtgaaagtgaatagggttttccagaaagaaagcaaatttttacttaaatgaatgtccttcagtaaaattttgtaggaagcaccagtaagggcttatctctagagaaaggttttgcccactagattcactagattgtcaaacaagaagaacttttttggggaaagaatatgatatatataatatgatgtcctggaccagaaaattttctttcactcaaggaatttatctaaaagaggagaatattcattcattcacttattgcataaatatttactgagcacccactctgtagcaggcactgaactaggttgtgagattatagctgtaaacaagacagagggctcattctcatgagacttacagtcttacaggagagacaaaaataaatacacaagataattatagattgtggtgactgccataaagaaaataaagagagggtgtgttcaagagggtgggaacctattttggttatgggaggcagacaaggcctctcataggaggtggtgttcattctgaggtctaaggggtaagaaagagtgggccctacaaggaatcaggggagagcacttcaggaatatggaaagctcttgagatgggaaactgaaaaggagacagattttcagctgcccagagagaaatgctagagtcttaggccaaggttatatcagtagaaatggagagaactgaatcgatttgagatatagcattcagaaagaaatggcaggactcggtaatggattgaatgtggagagtgagagataaggagaaatcaaggaaaatgtctaggcttttggcttaggaaactgagtggctagtgtcatttactgagatgggggactattagagagaaataggatttttttggaggggagaataaaaaattctgttttgaatatactgcatttaagatgcctttgggacatcccagggtagatgtcaagtaggcagtagaacacacaaacctggaactcaagacagaggtcagggctcaaccagaaaagggggagtcattgctataaataggtagtatttagtgcatgagactgagatcaccttgggcagtggttctcaatcctggctgcagattggatcatgtggtgaaatcttgaataaaagagaccttttccccaggtcccactatcagaaattctgatttaattgatctgatatggggcctggacatccatgtttcaaagctccctagggaattttcttattcagcaatgatggaaggattcagggagaaagttcagctagagaagggatccaggactgagcatttttacatagagtctcaagtataatacaggaattttccattcttcataccctcctcctgtttggaacatctactctttggcccgttggatgaggtttagtcctcactgcactatgacagagtaccctatccttgacttagtcagtgtgtccttggtcttccatgttcttaatttctgaaggaattgcttgggtgctggggatttaagtacaccttctttcagcccatcattcgagtgttaccctgatgtggtttagtggtaacaggtatttgtcatagttgaaatgtgaagaacttgtttggcttttgctcttcaatgtactttgttcttcaatgtacttcatacattatgaagagtgcattttgttgtggttgcagtggtgtctgtgaaggggcagatatctacaaagaaaaatgcgtatgtttttgtatgtgtgcatctgcagataaatgtttcctgaattattctagggtgcctgtagatacttggaagcgttctttgaagataatttccaaaagatcatgaagggttttaaaatttcacctgctttaaaatttttcacacttaccagtcctagcctaagtcctttatttttgcctgcaaactcttattactcctgaaaacgctgggctaagagaaagtaaaaatgtactcacacatgtacagtctgagctcacatctcatacagcctctaggaaaacctaatgaaaaggctatagaaagcagaggcaaagcttattaaattttcttgtgacccatggcccacgtaaagtcctagtgtataaaggaaccatgcaagatcatgtagccctcccctcagccctcagggaacctgccattccaaaaatatggcctattaagaaaaataacttccagggacaattccgtaagctttcttgttaatgtttacagctgtatcaacaccacaccaatactatgtgtgtgcatgtgtgtgtctgtgtgtgagtgtgaggaacagactccatggatctgtgacaagtactatataattccctaattgtgaaactagttagacccagcaagatgtattgatggaagtttggtgagttaggctacagccatttgtttagggtaatgggtgaattattaactttgtaattgaatccttgttgctacttctgcttatgttgaaagccagccttggcacctcactgggcttagttcttaggtgtttcactctatatgatctggatattttcagtcctccatagcagctggaagaggaagggaagagaaagctagaataccagcactgatggtgccacgtgatgaatggaaagctcagtcaacttggacgagggctatatcctcgtgaaggctcagctagtcggcagccgaggaccataagctagttgttctacctctgcaggcctcagtcacttcataggtgaacaccttacttgccagggtctaggagttgttttgggtcatctctaaaagtcctctagggatctaaaatctatttgtaatctggatacaaaacagtaatggtggggaaaacaaccattaacaatgaatttctctaatttttcctgttcatttttctcctaggtctagtccttctgttatagcagatgcccaaaaacttgcactggcaggaaatagggtggtgggtgcatttcagttaatgggcctagttggaacacgtttggccgtggagacagctacactcatattaccaagccttggcttcctatctgttttctttgggctgggaaggcaatgaaaaaggagacaggaaaatacattttggggcaaataaaataaggaatttgtcttacgaagacagcttatagttgggaaattctaatgttcaatttaaccctatcctgatacattcctcttgttctgtattaagtggaagctaaggcgtttgcgctacccatagagtagtgaaaaactcccaggcttgaaggcttttcataaaccttcttcaaggtttctttcttttatggataatattctaattcccttagtttctcttcaaggggcaaactcttaatcccatcatcatcttggtggttcttcctcgaatcagcttcagttacttaatagtcatactaaaatgttagggcagcaccctagggcctcactggcacagaatctggaggaaggaatccccagtccatttctgtttctctattagcattgcatttgtccccaatagcaccaccctatagatttactctactgtggtacacccagattcagatgcttttctgttatacttgcaccaagacactagtatgtcttttgttaagaatgatttgatgatttttaagaagtcttagtatcttggtttgttttaatttgtgcatttctctaatacccagaatttctttagcttttagacttgaataaactagaagagagatagaaaggctcccctcctccgccaaataatggattgtcacagtcacatgtttacttaaagagtgtatttcagcttcttttccaaaaccacagtagtggatttaaaataaaaaagcattctctctgatttaacagagtttattatacacattccagctttggcatatcacaaaatatccagattcctcttgagaatttgagtttccctgcttacatttctgtttttttatttcttaaaggggtttaggtttgagttttaattttccagaaaagagtcttagtaaagagtagttgtaacgttaaagaaaagtcactatggtcatcgtggaaatttccctttgacaaatgtgtttgtccgtgtctctgctccagctttgtgacattgtggctaacatgcacggactctctgaactttcagaggggatttcctccatcatgaaacaagcaaacacccccaatacacatctctcctgtttgttttttttttttttttttttttttactgagagggccagagaaggtgtctagtatcctgcctctctattgatgcttgacttcaagttgtcctctgagacctcagctctccatttataaaacagagctaggaatgctggccaccagataccgcttataaagcaatttgaaatggaaggcattatgtagacaagtcattataaatattaatattgataattccttggcttaaactcccagtttgtatgttcacatatctatttagcatggtcaattgttcagctaattaatatgcttttattttatgatttgctatttccagggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacaggtaagacagactcataggtttcacttgcatagacgctggcaggctgggggtgaggggctaccagaggagatgtgttcacttcaaaactcctggagctgtgaagcggcttattattaaagaatcaagacttgaagacactgatttcttcttttttattaaaaaaaataacattcaataacttggggataacattttgggggatatttctactaatgctctactctgcagcaatctcagtctacaccctggtggaacggtaataatgcactttgggagaatgtttattatacgtttctatattgtatccaggtggtgcaggggataacatcacacccttactattagaaaattagtgttaccctctcagatttgggcttacatttcttacatgtataactatttcattaagtctgcttgaaaattgcccagggcgaacaggaagccttgattggtagttataaggcaaggtcaatgtgtggctcatcgggcacacagaattcacttctgatttacatttagctctggttctccattagacatttctctttataaattctagtcagctacttactttacctttcttctgagaaattaacatcggcattacattacagactaatcattcacatttggtgcattaagacccccaactcttttctttttgtcccacttgtgcaaaaacagatttatttaaagactcgtttgaatgcttttaggtcatgatgacaagagagtgtattaattattataaatctttaatttgcagataaaagtattgagagctgaaaggaagtttacatgtcatctaattgctatcattggtagaggtggactagaatagagggaaagtaagtcaaaacaaaatgtgtaataagccctcaacatggatcttttttatggttagatttttgtttatagtagttaggctcgaatgttcttaatggtctcaaaacataattgtttataagcagaatgacctatctcttcttctctcctgcccatattatgtaaatgtattcttggatagttacttagagtaggtttcagtttctgtgagtgtatatattttagtcggaatgtatgagtttgcatgagtgtatattttaaaaaataatatagaattataaaaatcaaacatctaaacactaaagataaccagatatctgcattaaggaagaacattattgctctttgaagaatggccatgttttagactatataaaactttaatcattcatatgtggggttgaaaggtcaatgtgttcactagacatatgtccttgataaaaatacaagagtaaaattcacactaacttgtgaatttgaagcttgtagctatgggtgctgctgcatttaaagtagtggacttagagactacaaaagatgggagagtgggggggcggtggtgagggttgaaaaatgacccttgagtacaatgattgctgtttgggttatgggtgcactaaaagcccagacttcacctctatgcactatatgcatataagaaatccatacttataccccctaaatatatgtaaaaaaaaaagtagtagactttagattattcattaaggcataaaatagctttccttttgtctttatagtaatccttagactgtgtgtgtgtgtgtgtgtgtgtgtgtgtttgtagaagcaaatgtatatatatacacacatatatatgtgtttatatatgatttgtaatggatttatgatgactaataaaatatatataaatatatgttccatgatttggcaaccactggctttttaaatgtttgatttctgtattctgatcattatttgtttgctatttatgctgttaatgactaatgctttagaaatggcctttggagactgcgtgttgccagattcacttaagaagatgcttctctcaaggctttgtccttaaatctaaagatgagatcataaagtagatccagaggacattttagaacctaaaggtaccttagatattgtgaaaccaatggctggaaaaattgtgaagaggatctgtgttttagtagcatccccgcctagcagatacacgtgcagagagtgaggctcagaggaggtgtggggctcacctgtgccacaaatgcatctgagcagatcgagagtgtggccacctccacaggcctggccctcctccagttgtcagcttctcttcaccctcttccctgttagggggctcaggaagttaagcttcttgtctgcagttgcacagcaagttactggcagggcagggaacacattcactggatatatttctgaaaatgaaaatataaaacaagttaatttctaggtactgatagcttcttggaatttttatgagtattagtgctcttcattttgggattatagtagtaatagaattgatttatagactagtgttctttttttttcaacatccactaggtattggacccaacaacttttctcaaactttccaaatttccagatgtccacatacatacttgtcaccccaaccactcttggccatgtgagctttctttaaatgttcccatattgtgagtgagagaatgcctgtatctgtccataaccaaggagatgcagtgttctactgtgacccaatttttaaaggaaagcccaggaacatctggagcagcagcaatgcgaaaatgaattgaataggttcaattttttaatctctggattgacttctttgtttattcaataagtatgatttggggcctatcacatgtagcaaactgggtgttaggtaatatggagagagaagaaaagcgctgttcttagttgtagttgaagagatagttatcctccccagccctggcataccacatcctgtgccccaactgtaataccattcctgagtacacgtgcttctctctgtacccctttactcagccagcccatctacagtagtctctgtctgctgacaagattccacccatcctccaaggccactgtgttatcttcttcaggaaaaagttctggaaccttcatccaaaggcagttcatccaccctctaagctttagttaagattgccttcttttaaggatactgtgtattcatcttttctaccctgctacattgtacattctttgagggatttattacagggatttattttcttttgtgactagcccagtggcagtgtctcattaaatatgaattattgaaagttcaggtgagaagcaatcggtgcaataagggttgagaggatatcatatctgtcttagtagcattaactcttctttctaatttcctgtcccaggatgtcattgttccctagtgatgggcagcagcttaaatcacatttcaataaaacatttacttagttaaactgttcggttttattcaagtttagggtcaatgtaattgcatgactaaatttaaattcttgcctgtaatggattttgtaacttctttgcaatatgccatatctgcattttagttcatgtaatcctttggacaagacgtttgtaacaggaagggcccagtttcctctctgcaattggcttgctactcttgatatctcaagcttttaccccaaaactgtagataatgatcatggttatatagtcccctctagttctcccacttgccaacataaaaggcagaagacgtctttaaactcccagaagagtgaagtgaaattagcaatcataaattgaggaagtcataagcatttagtgtttcatagttagccttttccagtgtctcttgcagttcctaggaccaaaacttctagccatgtggtagctagaacctaattaaagtggtttccacataacttcagtctgattctgtattccctccctggtatctttgcagtgcttgtctgatggtgatattttgtggaagtctttaatggctgatgttcagctgaaggcccagggcctccccacagcttcctggggaagttgcttcctctagacctcttatcattcagacatctgctgcttgtctctaggtgccaggaaacacctagtctgtcacaaatgttcacttcttttgattcagaaagcggcgatagcaatagagtaaggatatgatgttgggagatatcgcttaagatatctttaaactcattatcctctagatgggtccgctacacctaaaaaataatgctgattcaggcccttgggtttggtggattgggacattcatctcgcttttagggtgggggatgtactgctattctgtttttcactcattcaaaaaatacttaatgagtgcgtattatctgctaggcattgatgcaagtgagtgagagagacacagcttctgctcacaaggagcttatattttagtgtcagacacagtcaataaataggtaaataagcatacatataagataatgtctgataataatgaatgctatgagaaaatgaaataggataattgctaggtaacaactcggagagggaaggagctaattttgattggaaagttgagaaaaggtcctttgaaaagctttgaagatctgtgaggaatgacatttcaggcagtaggaaactcatgcaaagcctagattatggggagtcttgggggccacaatagtggcttgggtttagttctgattgtagtgggctaccagtgtagtgggggatgtgaagcaagggaatgacattatgtcatttacatgcataataaaacctgtttggatgctgtttgaggggaccataaggggctaaacaaagaagcagaattatgttcaggaagctgctacagtagctcgagagagtaaatggtggtagcagtggaggtggaaggacactgaaggattctgaatactctcttttttttaatagagagttcacaactctcgctgatggtgaagggaaaacaggacttcagagttttgacctgggcaattggaggatggtggtgccattcactgatgtggggaagactcagggaggataaggtggagtggggctggggagctcagagaagcagttgggtggagaaaagaagatactaagaaagaagagactcgacattctcactcctacagtagcttgtaaaactgcctttgcagacacccaaggggcttcccttctcatgattcttcctaggttgcagcgttccctttcatgatttcctttctcttttaaaagcagctcttggttcttttgagtcttggttgtttttctaagcagtcaatgaaagttgattttccctgcatgtaaatgctggaaggaagtgcacaggatatttttttccttggttcagacccctatttgcccttcactcaggagtagattctggacacttctgcataggctgctagatagtccatcatgttatttattgtgactttttctccttttgtaatgtacaagcaattcatttgaagtttcacttatttttttattttaaattaatatgttattgtatttcatgcttttttctctgcctagacactcttccttgtcttgtttttccaaacacatttttattgtttcttcaaaactcagatcaaatgctgccacctctgtcaagcctcttccaacctatccaagcagagtcgaatcaggctcccgtgccaccttgtacaacccttgattatatcttgttccatgtgctgatgattactgttcacatgtctgtctcctccatcagactttggacttttcaaagtctagggccatgttttcttcatctttgtgtcccccattgtcttacacggtacctgcttactacgtgacttttggttcggtgatcagtgaataaatggggtcactgacctcttcaggaggcgggacccactattatcctagccttaatatttttctagtgtctgtttgattgaattactattagttaccatttattaaatgcttgtcatgtgtcaggcattgttctaattagtttaactcatacgttcctcacaatagctctatgagataggaggcattcttatggaaactgatggtagacaggtggaataactcacccaaggtcccacttactactagtaagtggtaaatacaggaagtaaaggcagctctccatagctccatggccctgtgtacttaccaccaagtactcttgggaagctgaaaggtacttttatcatggctcagcttcctcccatttctgtacctcactttcatttattcagttctttaccatttacaaaccaaaggcctaaaacaattctaaaggtacatatttcacagatggaagaaattgattcttggagaaatgacttgctgaaggctacttcagctattgcagttgactgtgagttcctgattcttagcaagcactcaccttcatccctatcaagataggttgggcttgttgccaacaatctaagtgacatgtgtcctgcaggactaatttctttttcttctgtccattatacattatttaggatacttagagagaatattttcatgaacgggagttagcattaggaatatctgaattatactttaaaattcaatataatcatttaaatgattaaattccagttatataaggcatgtatttaaggtaaaaactgcttgccagacatcctgtctaataataatcttatcagcagttactgtgactgaagtggtttccacctaacttcagtctgattctgtattccctcagcaaacagaactcctttaaaaattaaggggacctcagccaattaggccagctggaattaggctgtgtatatgtttggctgtcctaggattctagtgcttgtcccgaaacatttactagtgtaatcctttcagaaatcagaaagcacagctgagttgcatgtgtcttaagttactgttctgttcaagtgctgagtgaccacatgattctttaatgtgaaacaagttgggagatgaagtgggcctggggtgatgttggctgtgagtgtgagggtggatggacccataagaggctcagatactgttggtgagcaggaagaatgacagtagggtaccatcagtgtgggtatggaggagagtgggagtcaagtgaattctcagacttcacagtcactgtggtcctgctcacttgtaggcaacttgtgtcaaggaactgaagtcactgcattgaaagacagattgttggaagtggttcttttttactttggtggtgcagtgttgtaatttctgaagttcctgggaagttttgccctgtcttcttcctttgagatgtttcaggtggggcagctgggcaaatttgctgctgccttgcacatgtgtgagcagggaatctgtacaggaggttgctagtcacaatccttatttttagaaagggctcaaatcctgtgtgtaaacactatttcatactgattctgctctggtggccacattatgaggaagagtagactttaggtgcagcctgtgctggctttaaagaatgaagcttcctaggactctgtgaagggctggtggtcaacccgttatgttgttgcttagcctgttagcagtatccacagatgagcttcttaaaggtgctctgtttggatttctgtctgttggcattcccttattaactgaagatggtctgactttagtacgctttcagaaaagtagagagggtgatgttcccagaaaaattatttttttgtttcaaaaaattgtctttgtaattttctcctatctgggaatataagatgcatagttaacacttagttgtgataagaagggttcatctcctatataatgcctcattttatccttcttcccccaaaacagttccatttctagcctgtctttaactctccatgcagaggaagtcttgattttgttctcctattcttttccaacacatcatctttctcttttagttttatatttagttttagttttatatacatatgtatatgtacgtatatatgtacacccacgtgtatgcatacctgtcccctttattagttgcttagggtccttttttgccctgttttaccttttgtgatggactgtgggcaaaaggatcagaataggagattaatgttgaaggaaatattaacttatggggtaacccagcagaggggcaagttaggcctgcgctttgtgcaaagatgccctggtggtatattttcacactaaataatggatatgcttcacatatccattatttatgtgatatgcttccacatatctcagggcttcacacagagagttggtgtacattgactgtgcagtattaatagcaacaataatatattatagatatgatcagtctaaaaagtgttttcattttaatgtatgcgaaagtattccaggaatataactgtatggcactactcccagttagaggcatcagattctctttagggctttgtttattgtaataaagacttgctttttaatggcttaaaacaattggttttaatagactttaaaagacaagatttaacggaagaatcagattgtgatccatatagagaatatgaaaactgaggtgctaggagatttctgaaatcctcagagctgaaattggaaatctgtgtcttaggaaggtgaaacctgacagatagttttaggtggggagtgggtgaaggtgtagggggaaagatttagaatgaaaaatgtttggcgctgttgccagggtgaatggtgggaatggaaaatgactttggatgagcatctttgaggacccagctgaaggtagaggtcatgggaagagccaattggcatgattatgtgattctctcccacagtggttacagtttgtgactaggagtgggctaggctgtcgtggaccgtctgtctgctaggactaggtaggattcagtacaacacaggggaacaaggaagatgttgagccagtttcccatgtgggggaatgtcctgcaggttggtagatggaagaacttccaaagaggacttgacccatctggactgggaaaatgagcagcagctgagtggaagggttaagagggaaatttaacggggaaatccgtgtgttcgttcaggtgggaaggggaaggagtgtcatctggagaggttgaaggtagatgggcgctcttagccattcttcagctattcctcatgtgaccgatagaggtcccacaccttgtcctgtcttctccagtgctctagcctgatgctgcctcttgagaacacaatccgctagctatgcctgaccaggtcagtaggggtctactaatattctgttaatatatcccaagtttgtgttaactttttgttatcccatcacactgtggctgtcagtccatgaaaaactctgctcttggagcaggctcccccatcctgtcttgtagttgacaaaatgcagcactgtacttttgctcttatttcatttcatcatgttgctttcacctcctctttccatcctgtagggttattttgtagttctgattcttcttctgttgtgttgggttattcctcacaactttgtctcatcttgaagcttggaaaggtcccttctaatccttcaagactttggtgaagatgctggacagaaataagactattgtgccctggattatgccaccatataactctgtctaaactgaccacaatctatatattaatgaccactttctggcaggctttttaactagctataaatcacttagagataaggcatatatcttgctgaggtccagatatgcaatagacagatgagctgccttctaatctattgctttagtaattctaggagacagttttttagtgagcccattctgctttctgatagtcactgtgggatgaagtgtgagaagttctttgcacactggctattgaaagtgtttttagtgggctgcaagcaagtcaacaccaacagtggctccaaaacaacttagtttcagcaacttagattttaccaatagcaatgctgttttcagaataagataaatggaataagggaatgtaaaacctagtgtattttgtgtcgtaaactttaaaggcattatcttcaagtaatttaacagctgtcatgtggagtagtaatcccagagagcaaaactaagattagtagtgattggagttatagggaggcatattttacttaatctaaggaaaaactttttagaccctgctccatcaagaagcagccccttgagtactagttacctacatttttgccatgttgtgggatgtcatttatcttggagcagagacttgaattcatctaaagcagcacactgctctcccttatctcctcacttctcttgggccttaatttcctcttatgcacgtttgttctgctctttctatgtaagatcatcctttttgatagggaagattaaatcaaaatagggttcggtaattttcctttctaactttcattaataaaaattatgcctattgttcttgaactttggcacataatcacatcacctggggagcttgttaaacatacagatgcccaggttctaccgctgaattagaaggtgtgaggtggagccggcccaaatcactcccagctgtaggcccaaggcaggcctattactcaaggctcaccttacccatccagaactcatcctgatccagcctgaggccatctcaggagcctcgcccccgtgatcagctgatgtgtggaggcagctaagagcccgaagcctgagtgcagcccctggactccacccctgtgtccattccagctgttgttttctctccacaccctttcctgcacgcctggtcctagactggacttctgccctgtttcttttaggatgctgccagagggagattttaaaaatgcatgtctgattatgtcactctatacctaaacatcttctaaggtgacctattgcatttaggataaagattaaaatgtctagcatggcccagcagggtcagcacagcctggctcctccctgcctgctctccattctcatctcacaatattttgaaactttttcacaatgttctaaacacaggccttctatcaagtacataaaaaaatgatattgccttcttcccaggaactggacacgggcctaaagccctcttaacctcccttactcatcttctagacttatgcttgtcattcaggtcttggcttgatctttactaccttagagaagctttccctgatgctcaatgtggttggagttcccattttatggtaccatgaacatctctttttcagcatttaccatagttatatgattatttgattaatgcctgtctctcctacccaactgtaaaactccatgggaccagggattaggtcataaaactccatagcaccagggattaggtctatttttattcaacattaatattccaagtgcctacacaataccagagtagatacctgatacatatttttttgaatgaatgaatgagagacaattactagaacgatggatataatcatccatgtgacatcaggtatcaccatgcctggggaccttctgtaataccccgactgcccatatctgatttcctggatgttgacatcagcctgatttgaacctgaatttaccacacccagttcaatactatgattcgaactaagggccactctcccttgccagcatcacatctcagtggcatttcaagttcttgtcccacccttttgtatctcatttctctccctcttctagctttgccgttgagattcaggatatgccaaggctgagaggccaggacaggtatgacatgtggtatagcctctttcttcttctattagatttttttaaaacaagaaatgcctgtccttttctgtaagacagttatgatccctatctagcaaaagttggtgatacataagagtgcttctcatcaccttgtcttaacaatgcaacttccttctggtttttcttttaacattttattacaggatatgatatcttaggccatacatatcgtttttcattctcttctctgcttattgtcttctaagtttactaattctctcttctcccattgtttgtgttgtaatataacctatggtcatgcctggtgtaccctacatagcctccagttttaaccagtttgctgcttttttttctcagatttcatttttagactctgtcactcgggtctgtctcctgctggatgattctggtagccaccagatcagttggagaaggcccttggtggggacaaggggggtccgcaccttgctcttggggcttctcagcagacatgagccagatgctctgtgatgggaggcgctgcattgtcagctacctttcatagccaccccaagtcagctctgcatggcttcagtcatttctgatgcagttacagtctccagaaaggactgagggttgggagctcactcttctgagtggttagcatcatagcattttgtatctggaaaacatcttagagataacccacccattcccatgttacaggtgaaaacagtgagactcagaggccataaattattcgtccaagcctgcacagttagtgccagagcctccagtctagggctcttcctatgcttggaggaggccatttgtttgtaaacagtttcctgttagtcaagagaaccagaaatgagtgaagaaagctcattctaaaattccagtcttgctgacagggttattagaaaagacatagaatttaacatttcatatttagtgtagattgttttgaaatgggaatctctgtatgtatgaatgtgtatatgtataagtgtgagtatgtctgtattatgaatgacagtaatatgacagaaatagtttaagataggaaatggcaaatctgctcctctgtgttaggatgattgaccctggtagcaattaagaggcatagttctaagccagtagactctgtatatcatttttgacaccccagttttctcaagaaatatttgaggtttacacagcctgatttgagtactgtttagggggaaaatgggtggagaataaggggtgggattgtggggatctttgattataccttgttgccccaatacggcaggtactccctgcagacagctttggcagaatcactggctgccatggtgtcctgttacacagaagcctgctggccgcaggaacaggaaatagccttttgtatgcgggttcaggctttgctcccattgacttgtttcctcccgtctgcatcaagttcagcaccctgtccctggtgtgccttgttgtgagcaattcctaggaaagcagatcctccttcacacccacacatgtttaaccaaagtgtttacaaaaggagccttgctaatagcagctgccttgtttccagcatacctttgggctttcagaaagctctctgcctgctctgctgcccccactcaaacttactcattcagaagagaattggatatgttttcccggagtcagttcattttcctgggatgccttttttttttttttttcttttctgccttcctcccttctcaatataactccaagtgtttagggttcaattatgcagatgcgaaatttggctttttagtcatttgaaagtatggagactcctagagctcatgactcttctatatcactgtaggaagtgcatagccaccccctttttgttccccataccagtgattgtacttcagaagctgtggtcctgctcaaaaaagactgtttgctttcctcatctccacaggtttacataaagggttgtctccatttttgcctgatgaaaggcaacttgagacagaggaaccacccctctcccaactagcatttttgagcaccccctgggtacggttttgccttctgtgcttttatgttttgtggtttataggatggaaagcagatgcaaccactctccaagaagtctaagctgaaggaacaccaccctagaaggagaacttataaaatcgattctgacattggtgctccatggttcctttccatctttagagcgtttttaaaaacacaattccatgcttgtgacagactttgcctcggttgaaacacatgctgaagggattccttatgacagatgactggttcctttttacggctttcagtggcttctaccttagacagaaaaagagaaattaacctgaactcttaatagctagatttggtctactctcacggaggaaaccatgattgcttctgaaaatgtgttgttgcagatctgaggggtccaataaatagccttccctttattcctggtggtggttcttagtgtgctttctcggccctggggacccctttcttcctgggttcatcctcagggcccgcaggagcagccctggtcctctgctttgttctcttctctcgcatgtagtcattttgatcaatcacatcctgtctgtgagtacagcagacccatcagataggaaagacctgattttctctctcaagtttatgttacaggtcagatttgattaccacttccctctaagaccccctattttaggtggcaggagagaagttggtggagaaataagagtggagtcatctttagtgatacgtagtgcctcagatttcccaagcactcaagagtgagtgcataaaaacccaacaccagagggttgttcatatatcatatccatataaaaacatgtcaatttgttgaatttctctaatatagtaattaaaataatattgatactgtttctgaagattgccatataaaaagaatgaattatagtttttaaaaaaacataaaaatatttaaagttcaacaacagttttgttgttgttgttgttgagacaaagtctcgctctgtcgcccaggctggagtacagtggcgtgactcagtgcctcccaggctcaaatgatcctccctcctcagcctctagagtagctgggaccacaggcatgtttcactgcacccggataatttttgtatttttttgtagaggtggggtttcaccgtctctacaaaagcctgttacccaggctggtctccaactcctgggctcaagtgatccacccaacttggccttccaaagtactgagattccaggcctgagccaccgtgcctggcaacagttttctttcctttttttttttttggaaactttctgtgacatagcattgatttagcccccgaaaacttgtaggtagttcatggctttgaggtgacactctggctgacctataactgcagtcagccagggtgtcaccttaaggccatgattaaaagtcaaggatatttgtgtttatgctggagtgttaggacatggttcttccctccatgtttctgtagatttgaaaagacacaccatccaatataactctgggtgaggcagggtgacggatggattatccttgctctgtgggacctgaggctgagataaagacagtttcttgtttgtcgttaattagtaggtttgtctcagagctaggccttgtatctttcctattagtaactttaggattgactgatgatgcctgaaaaacatctatcacctgttctgactcatccaatttgagagtaaatctcagaagtctcaggtttcttcaggaagttgagttcagaaattgtttatgagatcaggttaaggtgactttcctctactataagcactaataattgtccataaaaagcaaatatgttgtaatcatgtatttatgacaggattatattttcttggtgattgcgcatttaggaagtgaagacattttacagccatttttttccccactaaaagattgaaaaggttaaagtgtacagtatttgaaaatacacttaaaaaattaggatttctctgggaagaaaccaaaacttaagaaagaacatgattaaggttaagccattgtaaaaggatatcaacgtgactaacacggacatatatgctccaaattgtgaactacacggtacaggaagctctcctaaaaattgtactctgccagaaaaagaggtcaagggctagaaacaaatataaaatgaaggttcagtaagatagagtctttaactgtgggaaacatttatcaggttctttccatatgctaaactctatattatattatctcatttaatcatcagacaactttatgaaggagatattcttatttactcccattttatagatgaggaaactttaatcttagatacgtaatttgtccaatcacacagtctggaaatggtggagcttggattggtaatcactcattcacaaggtattagagaaggcatgggggtgtttggagaccatggcttttgtttaaaaggttgctatcctctttaaaattgttttttatgctagatctagtgaaccccataaccccatatggcagttcttatatttcctttttttttttttttttttttttttgagatgcagttttgctcttgttgcccgggctggagtgcaatggcgtgatctcggctcaccgcaacctccgcctcttgggttcaagagattctcctgcctcagcctcctgagtagctgggattacaggcatgtgccaccacgcccagctaattttgtgtttttagtagagacaggctttctccatgttggtcaggctggtcttgagctcccagcctcaggtgatctgcctgccttggccttccaaagtggtgggattacaggtgtgagccactgctcccggcctattttatttttctttagtaactctttctttaagtcattctcatagactcttaggacagtgaccttgaaagagactggcttgactctagcctatcctctgagagacaaaaagacaaagatagatcttctgacttgtttagggatcttgagaacttacttttcctaatcttggatatttggaaaggcctccactaaaagcaaaactatcctttaacagacttttctagtatatattctggcagtcaggatgtaaaacctaaaacctcacgatataaacctctttggtagcttaaagagaaattagagaattactaattatgacttaattttaatattttattattcactcaagccaccctgaaaggttcattcaatagttgtttattgagtactatgtgcaaggcattatacttagttatgctgaatctgatcttggaagtctttaagaataacaacatgagacaaacccagctaccctagatagcatagagtcatattttaatatttatttttaataatgatgattttccatttaccatatattatttaatcttcagtctgaggattcaactctttgagatagtattatcatctccattttgcagatgaggaaattaaagctcagtaacattgagaaacacagcccaggtcacaaggctcaggcagggccttcaccatgtgagctcctaaagagagtcaaaatagtttttctgtagtactttatagttatcaaaatgcttttacttgcattatctcattttccaaaaatgagagtatttattattgtattcattatatagatagctcttgtatttattatatacttaatatgtgctaagagtgccaggtaccatattagacatggcctagttcatgtaatcctcacaaaaaccctaataagtatcattattcccattttatagatgagccaccaaggcctaaaagtttaagtgatatgctcagcacagcagggaggtttaactgaagcctaggtttgtctgcacagccaggatgtgtgaccactttactatattcacttttctgtattatgctgcctcattttccagatgaggaaactgagattcagagttagctaacccagatgaggtcatacagcttatcaatagcggagctggcacgccaactcagatcctctcactagaaagcccacttgtttcccactgtactgagccgcctttctgcacaaggagaactgtatcttacatccaggttgagtaccctaattccttttcgtcattttttacatttctttgtatttgttcttgtttttaggcagggggccctagacggatgacttgttgcaggagaggaatggtataggttaaactgcttgctcaggaagtcatctggggaagttagatgagaactcaaatccaaatttgagtcctgtgtacccaacttatttagctatgtggttctcaacctctttgtcttttgaaaatgttgcttgagagaaggacttgcccttgcgagactgctttcctgtgctgtaaggaatgaatctttttccatctgaagatcatttaccgtttctctgaatactgaattacattaatggtgtaaggcaaggaagtatgtcaatatcagatatataacaaggaccagtcactcagatttgaaatgttgccaatctctacaatctcggccttgagaattttaaggcacagaagcccgttactttaatgatcaattatcctttagatttctgaaggaaaagtttgttaaccacttatagtactgcttttttattcaaattgcaaactcaggtaaatgttctttaaaattgaattggatgacatttttctgtatatgtcaatgtcagtaaacatccgataaatatccaggtgtgtttaattattttgactcaaggaagtatgtcctatttaaacaatctttaaataaattgtttctgaattgaacaaataaacaagaaatagctgaactaaactgctgtgactgtatagaaaaactgagaggttttaacggaggaatgatctaaaaatccgcatcttattatactcatttttacttttagagataaacctgaattaactgttcaagtatattaatagtttttattttcaaagaataataggtgatgtgtagggataatttgaaacctattccaagtgtattaactccagttcagatatgtttgaaacatggaacttaccctatgtcacccagagttttttttttaatatatatatgtatataaaataattaatgcctattaagtctattttgtgctagttttctcttaatcgttttctcctgtaattttcatatccttatgattcaggtattattgctgcccctccttcctcaccttttacagatgaggaaactgaggctcagagtgactgagtaattaagccaaggttacacagaaagaagaagtctcagaacttggacctaattctgaacattccaaagtccgtgcatattctaagataccaagctatcttgtgaacagcctggtctattagaattttaaaaattaacataatttaaaaattagcataaaaacgtgttaagagaaatttggttatgattttgtttgattagccctcaagtaagagcaaaagagtttgaaatacatactttttttgctttggaaacatacagcacatttacctttttttctgtatataagcagaaggtcttttaataaatctatgtggccttgagtttgtacctccaagaaactcctagagatacatcaaaaaatattgttaatgttcagcaattaaacctaaacagctgactgcccattagttttattattacaatgactgtaggtaacactaggccaaattccagacatgtgacttcttctaaacagattccagtaggattaaaaacatttccccgttctcctgttttggggcattttcttactgtcagaaactatggtgcttaacattgaaactggctggtgatgaaacttttcagttcttaatggtagttgactttgaaattaaatttttgtctttttcttccgggttattttctgttttagctttagcatgagagtaacgtaactggcttccctccttcctgttcatcttacgtgctgcccctccattctcattcctgcccttattcccttcaccccatgctagaaagggccattccattgacctgcctgaaaagaaagtgccctgagatgaaatcatggaatcatgcactttaaaaccaaaaagcatgtctgaaagatagtaagtagctggatatgcagcagcgaaaggcacagtctacatagtctttaaccaagttaattgttcagaaaatattctaacttagaaaaagttatccatgttcactggaggaattttagagatacagaaaataaatataattccactttgtaaagataaccaaagcagattgttttctaaatgactattagactttcgaaattgaaatatttggaagagagagacaaatagtctttatgcatcatccattttgttgctttcattgagactcaaagtctagaacgctttgtgctatttaaggcctgaaaggatggggttataagagataaatagccattccttatatattatatatatataagccatttttttttctctccctgtttttctgctttttcctttctgagttttgggttgcatgtttctaaggctgcaatggttgctatactaaagatttttctttttctttttcccagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcaggtaaagaccgtgctttaactaaaaatccatccctgcacaggggtcggggggagtgggatgggctgagcctgtctcatccatgctcacagtgactctctattagaggcatgtgggcaagggaatgacaactggcaaattaaatcttctgaattatggggttatcaaacactggaacattttaagtcaagagactgaaaatccgctagagatggcatacttttaacatggtatttaatgccgcccagttagtgtcctgctgaattgtatcccatttggtgggcactgtctcataactagggccttttcctgagggtattatgccaggatttcctctgcttgtgttcctttcttttcgtaacatctgcctataaacaagattgatggcacagccctccattcctaaaggcttataagtcccaggagtccaagctagtcagttccaagagagagcacctgcaaacttaggatctttgtcagaaactagtcatttgaagtgctgtgaggcctggaagaatcttaaaagacaatgcgtggcctctgagtggctaactcaagaaggaggcagactttctgtgaaacataatgcatgctgctgtcacttgcagcccggcagcccagtgctcacaattcctctgttccaaaggcaccacagaaatgtgtggcccatggggagagtgtgtgtgacagatgacctggctgcccctctatcctggagaattcatcacagagagccagaaagtgttcacaaaaactccaaactgacaagtagagaaaagttaaaggcccttagctgactatatgagtcccatgaataagaaaagaaacctcttggtccaccctgacatatgaactgcaaacattgtccccactcaatgacgtacgtccacagaggcacacaccccattggatcccacgtttgccagatactcttctcagcgttcgggcccctgcacctgtttgactcctggccaggttaatgcctttctttctttctctttgtgtttctgtctctgtttctctccctctctcattttctgcaaagctcgaagccgttactcactccgctgagttgcatcactgacaagctgaagctccaccagcaggcttgcgggttttgattagttcagactcctttatttctttcaacttgggaggagggaaggctttgtttctcaagcaaatagcaggaaagggctctctggtcctagtgcctcacattttctgcagcagatggactcccatgggggtgagtagggaaagaagaggggtggagggagaattgcaaggttttttggaaaaccatgttaccacttttcattatgactcctgttatcatttttacgaatcacatagtatgtattggggaattgtatagagtatagaattttagttatcatttcccttgcctgggatcaccgtcgccttcaggcaaacattaattaaaggtacgggaaaggatgagtaaggcacagtggggataacgaaggctgatgcgggattaaaagcataatgttgatggtgttgagttagttctggttattccttctgcatttcatactgagaggctgttttgttttacatagggccgaaaggacactttgacagaatagacttatgcaaacttgcttctgtttggggtcccctggggcttccatctgcccaacccactgtggctgaagcagattttgctgtttttttctctagcagtacctacaagaaaaaaacctcagggagtgatggtagcattagagacacttaactacagcagtttcctactgaggtatattcctgtgagttcaccaggaaagccattgaaaataacattggaaaaatgctgcataaatgagtagtcgtcattgtttatcatgtacatgtgtaacggaaaacagccagattatttcaagttactttactgagggttacttaaaacatttccacaaaacagtacctttcccatttcacaggtagggaggcaggagcagaaactggttaattttccagccatgtatctatcttaggccacaggtaggagtgagcctctggtttaaactggtttatactgagtttagtccagttttttcctccaacccttaacatttctggagttgtcactggtaaagtaacatggtgccagggtgggaggttctgtataaacagtaaagagaacagaaaatccctcttgtcagcatgtaggtagggaaacaggaagaaacaactagacatggactgtcagggaactggaggagccgtgactcacctgaccttgccctgggctgcggggctgtgcctgcacacccaagcactgcctggtggactcaaggaccatgtcatcggagtgtgcaccatttctaattccctggggactagtcctgggagccttcttgggggagcctgtctcataggttcccaggtaccaagttagacaatttatatcttatgattcctctcaacatctaaacccaatgtctaagtccatgacctagaggctcctacatgtgagacttaagcatgaggggttttttaatttgggttttttttttttttgtttgtgtgctttagtaaataaagtcctttggattgagtccattcctgtgcctttagtcttcataatgctctgtgccaaataatgctgtttccacataacgcggacagctaaaaatactaacctctatccctgtttacaggcagtcctgtggtctctttttgaaatgctttccagaacagtttatgtttttgtgtgcattgatcaattttcatctccatatctaaagggatacacaaaatattctcatatgattttgggtgagaaagaataaaattcttcacttcacagtaggattggatgttcggacccaggtttttatcccagctcatacatatatcaggcaacttcttacttctctgaaacttagttttattatttgtaaaataggcatacaatattcatcttcagggttggtgtgaggattaagtgagatacttcatataaagtgtttagaactggcctggcacatgatatgtgccaaatagattgtagctgatattatgaagctaaaattgttttgtaaaaattctatatccatatgtaatttacaggcaagtcttgttaagtgagtcaaattagattagataaaaatctaaacttttaaaggggacttttccttcagaaaatagatcaccgcagggcatatttaaaacaaagcccttagattatctaaataagttaatacccacatggcattcataaagcacttaatgcagtacctagcacatagaactcctcaaatgtttcccattattattattattcgtagatttaaaatgaatatttacagagcaaaaagcaattgggaaccattcacaaaaaagtcaataaagcattaagagaaaataacgattcaattatgtcagacaatagaaagtgctgagttacacttaaattaactaggcatgctaatgctgtgttccaagggatcataggaatagaaacaaccagaaagatccaccagaaagaactgttccaaaagaaattccattttctcctaaaagaccattccaaagaaagaccatgatttaatctacctaaagaccttcagagaatccaatatttcacctttctttattagtatcctttcttctgagtaattttcaagcatggcaacaattctagaagttaataaatgacaataatcacagtgatattatattagatagtcttgtagttttcctcagaccatttttggaaggaaggtataaacaaaataagataaaatgataaaggtatgttacctacaatccttactttactgcagagaaagatataatactagacgtcttcaagttcagaggtacaatacaatgattcaggaaatatttccttaacattgggtagccttaaatattgtaatggaacaacaagagcacatataagtttgtaattgaatgagaagttattgccatgtaattgactaacaggtgtatgttatggtaatgagtttgaatcatattcagttgaattataaaagtcagcactagtctcagaaaccagtctagtgatgttacagtgcagaagacacctcctttcctaccatacttacattgatacatatggcctcatcatataataatctgtatttaagtagcactcctatccccaggtgattttatacattatctcacttcatcctacatgtttctaaaagattattcagtacacagaggtggccaaagttatttctcattgattctagtcaagggtaaggtgtgacaaggcaagccttatatgacccgaaccactgcatgtctttataattgcaatcgtatcacccatggcagttttgatcttcaaagcacttgtgaggcttgacacaaagattataattacatttctggaagtcattacaaaatactatgtaaataaataattgctgactttcaaaatgtattttatacaattatcctactatggaaagaagcacaactctttattgaggctgattgtttgggtcagagtatgagtctcctagagagcttacacaggttttttttttcactgcaaataactcctccactatcccactcatttgagtgaagtagcttagattaacctaagtctgtaccactctttggcataatgaagtagaagggatttatacctttctgatgctttctggaggtttcttagagacttaggatatgttagttaaagatgcacaggtaagatgcatcttattcatagatgttggctgcctcagttactctgaaagaggtcactatagatttttttttttaagagacagggtcttgctctattgctcaggatgggatgcagaggcgtgatcatagctcactgcagccttgaattcctgagcttaaacaattcccccatctcagcctcctgagtagctgggactaaaggcctgcaccaccttgccaggccaatatttttcatagggacaggatctcactatgttgcctgggctggtctcgaactcctggtctcaagtgatcctcttgccttggcctcccaaagtgctgggattacagacatgagccacctctccctgcttgccactatagattgtatggaagattcttctctgcatttatggggtttttgtttgttgttgttgttaacataggacagagttaatctttctgtaaggttatttttttcttctgcttaggaaagtagtcttgaatctcttatttcaaaatatgtaaatattaacacttttcacttactcaactgcacaggactattgaagatgtctccagttttatgactttcggtggctaaactataatattccaaggtcaggagaataagcattagtttaataatacaattattaaaaattattttatcactactacaaaatctagaaattgccagtggaaaaaccccaccccatttgagtactcaaggtctgtcaggaggattcaaacccagtagagtttgaggttgttcattctaaaatgtcccttataacccagtctctatcaagtccaccgagtcaagttcttgaaaccagcagcttcgtaatgtgccaattatatgtgaacatttattttagcagagcagctcttaactcacaggagggaggaatgccttaagaaaggttaaaaggaaaacttcagcaattaatactaataaaccagaaagttaaagcaaccataataaaacactagagcatctactttttactacagaaccattcctttcttaagagccacctgtttggtagacatactctgccacagcagccacaggcaaataattaagtttaataggagtaactcttattttgaagaagttctccgtttaaagccacagagtggggaagttattaaattttatggaccctaaacaaaggcaagccctgtgtcaaaaattgaatgttccgtattcttcattatatcgccactgattggatggattacttttgcattccataagttgaaattcatcttgctttccctaaaaatagcctatcttttgacatagcagatggtgttctaatcttacctggacctccgtttactctaatttttgatttactgctgctgaggcccaaagaagtggttttcattcctactagatcagttggagataatagttggtccagctcacaaagtttactaagcttggttgtatgattaattactgttatttgtagctacactgagatactaaagctcagaatgaaacctgtgtacatggtttgactctgattttatacatggtttttctcagttgtttttgtggggatttatttctgacacatgtacaaccacccacacatagggaaaagatttagtaatgaaaggaatcatgcttttgcagggatgacaaacacatggttatatattttattgaggatttgctgaaatctcctttccatcaaagaaaacttgagtgtatgaacctcatttcacccaaagtattaattttctaacgatagatacagtggcttctgcagtgcactggggtctgagaagagggggcgcagtttaacttaggacacctgagttttcatttcattgtcactaaagagtctttgtatcattctcagatacagttaatttattgtgcctcagtggtcctatgttaatgaattactagaaatcgctgaatcatatatctcagaggctctgcaaggagtaaggtgctatctgtttagggatttgatgttcttaggacttttagtaaagtttgccttaccagataaatgctagtggaaaaaggaggtcgcataattatcttctaaagagtagaaatgcatgcgacattattacttttatgtatatgtcttaaaattaatactttattcttttgagagattttaagtttacagaaaaatggagcagaatgtatagtttcttatattctcctcctaccatctcccactttctcctgttatttacatcttgcatttgtgtgatgtttgatgtaattgatgaaccaatattgatacattgttatgaaataacgtccatagtttacacagggctcactctttgtgttgtgcagttctatgggttttatcataatgccatgtgtccaccattacagaatcataaggagtagtttcattaccctaaaaatcccctgtacaccacctgttcatctctctttcccttctcttttcctgagcccctggcaaccacagattctttttttttaactgtctctatagttttgccttttccagtgttatatagttggaatcatacaataagtaagtagcttttgcagactggcttctttcacttggtaatatgcatttaagttcctccatgtcttttcatggcttattaatgcatttcattctaccccgaattgcattccattggaaggatgctattatatatatatatatatgtgtgtgtgtgtgtgtgtgtgtgtgtgtgtgtgtgtgtgtgtgtgtatatatttgagatggagttcgctcttgttgcccctgctggagtgcaatggcatgatctcggctcatggcaacctctgcctcccagattcaagcaattctcttgcctcaccctcccgattacagactgggattacaggcacccaccaccacatctggctatttttttgtatttttagtagtgatggggttccaccatgttggccagagtggtctcgaactcctgacctcaggtgatccacctgccttggcctcccaaagtgctgggattacaggtgtgagccactgcacccgaccggatgctattatatttttaaaatcatcaaaggtgctctacctgaacctgaggatactatcttatcttccattttccttttgttgctgactttgtcagtggtcgttcctattagaaagcatttcacacatttcttcctggagaagcatgttttctatcatagcaattgtcaccaaatggttttctgtatcttgggtgcatttttaaattaaatatttttttcctaatcttgcccatagataaattcctgaacatctactgtttggtggtcatgcataccaattcaaatacggaacataccaagttaaaataacaatacagttatgtgactgcttagttgtctcccaaaatatttgactctcctaggtaaaggggggccttttctcttaaaaatgcctggcattccttaagtgtgctgtgctatttcccacttccatgtcagcccatttctttgcactggggggcagggccctgttgttccctcttgggcatgcctttcccaaacaccactttcttcaaagtgaatcgctgtctcatctacacccatttgtatgtcatttctgtactttggacacacctctaatgtgtacatatctttcttttttttttgagacagagtctcactctgttgcccaggctggagtgcagtggtgtgatctcggctcactacagcctctgcctcccaggttcaaaagattctcttgccttaccctcccgagtagctgggattgcaggcatgagccaccacacccagctaatttttgtagtgttagtagagacggatttctctatgttggccaggctgcgaactcctgacctcagttgatccacccgcctcggcctcccaaagtgctgggattacaggtgtgaggcctcatgcccagcccatatcgtcctttagcataaaaatttaattgcatgccattctccttttataagcttcttaaggacagtggctatgttttgcatattcttgaatccttataacctagcacagtttttggcacatggtaggtgcttaagaatgtttaatgaaacaagtattagtgggaaagaagattttaaaaaaaagaggaagatagatatgtaggagaaaaaaaggaagaaaaaagattttgttcacctggaacaacaaagaaagggcaaaacaagagaaactttcattgctgataaggacaggaaatagcacagtaagagtgtgcataagcagtatatatttttatctccaagtctttttgcaatatgtttcatatttagaacacatatcaagactgtatctgtttccagaacttgctgctaacagttagtaacaatgccaaaacatattttaggtccagcttgaaaccaaatgatcaaatagaatttttgatttccactttagagtctgacattaattatagccatcatgtaataaagtgtcaaagctcttttctgagaaaatgatagaaattatgttaactaatctgtaaactgaagcacagctattcctctacaacaaagcaaaagatagggttttgacagctatcatttctcatagtcttatctttttcaggctgaatttttcctgtatgccccacctctgcctgttttttttgacgctttctgtatagtatggttgcaggtcatcctactggtctggtcagtggtctctgacacagttcattagtgtccatcttaacgcctcgtacccagaaccaaactattcctctcttctcaggctctggtagtgcaggctttagtggcctttgttcttttggtgaccatattacactgttttctcttatttgccacttctgtcaatctgcatttctccaattatttacttttagagctgtttttttgtagatccaaatatgatactttacagttatccctgttaggttttaccttatttaattcaggtaataatttctgcctgtctagaacattttagattttaataatgtcatctaatacattagtagtccctggcattccttcctgtttggaatgcttttctttcattcatttcagtcatttcaagtcagctcaacaaatatttggcatgtacttaaaatgtgcttatgcaggtgagaagtaaaaaaagaaatagaagatatagtctctgccttcaagaagctttcagtctcatttaggatacaacataaagcaaatgtgatggttacattatagtactagcccatgtagatgccaaaaacatgcaaagaatgctcaggattttaggaaaggagatctcttttgttcctttgctctattataataattcacatccgtaaccaacttaaagccatctgcattaggaaattaaaaaaaaacaacaatcccattcagctcagattatactttcactccgaattgcttcaacaattacgttttcaacttttaaaaattacgtatgtttgatgtgtgtggcttcatgtttcttaagatgtgacaaggatatggaggatcttgtcttttcccagctagactgaaagctcccctaagtcaggggcctagtcttctaatcctttgctatctctccagagctcctgctagattgaagactcccattggcccagggcctggccttctaatccctttctatctctaactcctactccgatgctcagcatgcataatgtcgtgggaagtactagcattcagtagaaaagtctacccaggaatcagtgctgcatgcttcagggttcttatgctgtgactattattagaaattggctaatagatctagaagtaagattctataggagactaagacaatttctgtttacctttatttcatatttcgtaaatgcatgtatggtctcactatgcaatatgttacggaatatgccagcaactctgacaaaatcaaacaacgttgttgctctgcttcagcatatacatccccatatgcatgaatccacctactcattatattgataatgaatatacatataaatagtcttgacaggtctattatttgtgatattaataaatattagccaagttcatacttttttcaggaaaaataggatcactgacatccctatgtcttaatattatttgattacttcattaagcattgatttctcaggaaacattaactgatcactgttgatagaaaggggacagaggaactgcatgattattattattattttattaattttttgagacagagttttctcttattgcccaggctggagtgtagtggcatgatctcagctcactgcaacctccccctcccaggttcaagcgattcccctaactcagcctttctaggtagctgggattataggcacctgccacgatgcctggctaactaatacaaaaattattagtagagacggggtttcaccatgttggccaggctggtctcaaactcctgacctcaggtgatctacccgcctcggcctcccaaagtgctgggattacaggcatgagccactgcgcccggcctgcatgattattttaaattagctcttaggtttgttaacatgcagaaatagttataaggggaaatcttagaaaatagataactaggctggtgcggtggctcacgcctgtaatcccaggactttgggaggcagaggtggatggatcacgaggtcaggagatagagaccatcctggccaacatggtaaaaccccatctctactaaaaatacaaaattagccaggcgtggtggcacatgtctgtaatcccagctactcaggaagttgatgcaggagaatcacttgaacccgggaggcggaggttgcagtgagctgagatcatgccactgcactctagcctagcaacagagcgagactgcatctcaaaaaaaaaccaaaaacgaaaacaaaaaaaaagagataactaaacaagtaaaaagcttttttctaattaaaatatcttatatgataaaatgcaaatgacagaactttaatttgaattgttcaaagtcatttgtggacaacactttgtttcaaatagttcagtcattttcagacttcttttttgttttcctgaaatgcaaacaggaaggcgtattttctggaactgggtcagaatttaagtaacttggtctgaggcaaatctaggaccccatttgactatactgcctaaatttttttatatgactcaataaattaatgaatttcaaatccatgaaagtaatgtaaataaaaataaaatgctgcacaggcaacattgttcctaaatatctcagaggatttttttttaagtagaaacatgtcatgtattttccagagagactgtgaccttaagtgatcaacccataactatgcagcgaagcatgggagactaggaggagccctgtgcttttgtatctaaagcttatcgccatctcgcgctgtacccaaaacggtcaccgttccagctctctgtggtaattagtaacaatgctatagttgatggaataaaaataacacatataatgatggttacaaacacaccctgacctgtgccaaggagagcagtgattcatgaaaaatcaataaataaacccattgatgtggtcacaataaatccgtacataattaagaagaaccttttctaaataaaaactacaaaggaaataaaaacaggtttggaaaagaggaaaaagtctgataatagcgttatggtactcatcattaaagaaaacaaacttgtaagctcccaaactacaccttaggaaaacagtacattctcagtgtggcttaaagatatggtagaggctgggcgcggtggctcatgcttgtaattccagcactttgagaggccgaggtgggtggatcacaaggtcaagagattgagaccattctggccaaaatggtgaaacctcgtatctactataaatacaacaattagctgggtgtggtggcgcacgcctgtagtcccagctacttgggaggctgaggcaggagaattgcttgaacccgggaggtggaggttgcagtgagccaagattgcgtaattgcactccagcctgggtgacagagtgagactcagtctcaaaagatatagtagagaactgacctaaaagattccaaaaaggaaagagtttggccctcagagcagttaacaaagaaagttaaagttgttctctaaccttagaaattggcaggtgccacagatactctttgaagggttaataaaacctcacataacctctttaatccagtaggtggttgaaacttttgaattgggtcttgcctcccaaagaagaattgagttcaacactgataaaacagcagttgctcaataaaattgtgctgaattgatttggtttatcaggaaaacatttcttccatgactcaagcatgtagagtggtaattaaacattcatagcatcgttgacagtgtattggaaataggagttggctgggaattgaggagcctctcttttgaatttcagatgtgcctctgagttcttgagcaggtcactaacttctgtaggtcttagtttctttaagcgtgaactgagttaattgggctagtttttccccaaggtatatcataaagtttttgatgtctgtgattctaaattaaggcctgaaagggcaggttttcttacaggagagatttagtaatcatcacatcagaaaactaaattccggctgggtgcggtggctcacatttgtaatcctagcactttgggaggctgaggcgggcagtttgcttgagcccagcagttggagaccagcctcagcaacatggcgaaaccccgtctctacagaaaatacaaaaattagctgggggtggtgcgtgcctgtagtcccagctacttgggagactgaggtgggaggattgcttgagccagggaggctgaggctgcagttaactgagactgtgccactgcaccccagcctgggtgacagagactctgtctccaaaaaaaaaaaagaaaactaaataccaccatcaataataacactaaaggctaatatagcatttaatcgaagaactaaattaacaggagcaactatgatagatgtcaggaaaggttttgttttgtatttcagttaagagattctgatgagaagcaacctaagatcaggttatttaataccaaaaaactgtacatttagatcttgatacctgaccacagctgaacctgtctttaaggtgaagccttatatatgtgcatgtgtgtcagaatccatagacaatttttgaaatcccagatttaatgtaaaattaaggaattttattgacatctctcatacccttgcatggttttatgtaatttatttgttaaccctctttacatgagaatggtacatttgtaagtgataatttatcttactggagaaatgagaaccttataagctaagagttattaaaacagacgaattctgttaataacagaataaatgtgatcacaggaccaggctttctatattaaagaaattagatctatttaaagaaaatatgatttgaatcataacgagatttctcttaatgaaacattactgtcatagtgttttatgactgcatgataaaaatatttaacacaagttattgccaacattaaagttactcatttattgagcaccgttctgcccactggagatactctgatgatcaagacagaaaggctcttggaactttttctattggcatatggcataataattaaacagtctttagagccaggtctaaattcaggcttctttactcactagctttgtgcctgtggggaggtaacttagcttgtttgtacctcaatttccgcatcagttaaatgaccatataatctaataataataatacctgctttaataggttgttatggggactaaaggatagttaatatatgtaaagcccttagaataatgcctgatgctcaataaatgttagctattactaccaaagggtgggcaattgaaaataataaaatattatctagggatatgtactatgaaagaagtaaaatagagtgatgtgatgaggagtcaatattgaagctgagatctaattaacaaaaaagagttagccctgtcaagatcaggaggaagggagggcattctaggcagtgggaaaatcgagtgcaagggcccagaggtgggaagactgtggggtgtttgagaagaatgctcagtggctggagtgtgtagatgacatgaagttagagagataggctgggtccaagttatgcagggccactacaggtcaagatcagaggtttagatttgctgttatgtgcagtgttaagccatttggcagattttaagcagggtcttgatatacactgatttatatttttcaaagctcactctggcggttgggtggagaattgtaacaggggtagggaggaggttaggaggcttggcagtcaccctagtgagaggacagtggcttgggcttccctggaaatggtggggatagagacactggagtagagagagaattttgctggtatcatcaaaatgctttagtaatgttttctcccaattgttagtttactttaaaaggaataatattgcatcttttacaagtttaattaatgtttagacactattatacaccctaagtgaagtggtaattcaggagttacttgatttattaaacaaatacagaactattaacctggaaatttcaggccagaaatccattttgagatctgaaatgttttgtttgactgaaaatttttaggtttttgtaatcacattttgttaatcttctgatttccaatagctttccttccttggcaccatgcaaacccagattttagtacaatgatgtacaatgatgagatgaattttggggactgaaagaacattatatgtttgtattagtctgttctcatgctgctaataaagacatacccaagaactgagtaatttataaagaaagatgggtttaatggactcacagttccacatggttggggaagcctcaatcatggcaaaacgcgaaagaggagaaaggcacatcttacatggtggcaggcaagagaatgtgtacagggggcaggggaactcctctttttaaaaccatcagatctcatgagacttattcactatcacgagaacagtatggaagagacccacccccatgattcagttacctcccaccaggtccctcccatggcacatggggattatgaaagctataatgcaagatgaaatttggatggggacacagccaaaccatatcaacattcttctcattctcaaaatgtatcttctgtatctttcatacacaccagttccttctactgcttctaaaatgcactttaggtcaggcgcggtggctcaagcctgtaatcccagcactttgggagacctaggcaggtggatcatttgaggtcaggagttcaagattagcctggccaacacagtgaaacaccgtctctactaaaaatacaaaaattagtcgggtgtggtggcacgcaattgtaatcccagctactggggaggctgaggcaggagaattgtgtgaatccaggaggcagaggttgcagtgagcctagcttgtgccactgcactccagcctgggtgacagagggagactctgtctcaaaaaaaaaaaagatgcacttcaatggaaagcatcatgcatgcaggtgtgaccaggctggctttgcaggcaatcattagatgatcacactgggcagtgcgtggcaacagctctgaagtgaagaaacacttaggcaaggggctatcagttccttcaggctggcgagctaatatccagcagtcaagaaaagtcagtccaggtgagaaaccagcacttgtcctccctgtggagtcagtacccaaacagcttcttcagaggactgagaaattggggcttatcttaaatagcaaggaacttgaattgataagggatgaggaacatgttctaagcagaatctcataaccacaagccaagcttataggagaaagctttaaacaggtaaccctgttggcatcacagttgtagtaagctatcactccattctcagatccttcaaccatgccctaaaaggagattcctcctcatgaaactctaaatttggggctctggaagttagcttcaagatcttatgcagatatgaacactttttcttatatttcctgtttaaaatgtaatgaagttccatttctccatggacacagctttctgttctttctggaatcctgaagttcagaggtgtgtgtactgaaaactattacagccatttgttagtttgttttaaaggaaaggagagtagtaaaatcaggacctggagagcacatttcccagtgaccaaacctactcaaaatgtatttgatggatttattttgagttttggaagctcaaggactccatagaagatacagttcaaagggtgtcagcatggggaatccagaataattctcagagctccaaaaacttcatagattggagcttcggatgatgggttggctgtttctttggctgtcaaacctagtttttaacctttctccctggttaaaaactaggtttgacagcccattgagggaaacgggaagaacaaagagattggtacaagtacaatctgtgagttaggcttattgcattccctttcatttagaagggtatagtaaaagagaatggaggtgaaaaaatgtaatgtgaattttctcactagagtcagaagcagcagataacagataacagcccctggaaaaaaacagtcactttaaaaaggaataaaattggtagggtagtttattgaaaagaggcgtgctttctccccatgagccaagaggtctgaatcctgacaatacacatgtgtgtaatgaattcccctcctcttcagatgagtggctggacttgcttatactaatgccctccccctccagtcttaaggcattggtactgatctttttcactccaacaacaccgtggtataatagtgaaaatcaccgcacaggtgggttaggagataggtaactaggagatagattaaaactagggaactggagatgtggttatctttcagcccatttgcagactttgcaagctagtatttgaggtgtcagctttggacttgcaaagccacagcttctgcagatggctaagttgccttcctcctgcactttaccacattccctggtacctaagagagaaaaactatttctccaaagtgaacccctcccaggggtcttcctaccaccattttaataaaaaggttaaatctcaaactgcaaattatagaatgtctagttagaagtttgaaaacaatctttgtaaaagttcattaaaatcaaataagcagtaccactttaggttatatagaaggcgatttggaggtaaatcccttcagttatctaaaaatgtggcaagtaagttccaacaagtgtaacaagcaggttaacactgagggaaacgggaagaacaaagagattggtacaagtacaatctgtgagttaggcttattgcattcccccacagtatcctattgcatatgaagaggtccatggtccagtgcagttagatgacagtggactctggcagcttatcaagctgctgtctccagaggatgctgctggtcatccaagagaagtggaaactcgggcatgtgcaacagaatatgtacagacaaactgaggactcccccaggaaggaggaggcatcttaggagggcaccttgaactcttctgctctgcttcaggaactccagagagtgagggaattaaaaaggagcaggactattgggtcctctgtaacagctcttttctgatggcggaaagtacttaaagctcacagataaagaacatcatgttagaacctcagacaaattaagtgcaggggaagatgggaagaattttagcaactaactccaaaggtgagagtaaaaataaatgcatagcaagacttaatattaataatacttagatagtgctttacatctatagaaagcactttcatagacattatttcatttaatcattacaacgcattgaagtatcaatactactatactcagtagtttgccagcaggaaatgagggctcagagacatttagagatttgttcagggtcatcaagtgaaagggatagagagtgaaaactcaattccaggtcttttagctccacataatatgcttttccctactctgcgttgctgtaggagtctccatatcagaatcggactttgctacaaaggcctgttggctatcatcctaagaggaatatttgttatcactgatctttccagcccaaacctggataacaccattaatccttactaagtagccaaaattcatggtttgatgcagatcagagaacccaaaataaagtaaaatggaccaaatccctaacaagaaataatagtggaaaaatctacctcccaattttgtaaacataaattttattctagaaattaaaaatgtacacattaatgaaatcttaaaacctcaaaataggccaggcacggtggctcacacctgtaatcccagcactttgggaggccgaggtgggcagatcacaaggtcaagagatcgagaccatcctggccaacatggtgaaaccgcatctctactaaaaatacaaaaattagccaggcgtggtggtgcgcacctgtagtcccagctacttgggaggctgaggccggagaatcgcttgaacccaggagacagaggctgtggtgagccgagatggcgccactgcactccagtctggcaacagggtgagattctgtctaaaaaaaaaacaaaactcaaaatatatggttttatatgtggggcgaggaaatttaaagctacttaaattttgcacgatatattctaccttgcaagagctggaaaggttgatacaaaaaatcatttatttaactttggataattcagatcaaacaatttgcttaaataatctagaacagaaaagaaagagaaatagctcacgtggtatctcccatcgaatatgggagcctgaagtgttagttttaacctcctttactgctaaatttaaggatgaaagactttcttaaaaagttagtagtgttcccattttcttttggcctgtgttgggaactgttgttaacaattacatttttttagtttttagaaaagatcctaaatttttgaattgacattttgtacatagaaaacctagatttttttttttttttttttttttttgcacattgaatgtatagctttattacctcattttgaaaactagtactgctttttaatgaatggggaccattctttgcaggaacagtatttctagtagaatttttgaaggtatttttggaattctcagacttgtccaatatgtagcaggatcagaattttagagcagggaaacccacagagatgatttcatccccgcccctctttttactgacaaggaatgtgtgggtcagggagggaaagggactccaccgtgatcaccctgtgaggcagggacagcactgtggccagaacccacatctccagttgctagtccaacactctagaattattttatcctgctactcttctcataggctactgacattgtattaaaattgctatccatggccattgtgacctgaagaagaagaaaaaaaatgaaccaccaatgacctcttcctcctctgcacctttcctcttttcacccgaaaattaagtccttatgaaaagattaaatagatgtggccctgcatctgtggcagcactgtctctcctgaccagtcactgactgttttggtccacatctggagtggactcagtggacatgattctcaggctgagaaaaataggacttggattttgtccttggcaggcagagaacttccactgtttgaggagctactactggactactgtgtgtttgtcccacgtcccacagctagctaagcagaccgggctcttttttttttttttttttttcacggtcatcaaaacaagtagctcctctcagacaccttaatacataattaggtgtgtctgtttacacttgggagacagagggcttcatgtcccagagaaatacaagacgtctgggaacagccacaaacagatgttgaaaatgtccatttgtggcgagtttattactatagcaccaggaataaacattgaagatgaaacccctctgaaggggtgtgtgtgtgtgtgtgtgtgtgttgagaggggaatgttatcgaacagagtagaaagtgaaaggaggttctattttttaaaaaatttgctctagtatttgtttatctcctgcaacaaggaaaatttcgctatttggctttggctgtttgaaggcttttgccaaatgcttaacaatctgtagggtttgatttctttcagaaagaccactttgagaacaaggctctatgtaactaagatgtgtttgtttttgtttaaatcactcagaagagaaatcatctcttgtccattgttaaaaagagagttttcaatcaaaggaaaattctacatattctaaaatatacaaacagctctttgaaactgatgccaaatcaaactctaaaagggacgtttttcttgcagaagttttgagttaattctgtgtgcagggcttgagtggaaaaacgctgagactgtcagaggaacgagttactacaacactacatttggattcggaagttacataaggagcattgtctcaggatagcaggaagactcttgtacatggttttaggctaaatcctaacaacaaagagaaagaaattctttgcaaagtcagtttttcagttaaataaaaggtagtagtttggttcctgatgtcactggatataaacatccagtgcgagaaggcataccagtcatcactttaaaaatatcaattgaaatgtgccctgtgccctgtttttaaagaaataccgtcctttcccctgttgagactttttttttttttttttttttttggagacagagtctcgctctgtcatccaggctggagtgcagtggctcgatctcggctcactgcaacctccgcctcctgggttcaagtgattctcatgcctcagcctcccgagtagctgggactacaggtgcccgccatcacgcctggctaatttttgtatttttagtagagatggggtttcaccatattggtcaggctggtctcaaactcctggcctcaagtgatctgcctgcctgggcctcccaaagtgctgggattacagacctgagccaccacgcccagacctcccgttgagacttctgtttggatggaaagtagtagatgctaatgaggcacctctattgggggaaaaaaggacacaaattggaaacccaacgcgttcacttcagctctgcactaatgagctgtgtcctcgagatggtgccttctttctctgatgaagcttccttatcaatgggtgcctatcctgactacctctcaggctctttgtgaaggtaaaaccaaatgtatgtaaaagcagtgaaaacttaaaaagcaaaatctgagatgttaccttattatttcatgatgatttttgagaggtaggttgatgtgggacctgatggtttgctgggactgaaaaaaatcagaaacagtttttgttcataggataaagagggcaagccagggaactgaggagagcaagagacgcaccacagaactaactggtagtcagggcagagctgtggctccgcaactaacctgaaccctctcaggtaaacacaggtagagtaagtaggaaaggcagttagttgaagatgtacagacagaaggcagatgacacacacaaatttcagtgaaagacaaggatttaggtcaaatctgctattgccatcatttttcccttagacacacatgtaaatactttttgtatgtaactgtgagaggggccatggtgtgtttaaagataaataggacagcattcccatttttaagcagtttaaagtctagttgaacacagccataaaaaagaaagatcatgtcctttgcagtaagatggatggagctggagaccattatccttagcaaactaatgcatgaacagaaaaccaaataccgctgcatgttcttatacgtgggagcctgaatgatgagaacacatggacacatagaggggaacggtgcacactggggcctattggacggtggaggctgggaggagggagaggatcaggataaataactaatgggtgctaggcttaatacctggacgatgaaataatctgtataacaaacctccgagtcacaagtttatctatgtaacaaacctgcacatgtacccttgaacttaaaagttaaattaaaaaaaaaggctatagaggtgattgcgcgattgttgcttccccagcacacttataagaaagatacaaatgggccgggggcagtggctcatgcctgtaatcccagcactttgggaggccgaggcgggcagatcacgaggtcaggagatcgagaccatcctggctaacacggtgaaaccccatctctactaaaaatacaaagaattagctgggcgtggtggcgggtgcctgtagtcccagctactggggaggctgaggcagaagaatggcgtgaacccgggaggcagagcttgcagtgagccgagattgcgccactgcactctagcctgggcaacagagtgagactctgtctcaaaaaaaaaaaaagaaagaaaaagaaagatacaaatgaagaactaattgcctgcagagaggaaggggaggttactgtgggctaaagcaggaatatatgaagaagcttcacagcagagggggactgtgaggtcgattttaaaggctgcttagaattttaaggagctgagatagggtagggggctagtgggatactaagggcggaggggccaatgtaaacccaggcaggaaggtgggaaaaggtagggtagcacagaagatggaaaagggtctggtatgactggattatagagttcatggaagtaaaatgagagacaagactggaaaggtaagttgggacaagattgttgctcttgcaaatgtttgtgtgcccttaacacagagtctagaaacacacacacacctgagcgaaaaagcctgacgtgaagtcacagaacaggtaggcaaacatgaacaaggaaatcccgaggaaccagaaagtcaaacaagataaagattgaggaagccagataaaccacccaagcagaagatgcaacacagaaagtgaaccttgaatataaagccagcttctgtcacaacccggaagccccttatgtatttcctcctggggcaggaacccctcccagggcatggtcagcccaggcctccagtggggcacaggtaagtggctgcatctgactgtagagggagaaagggcaaaaataagcataggtcctcacaggatacagtttgaggctgaagcctgtggctttgatcctagattaacatggattgcgttaggcctggggtagctgtatcttttggagctgaattatagagactgaacagcacttggtaatctggttcaagtcctaggtctaggggcatcaggcaattcgagccacgtgctttaaggcccaggatggcctcagggctgttggaccacacctggggaccaagccttttgagatctattttgggaaattgtatttgaaaaaaatagtgcccccagcttgtcaggttttgtgtgattcggccttgaaaacagccgctgcctgcagcggactcttccttttccccggcatctctcctggaccagtgctagtctcagttacaggtgtagtcttagattgggttggttttagatttaaaggagcagcttgagtcctactttaagaagcagagtccaaccagaactcttcaaactctatctgaaaacattgggctttgtggtgattattcatttcatagtcttttcctacctcaaccagcatctctcttctcagttatggtttttttacagaagagtttggctggacctgcagctgggtgtgtggggttaatcacgaatttcaagattttgattctcaatttatgtattttctagcttggagacccaatcttttcggtttccttcttctctggctctactagttcaaatagtgcgggtaaggaggaatgcccttttaggatggaaatgtttgctatttgctgtgtactgttaccaattcctgcttacaagagtctcatgcaatgagtttacctaaggaatataaaacatggtttgcttcatatcattcagaacaccagtggtaaagacaatatcagaattctggggctgggtcaagcatggctaatgagtgcatgcgtctgcctcccattccacctccatcccagggctgtcagtgataattggtcagaacacttttcatcattgccctccaggtagccatggccaggctgctagattcacatgaaaatgaccccgaatccctgcaccttaggggagacagtgacagcaaagcccccacaagtctggggccaggtcttgggctaccatgtactgatctgtaacttcgacgaaatcactttttttgagcttgagtttgccattcatatagtatagtcagtggcattgctaccttacagaggatttaatgacaaaatggcagtgggagtgctttgatcgagtacttctgcagatctgagctgtggcatcccagctgtttggttagccactctttcctcttagtcaatttttgctaacaccatgggatgctgtggctattccatcacttataggattcatatggttagggaaaagcgactgactagtctgttaagcaataggcagttctagttcccagcccatcatcaagcagcttcaagtcagaacattcctgcaccagggcttcaggcttgctaccaagcctgaaagaaacgctgcgcagatttttccacgggagcgcctcaaagggcagaggaaactcaagggctccttcactatccctgctctccctgatctgctggcataacccaaaacaaccccaggtccccaaagagaatattttcaagtctcttgttttatctgagaatgtatgtgaattttattttagaatatgtatgtttttgttttaatatataaataacgttttaacttactaatatcagttaaatgtccccctttaaaaacccttctccatttgtccacttcttgtatttcatgccttcctatcagttaggctttggtgtctaatatataacatctcaaccagttcataaatttctgcttttaatatagaccaagttaccactagcgcaggccacaggaaaataccagtctgtcctgtctgaattctggcttttttgaaagatttacttaggaacaatttatcatttagtttgcaatttttaaaataatcttaattgaccacatatgttatcaaataagagttggtcttgtagcctctgcctcgctcgccatctccccgccacctcccaccccctcatttgcacatgtgtacaaccttctgccaggatgtcagaaaattaattatgccactccaggcagataccatcgcaggaaaggctctctctgatttaagataagattaccaatatctaagctgttatttttaggagggaaaggctatcacttttaaacctctctccctcattttcctagttccttctctcctaatttggctccatgttttggtagccataagtcattagtggtttttaatttttctgaaactgaaataaggtctgaaagggtggatttgtcccttttttcctccttttttcctttttttttttggctggctaatcggaggaacgcaaccacatctgaagccacttggctcattatgaatttcatggaaactgattctctgaaagtgtttccatatgtgttcccaatatatcccatcctctctaaatgggagcacagacgtgtgcatgggctggaaatggcttcaggatgtgacagggcagtcatatgactgccacggcaccgtgggtggccccttctgaaagacacggtgtcctgggtgctggcctccttcctgcagtggatctggtttcaaagactatccatccttcctaggatttaaaaagttcttaatcaaggcctagcaggaagatctctctcatttttcctcccttttctctccccctccatctttggctcgttccttcccttactctccctccctgtatgcatacacactcactcacacatctactgcctgccccctttccctttataaaaggaaatatattcttccaacaatatcctcaaaatttgggtgggtttaaggaatggctgaattttctgaaaattgccaggtttttttttctctctctctctctctttttccttcagcataacatactttcttagccttaggatcagctagttctttcagaatttgtgagcatgcagtggaaaagtacaattcattacaacacagaaaacaaatatttagactggatagtcgagggactttccctctcttttgcaaaagaatggagtttgctggtcatttcattatcttaaaatgattttacaatctcattttgctggtttcttctccatcagcatgatccattgcatgtcttctatatatggtatattttcctaattattatctaatgaaatgaaaagtaaaactaagttagtgatggatagttggtcattttttagtgtgaggggagaaattcagggaaatttagaaaattggtcccttagaacctcagtgtggaaaatgcaaagtaatattttgcatatagtctacatttgacttttgaataatgtttatccatagcatttctacctctgtcgtgtttgcctccttgagactttggtagtaattcatctgctttgcaaaattttttgaagcatctgtcttctcagcaccatactataaggtaggatctggaagaagaatatgtggttcttcctcttcatttgcttcctctttagttggaaaatgaaaattcttatctaaaaccaatgataatacttaggaatgtgtgcagcagtaagatttatctacataaatgtccaaggttagtttggtaaatgaaatattatggtaagaatttgtgtgcccaggaaatccttgtgtagtggtgagctttgagccagagctcgcttactttggtctggcagagagaagagagaaaaccatgggtgctggggagagcatgggcaaagctcccgtgagtgtcctgagtatataatcactccaccaggaagaggggccatgcttaggagcagtgggatatgactttgaaatagggcagaggactctgaatatgcccatagcctccttccttttcaccccttcattacagaattgctcagatatgctttttgaaaggtggctggcctatgcttgagtaaggggtaatacactcttgttttaaggccctgctgcctgtgtgacttaaaaaggcagtaagtggaagaatttcccttttcatgtgtgttttcatagaatgcagatctcaggaagctcaaggcagaccctctatgttttcctctgcaccctgcatgctctgtcagggtgcagaggtagaatagaatgctggagctaggacagagaaccatgttggagtctcgtgttgccgctcagatctaccatgcctgcaggtttccgtgtctataaaactcatctatagaactcatctatgattcttgatgactctgacttctgcttctgtatactagtctaaaaaaattcaaacaagatgctagtttcactctctgttcctttaaactattcactccaaataaagattatgatcttagtggcagcgattaacccaggatcataaggaaggacgagtgtgcttacctaacagcaggccatgggtttctggcctggccctctttccccttcatctagtctccccagggctccctagtgtggatctacacccagatactggctgggaggcaggacaggtgctgggagtgaagaggaaataacagtggaagcaaagcagaggcatccgtttactagtgtcaactgctgttttgggggctcctgtctgcaatgtgaggtcaagtgatgcaataatgcttgggaatagctttgaatgctctttaaagagagttgtataaggttttataggtatggaatgtatttgaattacattttaggtttgatgtcagcattgctcaatgcttttcatatcttttccttttgtgttaaaactgtacagagttattgtacagagttcccaatccttagactcatttacgtattcatttatccatccaaccatgcactgacattttttttttcattttagcctcttacaatgtactaggttccaagagggatatgagaggaaaacatattctttaccatccaaagctgactttatagttggagaaaacagactaagaaacagctaataattcaataagggagtgagtaagggtccaaaagagtgatatagaaaataaatgctattggaacggaagtaaaataggaaattaaataatagagctgttgggaagggggcagccaaaacgtttaaaagggggagaagattcttggttaccaggggagagcagctccacataggtcttgtgtattacatgttccaatagaaagaactctgagaggggttaataaaacgtccttcggatttatttgagatttgttgaagcaataactcctaccatttaaaaggccccaatgaagctttgaagttaacacctcattgctgagaagtacaatggcttttcattctgtacctttatcccctcacataaagtgggcagaggactctgaatatgccagcatatgttcagtctggattcaaggccccccttccttttttctgccctgacctgcctgctctgctgggatgtgtgaatgtactgcacagaggccaagaggacatggggcatggggtttcccagctgacagccccaatggcaagtacccggtctgttattttggtcaaattccaatttcttttttgttctagagatctccttacccattttccgtcaaccaaccatatttattgggggcctagtcaatgagaaaatgtatgttaaagtaaaggccttcaaatgtcaaacaggtgtgactgttatgaagttctgaaggggaggcaaagaagtatcagacacttctctaccctccacagctcactctcagtgggagccaaacgtgactcaggataagcagcattcgaaaacagtgtgtgaaagatgccacagggaggattcccggccctgaaaattgaagatcagacattctgtttgattccctcttatcttggtttcacacactttccacttgaagacccaagaaacctagttgggtaaagagaggctatttccttttccctcatagaccttgggaggaggggcaagatgttttaatttttattagtgattttatttttatttgtgctccatggaaatgttattaatatattctttcctgtgtatattaggttgtgaaaaattgctgctgccgctgctgttactattttaatgagcaaagttcttgcagctctttttatgacagctacatttgtttgcaagctgtttggctttggctaggggtgtagacagcagttttggaatgaaatgcatctgtaggaagccagcaggtcctaaggggatcatacccttgaccttggtctcattcacatgttgccctgagcaaccaaactaattgcccattatttagcagattagatcaacaaggcctaaaagagttattaataatatcccaaagataggaactctcactggggcaacacttaggcagtagaagagtcaatttaagtattttgagatattttgagtatttttcatttaggcaaatcaacttctaagatagcaggtgtgtatgtgtatgtagatagacctgtgatcatgttaaccaaattccttaagggtaactaagatagcatatcctttgttagaagtcaaagaggtctgtctagctgtggctgtgattttgtgatattgagtaaatggcttcttttctctagataccagctttcctatttgtcaaacaggggttagatttgcattacctaagcagcaaattaagagtttagacttttccatcagagttcctcaaccagcataaaggagtatttgagtaccttgggggatctcggatcatagcctaaagctttacaagagcaaaattttgttgaagtcattttttatttatctaaaaattcacataaatgttgcactctcctccacatcatattcatgtttattgtatagtgtattattttccccaagttgagtaaaaccaacccatcaggaaaatgcacgatgattatcttgggcttctagtaactcctggcagtcccccaggaagatgtaggcacataccattttgaaactcttcgcaccaagtgatctagtgttggctatagcactctcaacttctccactgttcagcaaagcctaatagccgaatgtactttgtatatggaggagataacatggataacagcaaaaagaatggacttgtgcaagttgttccttgctattttaaaaaggtccccaaaccacctttggctttatctatccagtaagttgtagtcatgagttttaaactggctcttgggagctctgagcgtaccaggcatatcactgggggagtggctgagctttggttttatatttagaaaatcagattggggttgcactgcttttagaactctaggccttcataatatggactcttaataagtcaaacttatattttgcttactttagttgatgtaacatccagttagttctatgttggtaagtttgtggctacaatgtggttggtgacacaaggatgactagtttaggatacaatgtcaaaatagcccaagcaggggttctaaaagaaaacctgagttcatgtacaaaacagacattggaagcacagacacaaccttattcaatgaaagaaaatttaaggatattatttgcttctgtaactattattatttaaaaatttgaagattaggaaggagtttatagtctttcttttaagtttaggatttctcccaccaccttatcatgattattttataagggatctcgtatggtactagagcaaattgttactatttcttcctagagaacatgttgcaaaatgtttcaggaacatttcttggtaacataaagtgactaagcaaattccagaaaattctattgtttgtaagttgaaaaatcatcctataatccctttcaagtcaacattagcgctctttatcaagaaagagtccattctcaagacattaagactcaaatgcctagaagtgattggttaaaatactgtaaacctagcggaaatttgttgcattgttttctataaaccataaccagagctcattaattgaaaaacaaatgtcattttgtgttagctagcatctataaaccaaaaaggtacagtgatcctggcatgtgatgggcaataaaaacatcagcaaaatgtatcaggtaaaattgagaggaaggagtggggaggggtaaattcaaaaccatattggagtttactgccagggccccacataaagagttttaatgaggcttctgcatcaaaataagtgaaaccatacggaattgtaattattactgcagtgtattttaagtacagatacacctaagaagcagtttttacattaacatgtctatctgtgtgaactccatacttctgcagggggcacacgttggcgttttaagtgcgacttctttctgatacacgctgttcacattattctggttcttcttatatgatctaaatattgaacttaatgcatacagaagtgccctgcccatcgctgttagttctgccagctcaaggtcacctggatgccctgcaatgcagaggctgcctgaggaacgtctgtggcctccatttggcctctgtattgtacgaggcagggcacaagcactgggcgggggaaatgttatggagcatctgctcccatttctgattctgtcataatcgctgtttccacatttttaaatttaagcttgtcagaatttcgtttttgggaggaataggtagaggctagttgaggatggaagaatttataaaaagcagagagtgactgcctgggctgtcagttttggttcttcatcttgaaagtgtttgcttctggccttagaagctgctcactagcttttaccctctgcttatgggcctgcagactctgggaaatactaatgagggatgggaacctctctgtctacccctcccctaaggctgttgcttctccttctctcttggaattcatagtcatagaacattagagctggaagggaacttagagctcatccccctcattttacagatgatgacactgccacctctgacttctgcctctggccttccactctcagtaagaagagccaggcaggtgagacttttaacaattgctgggctgggcagggctgggctgggctgggctgtctggttgttactgtccgatttgtgagttttgttaactatatgttgcttttaaagagtcactttttattacaaatgcacatcatggcacttaacccttgcattttgtgaagattataagcagtgtgcattttaacaaaaattaataaccttcaatcagcacctttaaagaaaagtgttcggattattcccttaataaacatcgtaatatccaagaacaaggtctgaataaaaatgaggtgaagaagtacccattcattaaagtcctcaagaattgtttagtgctttcctttatagctaaaagctgtaggagaaacaaatatatgagatctgaataatcaaaatattttagaagggaacaatatcttaacaagagcactggtattagaaaagggcttgtcacaattctgtcaattctagaaaaataataataaacccaatctttaaaggtcacaactacaagattctagcatttcagaaaacaaatttccacatgaaatggtttataacggtggtttcataacttaggcaccagaaacatctattaaggaggcctactgttagctttagaagtgaaaggacttcatgttttaggggaaaaccatctttgccttcaggttactgcttcaagttgacctgaagctggttctgtaggatgtggtgctggggcctgggagacgggtggggagtgccctcctcttaatctcccctaggcagcgagcctctcgcaaaagctactgttagcacctggtctaaatcaggtcacaagtctcccatcaagacttgaaatcaatgattcctaaggtaccaagcccccttgtgcctcctaactcccattttcaaaaccgactgatctagtagcttatgaccctccctatccacccccagagaagttatgagtttctggtttgatttcactgttgctaagatgagacctctgacaagattttaaattctttaaaggccttaaaggaaatgataggaacatgataggatatctttttgatgttccttcattgatgaaagagcctaccaagagtaaataacagtaagacattattttggaatttctttatattgagttgaggaaaataaacttgtctgacttagtaaaaatttcacttcaaatatctaaagtgcaacgagaagcaaaaagagaaaaaaaatccatgaggatttggttttaaagtctggtgagtgaacctatgtgatcagagtgttgggttggtttacacattgacctggcacacatgtgggtttttaaagccctctgggattctctgggggtgaagaacttaaggatcaatgctgttaagactgcaaagtgggggaaaaagactgtaaagtgactggtgcatttgaaggtctgtctgtggcttgctgttcctttatgggaaagctaaagttttctctttttttttcttgtaacaattctatcattattttaattgatatttacagatttttccctccatcttctgttataatttttaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctg

SEQ ID NO: 17534 - DNA, 6569 bp, Human
gggagaccccagaccaggcccctaggtgagttctgggccagcccagcctggaggaggtgtgagaggctgagccactgctcagcttagcggggggaccacttagtgaccaacaccctgagggaggccccagcatcccctacctagcctggcagcagcagcgggataaataggggggcactgctgcctgtgagccagcccagcatagccatgggtgtgtgggggaagcagacaggtaacagtgacaagctggggactgtgctgaacgctaactggcaatagtacactcctgcccacagcctgtttttaaattaataattaattctttagagacagggtcttgctccgctgtccaggctggaatgcttcggtgtgatgacagcgcacgttaacctcgaattcctgggctcaggtgatcctcccacttccgcctcctgacttgctgaaactacaggcacccgcctccaccgccaggcccagcccacagctcctttgacctcagtgacaggcactcacctacctgacccccaaactgaagcctcacttttcccagccgtgtccacaccctctgggctaccccattaccatgacaagtattccctctgctccaggagaaaagccaggtcccagacctgacccattaaaacccaatcattccagctttcacccttcatctctgcaactttcggctatgtaagggctccctgggggagcacaggagacaggcgggcaggaggcccacgcccacaactctttctgagctgggcagaacaatcaatggcccacacagctgaccgcgaggctgcggggccctgggcgggacagtagggtagggggtgaaggagcggcttccagccagcttcactgtgtgcatggcctggcactgggtccaaaaggggcaggaaggtgtcggagaagagcctcagctagagtccgggccttctgagcgggcacctcccgcaccaggactctgcgcccgccagctccgcagggctccacctccctcgccgggactggtgaccctgcgaccccgcgacccctgcgcgtccagactactgcagctgcggtaggccccaaaggctggcccgggaagcgaggggaggggctggccccgctgcccctggacgcaggcgggggttgcgggatctcaagccagagacccttcctgggcgggaacccgccacactagaaggctgctgaggaagtcggcccaggagcggggccagacacctaccccgacgcctgcccgcgggccgcagccaccgcatttccgcgtttttcgcggtaggcgggaggtgggggcggggactgcggctcggcgcccccctccgacccgcccacacctgtagtctcgggggggggcggggcgcggcgacgagccaatgggtcggggaggggcgtgacagaggcagccaatgggcgcggggagggggcggaacgcccgcgctgagcagccaataggggtgctaggggcggggcgtgcggaccgcgggccaatgggggcgcggggcccgggtgcgccgcggcgctgggggcggcaggttgcggcggcgccggagcgggtctccaggctggcgagcgcccaggtgagccgcgccgggtccccggtacttgggagcgcggggcgcgcctcgagccggccggacgccgactccaactggggagagttttccgcgatgcccggacggagagcgggggcggcgccgcacctgcgcccgccctgcggaacggggacgccctggctcccgccaggctggggtcgcggcgcgggcttcggtgcccgcggcggggaccgggactttcggggcgagcgcagcgattaggcggcagcggcggggctccccgggctggcgggggctgctcagacccggagtctgctccatctgcagggtcgaggtctgggttgcgaccccgagcgcctctgcggcctgagcaggtcggggtggggcgttcccatgccggcggccgcggggcctggcgtgcgggcgcctccgcgccgcccggggagggggcagtgtcctccgagccaggtgaggcgagtaggaaatgctggatctggttaatgattcgccttgttccgggagtgcgagcgtggcaagaggaagctggtgaagtgggggaggatgcgtgctccggagggccgccaccccaggaatgtgtggctggcgggtggggctggcacaggagggtggggcccgtgcggaggggcggcagcccagccgtttctagggcaggccaagaggatgaggagaggaggaccagcctgcgataggagtaggcaggtcctgacccggtgcctgcgccctccccacaggacaggcatgttgttgggactggcggccatggagctgaaggtgtgggtggatggcatccagcgtgtggtctgtggggtctcagagcagaccacctgccaggaagtggtcatcgcactagcccaagcaataggtgagtcctctcggggtcaggcaggccgggcaggtagagctgaagtgggacctggtggtccagctccatggtctcccccaaggagagtggggctggttgctgatcctttttgttcttcccaactcttcaagccaggtggacagagagtcggggggacataggctgaccttctcctcttcttcccaggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggtgagcccggggacctgatcccctgtcactcccccacccctgatatgggcagatacggggatcacagggtcccactcgggaggcaggtgagcccggggacctgatcccctgtcactcccccacccctgacgtgggcagatatgggggtcacagggtctgactcgggaggcaggtgagcccgcggacctgatcccctgtcactcccccacccctgacgtgggcagatacgggggtcacagggtcccactcgggaggcaggtgagcccggggacctgatcccctgtcactccccaacccctgacgtgggcagatatgggggtcacagggcccgaccagggaaagtgctccctccggagcacaagggctgtggagcccagtggctgtgcctcctaaggatctcatgtgtccccaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagcagcttgagtgtgtgtggaggctgcgctgggcagggtctgaggtcttgaacttgagcctccatggggtgccactgagcagtaccctgacacacctggggctcaccacagctggagtatctgagaataggatccctcagggtgctcagtagggcccagggctggggcttcctgagctccacattccatctgctctgcctcacctaaccccaggggctctcctgtgagggccccagcctggtgggcctgctggttcagcctggcctgactgtcccaggcatttgtctggaccccctcccacctgactctctgtcatgttgcctgtgccccgccagcagcgggaactgaggacgtcaggacaagctagacccgcccgtcaggtttactgagaacttgtgggggtggatcccacactcaggtcagccagtcccaggctgcttcaccaccccagggagggtatgggtaccagtgggcaggggctgcctcctcttctccaggtgggtgtgaaatgtctgctctgagcttgcagctttgaaatcagggcaggggccaggcatggtggctcacgcctgtaatcccagcactttgggaagctgaggcaggcggatcacctgaggtcaggagtttgagaccagcctggccaacatgatgaaaccccgtctctactaaaaatacaaaaaattggccgggcgtggtggagggtgcttgtagttccagctactcgggaggctgaggcaggagaatggcgtgaacccggggggcggagtttgcagtgagccgagatcgcgccactgtgctccagcctgggcaacaaagcaagactctgtcaaaaaaaaaaaaaaacaaaaccgggtgtggtggcatgcacctgtaatcccagttacttgggaggctgaggcaggagaattagttgaacctgggaggcagaggttgcagtgagctaagatcactccactgcactccagccttagtgacagagcaagactctgtctccaaaataaaaaaaaattgtgtccacagcccagcccctgcctgggcccttgggctagctgtcacctctcctggttctaagggtaagccatacactcccagctccaggatccatggttggggctggagaaatcttttgtgttgagcagaatgtggaggacccctatacctgggtacagccatgcatgggaaggcagaggatggggatgccctaggtcaggggtgtccaatcttttggcttccctgggccacattggaatacactgaggccatacatgggccatacatggaatacagtaatgatagctgataagctttaaaaaaaaaatcgtaaaaaaaactcacaatgttggccaggcacggtggctcacacctgtaatcccagcactttgggaggccgaggcgggcagatcacaaggtcaggagatcaagaccatcctggctaacacggtgaaaccccgtctctactaaaaataccaaaattagccaggcgtgttggcgggcgcctgtagtcccagctactcgggaggctgaggcaggagacgagcgtgaacccaggaggcggagcttgcagtgagccgagattgggccactaactccagcctgggcgacagatcgagactctgtctcaaaataacaacaaaaaacaactcacaatgtttaagaaaatttatagatttgtgttgggctgcattcaaagctgttccatgggccaacagttggacaagtttgccctagatcatggggtctttgtgctctgagaatgggcgagtttgggatggactcagctttctgttggttggccctggatctggatctggtgctgccccctttctctggagcacacaaagggaacaagaaggcctggacttgggcaaggaagccatccacagggctccccagaagccagggccaccaggagctcactgctgtgcagaggcaactcggcttggttatttcttgcctgaggcagggaacagggaatgcagggaagccaggcagcagcaggaggct

SEQ ID NO: 17535 - DNA, 27363 bp, Human
aatcttcctttctcccaggctggtccaaaggtctggtcacgtgactccaacagtgacatcacattctgaccgccagggaacactggtagttctttaggtggcgtttgttgctgtgaaaggcagagaatgcagcaagtgcccttctaaagcacttcagactggggcttcttttgtaaaagctccccaacctgaatgaccaaatgcgggctgccaaggttatttcttccttgaggcagaaaaaaagaaaactgtgattgaaggtaagcagacttgagcctgaccaaggactgaagcatgccccccgggagcaggggatctggagaattgcaagcagtctgttgtaggattctaatcactgcctgctctttgagaggggcctgacaattgcgtttctaaggaaaccagactacaaaggaggatgatgcggtgctcatgttacctagtgatgtaataggattctttctttcctgctagaagctgttgcagatcttcattttgccttaatatccttaaaggtgggggcctcatttgatatatagtgtatcattagatagctatcagatgatttttaaaatcagtttcacaaaatcctatttttccccttctgaaaggagaactcttaaaccagagcaaattcaactggagcattaacctgccttaaaaagtaaatatctggttgtttggtgtcatgtgttcatgtcagcattggacttgagaattgaaacagcttgccctcccccacctccacacacacatactttatcctctttctgccctcatttcctagctggctttttccctctaagctctcaagaaacacatcagctttcatctttatcagtatgacactgacatgataggaaatgctgggctggtgattcagcagccatccattttacagtcaggtacgaatgaagatatggaaaggactttggttggggtttaagattaacttgttcaccttttccactccacccccaccccgcccccaccctacagatgatttggactctgcagagctttttctttcaaatgtgcaccttgcctgtgaaaggcatgctgacttaggtattcagaagacttacaattggtaaaccaattgtaagtacagcttggggtgttccttcaaactttccccatgacattgctaaagttgtctgtttggagtttacagtgaagatggggatgcagatgggaggagagggagtcagctcaggcccactttggcctcctctgcagagggattcattaccaaacagtctggaggaagccttgtccctgccaaggttggtgctgcaaatgtgagctttggctgggtgaattaaatgatggcattactctgcacttttccccagtgtgcatttgcatagattcctcagtactgttttgtattttgtgtttaatagcaaaatcttattccatcagatgatgttgctgaaatattttgaatcaagtttaagccttgtgtgagtatagcttgtgagtttaaaactttctcccccattcccaccgttcatcaaacaaattttggttcagctgatatatactgattcttggatatgtgctagacactgtagagaagggaacgatgaatcagacatcaggctaccagcaaagagcttgtagtctagaaaggaagataaagcatgcacaaaagtaattgtaatagaagtacccaaagcaaagtagataagggactatgatgggtgggcaggtggatatgtttcttgcagttgaaggatcagggagggacatttcatcactgaatcatacactgttctttaaatctctgcttgtaaatcttagactgtgctgacatacttagagttcctacaagcctgttacatcagagatcaagtcttatacctattgaagggaaatttgtacattccagccaacttaactcgtgaagaggcccacatgctttatttggagtccccagccaggcaaaaaccacttcataggattgaattattgccttataaatgtaaaatggttcttgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccaggtgactgtatttctttatcaaccccaactgtagtcatctgatagtttaagggcccgccttttggaaccaaaaagaatgtattaaaaatgttaagaatttctgaagtactaatgtctatttcttgttcaatacagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagaggtaagacaaaagatggcacatgggtaagtgttaggaaatacaggggaagaaattgaagatacatattctttctattctttcctttcttcagccctggatgtgactgaatctggtttctgttggcaatatagagtttcatttttaaatttatttttgaagacatcttgcacataatttttttattatactttaagttctagggtacatgtgcacaacgtgcaggtttgttacatatgtatacatgtgccatgttggtgcttgcacataatttttatcctaaatttaaaaaattgtatttagtgatttatcttactatagtaaatagtcgcaaaggatcctcacagctaaaagggatataaatgcctctgaagagaggtgaaaacaaacttggaggaaggtggcaaaataaatgtcaaagatcttcctttcccatataatctctcttttatggttttttccttaatgcaggatattcataactaagaaaagtaaatggttttctgttaaaggaataaaagaaaaaaatctcagagccctagtgtttactgaagcatacaaagtaaactccttgtgattattgatcttgtacaaccataaaaccaaagtaaacttatgctttcaactccaacaaaaccacaagaccagttaaattcaaactggggacattaacttaatgtgataggtaatagatggtacttatggctatggcacaggttcttttgaatttagcaagagaatttccccacttttctctttttgaagtaccgtgaaaacttctcagagagacttgccaaggtcatttgcctttaacttgttgctgtgtatcatttaaattagggaatcacaatttctggtttgtataagggccacgtggagagcttattaaaaaaatagttgtccaaccccagagattctcagtaggtggtcctctggtgagtcacttcttcaacccacaataggtattatttttttttctttcttactatttctgcttggactccagatttgaaatgtgattttttaagctgccccattctctcccaagttcatgatttcctcctcttagaaccaagcaaatctcttgagtagtcaggtggagattgactttcgttcttaagcctttccagctcctgactggttttctcacgaccacctgaacccaggagtcaggttgtcccaagtacaggttttgagaaattccttcttaatccatggatatttggtgattccaccgagttttcttgtcacaactcgaaaagttgatcactataaagcatttcatgttttttcataagatttctgccatttgggaacatatacacatattctttctatcgtatgtatcaattcatcaggcgggctttagaatttctgccatctgtaatttaccagtttgtcatcagttgcatattcaacatgttatccagattatgagagtcacctgtgatatgacaagtgcacacttccttttatattaatggttgcatctgaggcaaattatgccaattagtaatccaaaaccagttaaagtgtgtttatcaaatagcccaagggggctttttgttttatagcattaactgttcattatcagaagggaaacactgtcacagggaaaaatgtaactttgttccttttcagcactgaaattggaaacttagagtcataggtcaaaactatttaaaaaaatgcttttgaaattctcagaataatttattgtctgtgacgttactgtagataaggtggggtaactaagttgccatttcaaagataagaaatagaggtacagagaaaggggaggtaccagtgacaaaactgtcagaatgttgatttttaaaatgtaggccctgaagggttaaattgtcaagtctaggacttaaaagataaaactttctgcacctcctgatagccttgatgttaccagcaggttgttgaaaatgaaaagagatacatcattgctatcacttagtatcggtgaccactgtacaattaggggtttgtgggatgaagtctgggaatttgcctgacctgaaccacagcccccaggtagtaagcctcaatttgtacttttatcactcaaataagcctgtgtttatttattctttgaaaaacattgaaactatttgctgtgagtcaagagattgcccttggaatatctgatgtccaggatagaaagataccactgcaataagcaaaacaagttgatgctataagaaatgatggcttgggaggaagctctgaataaggaacttgtgggcattacaatactgtagatgaaggtggggtttcggtaaacctcaaagttgttagtgaaactggttcagctaaagattatgtgaaaagtagctctaaattggtctctattctccagtgatttgtctttgtatttctttgttgaacagtttttaagtgaaaaaatggtgtgtgtagagtgtaccaatgttttctcattttcccctagattaccaataaaagcaaagagtcaacatgggccttaattcacagtgtgagtgatgctttttccggctggttgttgatgctccttattgggcttttatcaggtatggtaaactgttagttttcaaaacaaatctcctaaaattgtggtatgtctctcccgtaagtcctgagctgagtcacgtactgtgttttcctgtttttctaccttaaatgaattgctggtgaaccttatagaagctcaatgtccccatctgtaaagggtactaatacctgcaattcttaccttgaataaatgaggaaatgcatttaaatgcattttgtacactataaaatactgtatccattttaaggtgatgttagccctttggtgcttgttttgaggaagagcccttctgttggagacagttttttttttaatacatactgcatgggttttaggagataagatgtggaagaggacttcctgagacattttgtgggtgtttcttaaacatctactctctcatttggtgatgcagaaaagcatgtaagatatggctcgtactcccaagaagcttatgatctcattctttcatagtggctgggggtggaatggtgccaccttgccctataaactccatcaaccttccctgccactccatataatatacagtctcactaaaaatggtatacttactgtacaaatacagctttcaaccaagttcccaagaaggtttctcacccggtggggagaggagagggccaaggacactaggtagagatggtaagaggtgtgtccttatggcattaaaggatagggcctaggcaaatctgtaatcttgagctgaaagagaagttaggtggaaacctggaggtggaaggtatacagtggtagttaacagcaagtagaggctctagttttaggctgcctggatttgaatccaagccccaccacttgctagttttgtggctttgagcaagtttcttaacccctggaagccttagtttactgatctgtaaaatggtgataatcaaagtccctatgttagaagtttgctgtgaggattaaatgagatatagcacataatagcacttattaagcacagcagacagttgttaatgctgctgctgctgccgttaccaagagagaataattcatgagccatggagtagaatgtgactgtagcaaatgaagaatggcttatctatagctgggttttaaaaaattgtctagggcagggattggcaaacttctgctgtaaaggagccagatagtaaatattttaggatttgtgggccaagtgttctctctagcacccactccattctgctgatgtggcacgaaagcagccatagacaataggtaaacaagcccagctgtgaccagaaaaactttatttgcaaaaataggagacagacaggatttggtccttgggctatagtttgccaacccatggcctagggtgttaactctgccccttctggctcttacaggagagagaacatggtctggctctttggagctgcctaataatagactgggtggtctgtaatgctaagtattgcagagaggctgaggacaaggaagatggctgagaaaagattatatgacctagcagttaggaacacagcaattaccttgaaaagccatctcagaaaaatattagaagctaaatctattcggtttgtgcaaaagtaattgcattacttttaatggcgaaaaccgcaattgcttttgcaccaacctaatagatttcaagggaaggcaaccactgtagaagttttggtagtcataggagagagaggaagggtaaaggcttgaaatgataacaaggacaagggacagcattttattcttcagggtaggggaaacctaatacaatttgtaaccagagaagaaagaactgactctggggaggaggagaggtagaaggagaagacaggattgagggtaccagtgttaggtgaaataagacatgtacacgtgagacaaccagagaataagccaaactgtataacatcatggtaattttccgaatccaggcagtaacagatagaaggcagagaagattgtggaccggagtggccaagagtaggtgtcaaacaatgtgttagatttgactagattcttcaagtatgtaagtaacctgtgttaacacttttagcacctaccaaaacatacacgacatggcttcccgcccgttggaatgtaggcataatatcctcaactttttaatgtatttcttgtcactaggtggtcagtgaatatttttctttcccttgtacacacagggtattttgtttttaagcattggagagcaacaatagaagcagtgtgtctgaatgctggaacagtctgggaattcaagggctgtgaattttgtgatggctttactatttccctaaagcatgattctgggccatttaatttctttatgccagagtttcttcatctggatgacagaaatgatgagaaggccagaatctaaattactataactgtcttaaccctatcagtctattagccacagtgcatcctaagtccccagttcacgattccatttcccatcattttctttggtgaatgttctgtgtataatactgtttgctctttctcagtaagaaaacttcaggatgttcatgtcctaggttcaggaggcctcaacatgtctatagcttcatctcaccttccatgcacatcacagtttgtgctttgatagattcagctcctttagcctagaatgccttcctgccattgctcaaattcccttgtccatggagcacaatcctgctattaaggcttagcccttctccccataatcttcgtcagctctcctctctaagcaatctcaaataaacatcatagaatattcctcaatgttgggcaattcacatattctgaatcttgtatatatgtatatatgtatatgtatatatatatatgtgagaataaaagaatctttaataaacttgactctttatggatcagtattcataaagttgaagtcaaaatagtgtttttgccctgttagttcagcttaaagacaggcccactagccccttgctcccacttaaccattttgctttccctaagtcccttctatgtagaaattccacagatggcagtgtttagtgcagagataataagtgaaaatcaagcaaacacacaatgagaaagaggttacaggtggaatggggaagtatgtgcttatctgttactttgattcctttcccctcattttctctgacaaagcttattctgatgaccaaagaacagtttccgagattcagtttaactttggcctttccctccctccccacaaatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgaggtaacatgtagtgatgttttatgagccattgacttttcttcttacatttattttatttcttatactgtgctcacagcaattgcggaatcttcctttattttcctttccacagaaaggggaaccagtaccagctgcctttctctgtggtttaagtgcagctctatttccatctctgctgatgtgtagagtcatttgacgcttatgtttaaaatggttttttgtttgctttactaagcctggtatttcttcttaggtactagtacatagtgtgactgaatttctctttttctaatcatttcaaaagaagtgtcagaggcagccaacaggtgagctataatttctaatgaaggacagagtgagttaaaaatgtgtttatgtatatggatttgaaaagtgattttccctgagcattgcattagaacattgaaaaaagtacaatgcattccatgtcaaaataacagaaacccaggaataaaattgcctatcatcccattttgtaatcaaatcaatattttcatttgtccttgtcttctagcatacgtttttgttttttttcttgagacagggtctttctctgtcacccaggctggagtacagtgacatgaccatagctcaccactgcagcctcaacctcctagcctcaagcagtcctcccaccagtcctcctcaggagtagctgggactaaaggcgtgcaccaccacacctagataatttatttatttatttattttgtgaaaatggagtcttactatgttgcctaggctggtctcgaactctttgcctcaagtgaccctcctgccttggccttccaaaatgctgagattacaggcatgagccactgtgcttggcctaccatatgttttttgatgccaaggtaactttgcttatttttcagttccttacctttattttaccactcagttatatgtttgatctctcccactgaaaacaaaagcacacaaagcaaaaaactctcaactcccaattccaccctgacttccaccaacaaagacaggtaccatcttagttcactactcatctattttgttagtgagggaaacaagactaggatgtatgtttgtacttttaaacatttatattaccctccttggtctacaaacaatttgaggtggcatgtgcacacacatacacaaatacaaacagtccagggaaaaggaggatagaaaaagaataaagatagaaataggagtgtttatatacatgtatgactatgcatcttggcttaggtaaagggttcaataaaagggatagatacatgccgtatgtttgagagagtttaggtctatgcttctcaaactagggtaaggtcagtgtgccagagggtaggtgaaactataggacaaacattatttgccttcccagagcattactttttcctgaatatttggaattttttttcaaaaattatatgtaaataatcatttaaaaatggaatgcaaaatttcatacttgttaagaaaaaaaaaaatctttcagctctgctcccgggtaccctgtcccatactctgatgcctttgtttactctctcctagattaggagaacttaggtagaaaagtttgagaagtcctacaacttagggtgggtgtgaaagagagagagagagagagagagagagagtgtgtgtgtgtgtgtgtgtgtgtgtgtgtgtgtatttcccttgcttttggggggattcttttattttaaatgtaattggccaggcgcggtggcctgtaatcccagcactttgggaggccaaggtgggtggatcacctgaggtcaagagtttgaaagcagcctggccaacatggtgaaaccctgtctctacaaaaaaaaaaaaaaaaaaaaaaaaaaaaaaaaaaaacatgtatatacacacatatatatataaaattagccaggcatggtggtgagcacctgtaatgccagctactcaggaggctgaggcaggagaatcacttgtacctgggaggcggaggttgcagtgagccgtgatcgcaccactgcactccagcctgggcgacagagcaagactctatctcaaaaaaaaaaaaaaatcctctcctccaaggactgagtgaggtgtgcctcatgcctgtaatcccagcactttgggaggctgaggagggaggatccctcggggccaggagtttgaggccagcctgggcaatatatcaagacccctgtgtctaaaaataaaaaaactgggcgtggtagcaaccacctatagtcccagctactcagaaggtgaggtgggaggattccctgaacccaggagatccaggctgtagtgagcaatgatagtgccactgcactccaacctgggcaatggagtgagatcctgtcacacacacacacacacaaaagtaattacagattcataggaagttgcaaaacaatgtacaaggaggtcctcagtacccttcccccagccttccctccctcaatggcaacagcttgcataaatgtagtaccatagcaaaaccaggaaattgacataggtacaatccacagactttagttcaccatttagtttacacacattgatttatgtatgtatttgtgtgtgtgtatgtgcgcgcacgcatgtagttcatagttcattgccattttgtcctatgtggacatttgtttaaccaccaccacagtcaagatttagaactgttctatcactgcagggctgcctcatgctgcccctttatagctgtatgtgtgtaagcattccaacagttactttcaaactggagcttgagatttgctctagtgacagatttctctggctcttctttttatgaacgaaatccttccctggggaaagagtcctctaggttttggtttttgtttgtttgttttttgagacggagtctcactctgtcacccaggctggagtgcagtggtgcgatctcggctcactgcaagctccgcctcccgggttcacgccattctcctgcctcagcctcccaagtagctgggactacaggcacccgctaccacgcccggctaatttttttgtatttttagtagagacggggtttcaccatgttagccaggatggtcttgatctcctgacctcgtgatccgcccgcctcggcctcctctaggttttaagaagccttctccaaatgccaggaaattgccctcctggtctctgcctctggccagtttgagttacttttcctttcactcccttaccctcttcatttcctacctctgcagtcttcttcctccttagctacattggaaaggcaaagaaatagcaatcatgtgttcctctgagggcctaagataatggaaaacctgtgtcaaatttacaactcagaaaaaacctgagcattctggttctctttgtctaggtcagtgagttactttaatagtgttttgtgttatgaagtcaaaagtccattgggttttgtatttactgagtgagttgcaattcctaatatttctaccagcaagcataacttcctaatcaaaattgctttttttgtaagacatgactatttgcaggccctttaatatggatgaatctttcctgctggtcaaagctagatttcttttgtggcatgcttcatttatcacaggggaatagtctcaaaaagtatattctttctattttaaaaaatagttgtttccattttatttatttatatctggtaccaccagggtccaaaactttctacttatatggttgttcctgagtctgtggtaccaaaattttcttgaagatgtagttatatgtggactctaaaaaagaaagttgagtaaacagaaccagagagcagaatggtggttacctggggcatggaggaggaggaaatggggagaagtggaccaaagggtacaaatttgcagtgaggtagggtgaataagtctagagaggtaatgtacagtagagttaataatgctgtatactaaaaatttgctaagagtatattttagatgctcttaccacacatacaaagaaaggtaactatggaaggtgatatgcatgtaagtttatttcaatgtagtaacaatttcgctatatgtatatatataaaacatcatgttgtacaccttaaatacatacaataaaaaaattttaaaaagcaaagaaaaaagccaaacacccaaaattttgttactataaactatgagaatttgacaccaaggtaagtagccaaaggtgaatttagtggaactttagatccgctcttcacttcagatgtgaagccaaggttcagccattccaaaaaagctgggggggtgctcttaagactcttggtaaaatgacatggaatcatatatatttgactacaaaacccatcaaagcactcatatagaaagagaattttgtttcatggttttccgtttgctcttttccttgttcatccttagaatccatggtaaatttcctttgggtgtagcaaagcatctcattttcagtactaagtggcctgacagtgtttcagtagttgacaattcagaaagaaaagtcttgaacaatttaatctcggtggttttttttttttttggactttttttcctgaaaaaacattactcagaagagctgcatgtctcactgaagctgtctaggctaaaacaagcttctttttccccctgttccagggagcctttgcctacatagtcaattatttcatgtacgtcctctgggctctcctatttgccttccttgccgtatctcttgtcaaggtgtttgcgccttatgcctgtggctctggaatccctgaggtgagtctcttaaaatggtttataaatggttacaatatgaatactttttggttaaaatctcttaatatgtattccagcacataccacaatttgatgaatgttaaacaggatcagatcctgaggccatctaagacctaggtctttccacaagtccctctcagcctgggctaccaggaaattaaagggagttgattcttagcctcctgagggttcctgttgagccaggctctggaaaacttcccctgttccctatccaaaaagcttccagagtatatcccaagattctgacctgaaaaagcagtgttattgtcagctttttcagggcaaaagaaagaaaatcatttggtacctttcccacaatatgatttaggctacatgggatggttaaaaccctgtttctaactacttttggcttagattgcttgacagtgactaaagacactgagacttaggttaccaggatgactttgcccttccctgtttcctgaccaggtaataagtcacaattttttttttttttaagccagggaatcaagactatacctaacctttaaggttgtttcagggacattagccttgtcctctcaaaacatgcctcttgggctaccacgttgtaacatgaggaaaacacctatccctccctctccagctcctccttcatatatgcacactctcatacttacaatacatccttgcccagctatcactcccctccccctaaaaagggggaacatgaaagcttaaagaacagttcttgctttcttgggctcctgggctctcttccaaacagggatcactgtaggtcaagcatttatatgtcacttattcaaaaggtgcagtttctataatgaggtccagatttttgcttcttagccttgttgacttccttagtctatattcaatctttctgtgtttaacctgcagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtaataatgaatggccttaatagtctctttttggttgtgagcataaatgatacaatcttagggggtgagaatttgagagttctaccaatgttaatgcaaacaccctttgacccagcaattccacttgtaggaatttatcctacagatatcctagcatgtgtgtgcacaaaggtgtataaggatagtgcagcgtctgtcaacatagtaaaaaactgaagcaacaaaaatgtccatcaatagggaactgatctaataaatactattctgttcatactgtagaatactttgcaaccattaaatgagataaccttttatatattgacttggaattctggctatgaaacaccatttgattttaaaagccagtttctgagtaatgtatataatataattcatattttttaaaagtgtacatgcacttattgatagaaaatgtctggaaggtggttttaccccaaactggttttacttttttttttttttgagacagggtctcactctgtcacctagactgcagtgcagtggcatgatcacggctcactgcagcctcgacctccctggctcagatgatcctcccacctcagcctcccaagtagctgaaactacaggcacgcaccaccaaacccagctaatttttgtattttttgtagagacggggtttcactatgttgcccaggctagtctcgaactcctgcgctcaagcaatcctcctccctcagtctcccaaagtgctgggattacaggcatgagacacgatgcctggctcacgtcaaactgttaaaaatgtttatctatggtgagtgggagagtgaggggtagtgaaggagaagtaaggattttaactttttattgtatgtaattctattcaagtatatattgcttctcttacaaaataagttacagaaagaatagattttaaaagaagttgtttattgctatggaatagtacatataagtgcagtgtatgtttcagatgtcggttttttcactttctatttctatctaacactatacttgaattagtttctctctgtattggacctctctctaccttttgtttcagcccagctaaattagtcccgccatggcacctctgtagtggctgtcatgtttatgcagttgttaatgtatgctgttttgaggaggaaggacttttttaaaaaaaagttccaagtcattggtttacttttttcttgctataattaagggcctaagagaataatggctcttgctttattttctttgaattacaaagaagtcacatatggaatgggtcaagactaaggtcatttcacttaaaaggatttttcacaaaacaggaacctaatgatttcttatgaaaaccaaaaaaaaaaaaaaaattaaccacaagacccagaaggaaactcaaagatattgagatttcaaatatagaataaattttgttggttcaagggagaaaggtcctggcactgttagaaaggagaggaaagctagcaggagagaagatggggaaatatgagtagattgtttaactacctgtcatgcagtagagggacttaaaggtagtgttaagttggtgaggttgttaaatgggaatgacattcaacagaagggaagagttgagaaaacattttttttctagaagggctttattagaacagttatgaaatttgaatgagatttatagatcaaataacagttattagtgtaaatttcctattttgatcattgaactgtgattatggaagagactgtctttgcttttaggacataaaagcatttatatcctacatgcactgaagcatttcagggtacatgagccttatatgtgcaactgacttttctgagtgaaattccaattcttcagaaaaaaatagaatcataaaacaaatgcagtaatggtagcaattacagaagctacatgaagatatgtaggacttctttgtgctattctttcaccttttctgtgtttgaaatttttttaaaaaaatattataatggttaagagtgaagtggtgattgttgctggttttgcatggatgaaggtgaatttgaaactacagattgctggggactttcattctaaaaattggcatttttgttcaaatagtttctaataaaataagaggggaattcgatttggctgtttctctctacagatgccatatatttctccagttagactcatatgaatacagtcatgtctcaatgacagggatatgttatgaaaaatgcattgttaggagatttcgtcactgtgcaagcattatagattgaagttacacaaacttagatggtctagcctactacacacctaggctttatgatatagcctatggctcctaggctacaaacatgtacagcatgcgactatactgaatactgtgagcaattgtaacacaatggtaaatatttgtgcatctaaacatagaaaaagcacagtaaaaatataatataattttatggggccaccatgttgtatgtggtccatcattgactgaaacgttgttacgtggtgcgtgacagtatttgaattggttttttttgtttttgtttttgttttttttttggagacagggtctcagtcttttggccaggctagaatgcagtagtgtgatctcagttcactgcaacctccatcacctgggcttgagcaattctcccacctcagactccccagtagctaagactacaggcacatgccattatacccagctgattttgtgaatttttttgtagagactgggttttgccatgttgcccaggccagtgttgaattcctgggctcaagtgatcctcctgcctcagcctcccaaagtgctgggattacaggcatgagccaccacaaccggctagtatttgaatcttaaatttactttctagcacttatttagactttccagttattttttcctgttgctttcatcatcagcggcaaccttttttgtcttatggccttgtcaaagtgggcagatggttgagagtaaaacagacttgagaaagaagggtgtagacagactccactctacaatataaaattaaagcaaactagctaccccgattctttctgtctcttgattcatcctaaacatagtcactgaaatcccctttctcaagttgcatgttggctgtcctcatctttcttaaatgaaagccattgtagctaggaatttcaaagcccttccagctagcaccagagattccattctttcctccccatcattttcctgagccatcctactcttccagataatcctatatgcttattttgccaaggacctttttattcttcaaaactcgtaattttgttcaactttctctaaaatatttctttacttcttcaaatcatctctctccatagcaaccagaatccaatgaaaggacttggtccatctattaattttggtttgtttgccattattagtgtttgtcatgtacattttacatgtacacacacacctacacagaggtggaggtctctaagtatcactattctttctctctttatcactttttccctttggctccttcttcctctcccactctctcctagtccctttccttgccatatcttaagtcttcccttaaaaatctagtcacctccctatttctgtgtccataggttattgggcatggagtaggacacagggtacgagagactctaaatacctattgcatgaatacttgcagctgctgaataactgtgaaccaattgtgacttcagttttatgtcattagagccttcttgaacatctcatttaaaaagcattcctttgcaaagttccatataaataaatacatcactgtaagtacatcatttagatggtgaacaaataggcctagaaattcaaatgcagttactgaattgggagtatgggagataagggcgggggggcggtgcataatttagaataaaacacatggctaaatgaattacaaaggaaaggtcctcttacctggtcaagcatgtgaactatgcatgtgtattcaaaattcagcatacagtgtttgaattttgtttttgatgatatggaacatctagaggtatttttaaatgttcagtaactactaacatttcttctaaaaatgtgattgagtgattgaggaaagcagcattattctgtcactaattctgagttttggattttaggtcttgtcggctgcagcagcagctggtgtatctgtagcctttggagcacctataggtggagtattattcagccttgaagaggtaacaacttttcattgtacagcatgtgcatgcttttgtgtcaggaattttgtacattgcagcgcaataattttgtacataatgtacaatatctgtgtatatcccagtccctgagtgctctccccaacttggtgctttaccatgtgactagaaatccagtcggcagttttcatccattagttgactctcatgcctgcagcacaacatttcacctgaaatagtttctgcgtattgactgagtttgctttctcaccttctttcttctaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaaggtgaggaattcttttgggactcagtggctgcatgcgtagctgtgggttttggagggcagagcccaggtatcatacaatcctgatagctcatatggtgctttcaaatccccctcacattattcccccacccccaaagcctcttttaccccacacgttctcataatttgctagacacttgtacctctatctcaaattgtccaagccttgagttgtccaaatgccagcctcagtgatgaaattttaggaagaatgtttgctccttttctgtggaaaacatattttgcccctcaaaaatgatggtgaagtatttattccagtacatttcatattaaaatgatatctgaccaccacagtgttactccttatagggtggctttagagtttaccaataaagcacaatattgattgaaccaaagaagttgctgggattcgaccattttgactgctaaaatggcaatttcctgtggttcaacccaatatatagctaaatatagttttttacagtggtatcaatgttcagttgtcaagaagtgggatccacttcacaggtgatccttagttaatatttaagctatcaaaagtggacatcaggctggcacgttttactttaggtacctgttaccatttccacgtttcagaagaagccagaaaagaaaatttgttaaggtattttcctcctcctttctaggtttttgtttgtttctttcttttctttagcaccctaactaccaagttattttcctctattctctagagaaatggagattcaagccagaagagatagcaactcagtttaggcattattgtaatctctaagatgacgccatccatcccctcaatacagggaagggatggagaccctgagaaattttgcagtgcttcttgagttaattttcacctcatgcctgcattctttcacttaaagggaatttgtaaaccatcagaacaccagattcaaatgcattccaaaatcaaacacaggctattttaaaagaatctgctgttttggttatccttatcatcatttccctctctcagtacagaatattaagaatttactatagtatcctaggagtcaagaaaaagagtggggagatagatgagctttacttttttggttaatcttgtaaccatagtcatgatctcattacaattttttaattgtttaatctttcttgatactgttacaaaatagactgaaacctcatgtgctatatcctttttgtgtgagcaatgggctaagattcaatatatgagcatggttatgagcattccatttaaatcccagcaccagtctttactaaatcttgaccttgggtgggttacttaacctctctgaaccttaggttctttggcatttgggaataataatgcctgcctcctggggttataaagaacccatgaatcttgcatgtagagcgtccagcatagaacatggtaggtactcaataaagggtagtcattgttgataagaattcaaaattggtggaaatgtctgcatatatgagaaactccatctattttcctttttctttgggaaaggcccaatttctgcctccagttctgtgttggtctggagagttcaggctcttgcctgatggaccccgaatcagggtaagcttctttgcagtcgtccttgcctgcacgtcccagagaacctctagtccctgtagtgttacacacacctttacagccacttgctagcatagtgcatagttaaattgtcatcggcctgtttgctttgcagagggtcagtcctccagcccttaccatgtgccaagcaatcacatcatttctcactaaccatctattggtttctctttgcagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtgagtagtgtttgcattaatttcaagttgctacccaggtgacatacaacagaagagtttattaaacacagttgactgtaggagaatttaaatgcccatccctttccagttaggtttgccattttccaagcacattaagaaagcatctggtatacagatgaggaaactaaaaaaaataaaaataaaaatcataataaaaaagaaaaggaattctactctcatactggggaaataatcagaaatttagacaaagatatctgcacaagaatatgtatcatagtataagagcaaaaaattagaatcaacctaaatttgcacttgagggactggttaaatgaattatggtacatccatatgatgttatacaatgcagcctttaaatgtgatgttaattgttaatatgtttaacatcttaaaatatgatgttatataaatttgtaataatatgcagaatgttcccaacataaagtagagggggaaacatggcagaaaattaaacatataatgtgagttcactcatttaaaaacatatgtttttgcatagaaaaaaacttgaaaaagtcattcagaatttttactctgcttatttattggcagtcagctaatagataatgactttcttttatattttctggattttccacaatggcatgtattttctaattagggaaaagaagcaacagaaaaatgaaagaacaaagaaacaagaaggcatcttggactggacatggtagctcacacctgtaatcctagctacttaggaggcagaggtgggaggatcacttgaggttaggagtttgagaccagcctgggcaacatagtgaaaccccaattcgacaaaaaataaaaagttagttaggtgtggtggcacatgcctgtagtctcagctactcaggaggttgaggtgggaggatcacttaagcctggaagatggcagttgcagttagtagtgataatgccagtgcactctagcctgggtgacagagcacaaaacccgtctcaaaaaaagaaagagagagaaaaaagaaaaacagaaggcttcttgtagatgttattttgagaactctgaatcgtctccattgtgaccttgctttcttgcaatctctggggtctgcacagttgtaggtgagacctcattgtttttggtaggtcagcttttcctggaaaggcccataattgtaagaatcctgtattttgcctacctgagtagactgtgtctatttctttgcaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattggtaaggatttcagaaaggggatagtggaatccactgtggaactcaataaatatgcctgaaatgggggaagacagggaaggggggactggttaggagccagaaggatagagctagcacgtccatcttcaatttgttttttccttctgtttgaatagaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggtaagaagtcttgagtgaagtcaaattgaattgtgggagaaagagaatgcagagatagaaagaagtagaaagaagtagaacccagtttaaatgaacattagtagcacttttaggacttcttgaagctctgagatgaaagtggataggtttttttaaatcataattaatgtaaagggagtttgggaaagaacatgtgtttgagagatgtgaactgctggttgcatattataaataacccagttcctccctgacaaaggaaacacctgtgttttgtgcataggcagcactgaaattacagtagcatcaggtaatagtgtatttgctgggtgtttgttccctacaatctccttattattacttgaggatgagaaaaccaagtttcagtgaggtgagatttatacaaagttctccagctaataaatagtagagaaaggctttaaacacaagtcttctgactcccaagcccatggctctttccttcctgggatagttcttatccagtaaagggaacccttctatttttattggaaaagaaaggaggttgaggagaggggtggatttttttcccaaacatgctacgttaatccagcaattatataagaatttcacatctgaaatttctaaatggtgtaacagatgccttgcaggatttaaatcagtaaggggagttccctaactggttcattcaacatctgctgaatccctgctccatgtaagaaggtactccactggattccagggagacacaaaaattaataagacccttctgtgccctcaaggagcagacagtgttttaaggaaggcaagaacctagcagtggttatagtacaatagcaaagaggacaagtgccactgaggaggcctgcaaagaatgtgcatgctgttgctgtgaggagggcagagttcctgctggctcatagaatcagggaaggtgctctggaataggggcgtttgaactgggctgcagtagataagattcagatatgtagcgaagagtatttaaaccagaggaaatcgcagggtctgagacctagaggtagaaacacttgcatacatttaggaatccacacatcatcctatttgcctggggcacatgtcctactcctgtgatctcatactgaaagggcagctagtgatcaaagacaaagttgaaaaggactgaggaggacaagtatcacctttgggaatgctattttaactacagatttatttttgtttttttgtattgtgtttgtcttttaggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactgtgccaaggtatactttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctct

SEQ ID NO: 17536 - DNA, 39376 bp, Human
  misc_feature (1)...(39376): n = A,T,C or G
cagtacctgtcttagccagtaggtgccaccaacatctggttctggaattccttaagtctgcatttttagttcaatgaaatggcttattcccaatattgtgaatgatgaaggtttccagtgggtcagacaaggctcatttgctggtggggtctgtaccccgactgcgatggggcactagtggcagccaggcccctgcagtgctggctgaatctgagcagtgctggctgaatcagggcagtgctggcttccaggcctcctttctgcaccttcctccctgggagaggaagcaagagggggtgtgtggagcaggcctgaggctgctggacaagaatgggcaaatgctcctgagcagaggtgggcacagggtggcagaacctctgtgttcctgctgcctctgagctggccttggccaggtgctgggggcagcagagctgtgtgaggtaagaagagtgctggctttggatggggtcaggagtggcccgagtttccacgctgccgagtggtggtggcatcctaaagctcatgccatgtcttcctgagatgcagggtgcacaggaggcagatgcccatgagaggcctggcccagggcttcctcccgctctagcctggcacccagcgagtgagccagtgccctggacacagctgctctgaggcttggggaggtgaagtcttcctggggctggggaggggtggagccaggggtgtcccctgacctggggcatgtgggctcagtcatagccactctatgtgttcatggtcctgctcgactccccagaagtgcctgtgattgccacaggtcaaggcacggagggcctgagagccattctgcagatgggaaggctgaggcccagagagggagagtggcttgccccgtgtgcccagcccgtcggagatagggtgggggcaggcaggcagtgcctccagctcccggcacttgctgccgtctgtgctgccttgggtgggctccgacatttcccagtggtctgctcaggcccatgggcagtggattcgccacctgggagcctcccttctgcagtgccagcctccagggtgcggggcaggggggcacctcctgaagtgtggttggggctttgaaatctctgatttcaaaggcgggagtgtgggaggtcccagcctctcctgcggccctatgggctgccctcttgttcctggcacacaccaaggccttgcacaaagccacccagcagcgtccagcccaccgcccacgtgagaggtgccccattccacccatctggtcccctcaaacagacctcagagcatggagctaggggcctgagcgtccggtgcccgggcgaccactgctgtggcacctgagcaggtccaggcagtgtggcctgctggttagggccacagacatgggagtgggtcagcaggcgccgccagtcctggcttggccacaggtggctctgagtactcagggcctggcttcccgcatctgtaaaatgggagaatcatggtgctcactgctgacctcccaaatccacgaatttacccacgctcagaactgaccaggtcctggtacacggcaggtgctcggcgacatcagcctttctgcctttcatgattattcccagaccttcaccttgagtccctgtggagatgggcagaggggctgactagtcccggccaccagccactcctcccactgctttcccaggtggacgggcctggagtgctgagggttggagcgacccaggcgggcatcctggggctcattcacagcgggttcttcctgcgtctgccgcaggcccagcctaaagccggggtcaggcgcagaacagtaccttggaggggagctctgggcacacctggcccgtagtgagtgtgaatttgcgtcagagagctgtcgagacccacggggccaccttgagggtgccggggtcttcccgcaggtgcgtgcatctgtagctggggggagcaggcatttggtggggcctggagtcacctgcactgaccactctcctgcggcttcttgtcttgcagatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccaggtgagtgcggggctggggcaaggggagggggtagggcctggggtggggctgtggcttcaactgcaggacgaccgcctcatcttgaggcctctgggaggtaggtgctgtggtctccccgcttgacgcagagtatacagagcctcggggagcagagtgccgtgggggtttgagcccaggtggggctgactgctgagcctgggcctttggatcatcagccgaggtgacttgcagctggttatctgcccacgtggccccttcccatgccggagggctcgggactccctgttcccatgactggggggctcagcagagagaggctgtggcctccctcaggcctaagcctgcttccccaaaagcttgtgcccacacagcctgggtcctcccctgaagtctctgcttacacccaggccaaagggcccccagggaaggcgtgttcgggctcagggcagctgcgtcccctctcagggatgccggccctgggacctgcagtggccaggtgtggcagcggtgctctgtggtctcggctcccccacggctctgtgggcgcctggccgtctgtggggcgtggggaccttttccacagttgaggtttgctcagtcgcttctccagctcagcctggccctttgggctgtttctggatcaggaagggctggtgcctggcagagcctggcgcagtccaggtcttgtcatggagaacttggggacctggtccgtgctccccttcttccttggagaagacaccccgagtagtgtctcttgtggagttgttcccagccctggggtgtccggtctgtgagggtggagggcgaggctgggcctcgtcccctggctcccggtggttgcttgtggatttccacctggccggccggaacctcccagactcccactaggccctccctctccaggggctcctcacatgagcaggggtgctccttccgctctgaatttctgtgtttgggtttcaccctgtgttcctagtagctgaaggctccatggcagagttttggtccatctcaggacagcccacccgggtgggactcgccctaggagctcctctgcccacacacagctgacagcaccagatgtgtcctgtggactcccaaaccccctgctgccctgcctcagtttacctagggcaggcactaggcccaagggattgcatgtgagggggccaggaggcagcaggtggacacctagtcccaagcccccatgccatctcccgggtagtccaggactgctcctgacctaggactgggctgtagttggggtctggagccggcctgctgcccatccacctggccctgtttagagctggccttgacctcccgagctccttttccctggagaatcttgctggctttctgggccaaccccatcaaagcccctctgctttgggggatgtgtgcagaagaactggggcctctgctccgtgtccccctcatatcacctggccttccgaaagcaggcagcaggcccaaggtgctggcacgagggaggcctggtcatgttatttttagcacaccagccctgcccctgctcttgttggcagcatggtgccctgtggcgagagggcaatgaagactcggcttccgcctgtcccttggctgactggctggcacctgctgggtcccagggccccaggatgccccttgctgggtcctcccaggtctgccgcctgtcctggacacccaggggtctagtgcacagtaggttaccccctgcgggtggcagtggtgctcccagaatcctcaggggtgcctggtgtcctccgcactgttgagctcttctcggggaggggatgggcagcactaggggaggaggcttttcagggctgcttctgggccattctctgttgcttcctgtgcagccaggctcctggcacaaagtagggacttgttgaagccaagttgcttgggagtgagtggtgcaggtccccttgacattggcgaggtccccggggtgggtgtgggtgaggagcagacgcgggttgccccagacgttccctgcccggccgctgttggcgtcggtctgccgttgggctgtgggtctcacccgcagttagtttgccgtggtctgaggcccatgcttgacttggccctggttccccagaacccatagctccttccctgggggttgagtccagctttgaggcctcagcagtttgtcttggaaccctggggttcctcacattcatgggagtgtgagcagggtttcaggagggatgtgcccccactcctagccccaaaaccacaaccgcaaagtcagagtcgctggagccagagagattctctgacttctgctgctgttggggagggccaggcactctgccaaatgctgccttctgccttctcaagtccatggccaggaagggccttccatgtggcggcgtccaggccactcgcccctcctggtgggggaataggagtctgggggggcttgggtagacccaggccagaccgcagctgcctggcccctgagctgtcccaaatctcttccctggtctgcaggctgtactcccagagcaggcccgggggacattccccacagtgtcccagagccttcctggctgcagccggctcacctgggcgcgttgcaggtattggtggagtgagttggtgccagcttccacacagcacttctgagtgcccggcatggagctggacttggtgtcaaggcctctgagctctagcaaagcctcctggtgggagggcctgcccagggcctgtggggctgtgatgtgtgcacagggagtgtggacgcgaggctgagcgggcttcacggggtcggaagcagggcagcacaggcgcctacccgccagggactgaggtcggaggggagtgtgcagaggagctggtttgctcctgcctcgatggacagatgaggtccagcaaggtccaggggcctgctcctggcgcagagtgggcctttcccaagtcggggctggtggagagacccttcaggggctcaggaaggaagggtgtggtgggtgtgaggagagagccaagagacgggcaggagacctgggtggggcatcgaggcggcgggaactgaaataagtgccaaggatctgaaaggggaaatgcgatggcccccaccctggccacgcgtggagtcctgaggctccagcgaagcaacaatggcagcctggctctcctgggagcgggagcagggagtgtgggaggagaccctggatagctggggggctgtggagcccactgggggagggacagaccaaggcagacccccggggcggccctgtgctgtgctccgggggctgtgagccaacccgaggcccagcagcctggggctggaagggcggaagaacgcccgcctggcctccccatcctggcacagccttgcttctgtagcctggaccgtcctccaggtgagcccaaagaagcaaggtgggtggccccagggcctgcagcctggatgggcacctcagcccgggctccactcttctcagatgtgcagaggctcaccgggccctgggctcactgggctagccagaccctctgatatcactgaggtctgggggagccagggatgcaggctaagttcagcgcgggagctggcttggccctgacactgagagggagggggaccgtctgccattctgtcctgcctggagtccctttcccggccagggctgctctggtgctccctcagtttacccagggcaggtgctaggcccaagggactgcacatggagggccgggaggcagcaggtggatccctacccacccgaggtggtttgggacagcctagaaagaggaagtgcgtgagttcctttcctttgtgcttccgagcaacctggacctgcagagtcatggcctgtgctcctccagcctctggcccaaggggctcctgctcacacgcctcggtgcctccccagtgctagggcacaaagcgagggtgcccgacacttcctgcttgtggatgcctttgctgcccctgctctgacctgatccccgccctggctgtacctacttctttccttttttcaaacaagccctttgcttccccacctctgaacactggcttgggggcccctgtgcctgggacacccctttcttcctcccaggccctggcccatctcctccaggaagcttgagtgctcactgcagccaccggcctccctgtaagacagtgagttgtctgcgagctctgctctgagccctggcacatggagcgactcagttacacttaatcagctcttagaggcactggctgggcatggtggctcaacgcctgtaatcccagcactttgggaggccgaggcgggaggattgcttgagcctaggagttggagacaagcctgggcaacatagttgagaccccaccactagaaaaaaaaaaaatagcggagtgcagtggcatggacttgtaatcccagctactcaggaggctgaagcaggaggatcaattgggcctggaagtttgaggctgcagtgactgtgattgtgccactgtcctccagcctgggcaacagagtgagaccctgtttcggaaaaaaaaaaaaaaaaaaaagagaaaagaagtaggcactaacatggttccagttttgccgacgaggaaactcaggctcacagtgattaaatcattttccgaatgtcacacgagaacgtaggaggcaggcagaatccggagccagggatccgcctctggggcctccagtgcctccaagcgagacagccactagaccagcgagccctggagggctgggcagggccttgtcccctggtgcctcccggagcccagcacggggcagggccagctgggcacttagtttggacgagctctgtccctccaggggcttcactttcgccttctgcagcgtgggggatcatgtgtgaccttggccagcccctgacctccctgagccgcagcctctgcatctgggacacccagggtttcccatgcagggagtgtcaagtgtgggtgcaaagcccaggcaccgcacccctctgcagacgtctggggctttctcttgccccttcagttccctcccttctctgagaagcgcacctgctgcctgtggacatgaacactgggcatttggtgagtcacacagtggccacccggttctccagtgggagcttcatggcacccccactgtgctgagttgtcacgggggacctcctggcctctcgcagcccacctgagtcctgcagggaccaagcatccttgtaaagcctcacagcccacctgggcagatcgaggaagaacctagaagccagaacaagctggggctggaagactcattccaggcaccgaggtccatgtgaaaggaggctttgcggtggtttctgctttgcttgcattgagcctcaaactcttcctgtcccgtgagaaggggggatgggatttggaggcctgaggaaggaaggaggggagcttcctgcgcacaagcggcggcaggggtttgcagaagtggaggctgggggctgcctggccaagcgcttaccgccctgcgcagccgggctggctggcaggctgcagcgggaagcgcctgtgggtcctcggcgctgactgcagagctgggtggaggcagcggaaccaaaactgctgtgtcactgcacgctgcagctgttgccagggtgaccgggtgagtttcccacgcttgcccgggcggcagcgtgcgggccggcgggtggggcggaggggtgtgcagagaggccagtggtgtcgtgccacccgatgcccgggggtgtccactcccctctcctgggtcacgtgaccagggcccctgccctgcggtgttgtggggtgtatgtgtggttcttgggggggtccccagccctcctccgtcctgggaactgggcttcggcgtcctcatgtgtgggttgggaccccccagagtgcctgcctcatggagtgtccgggggcacccagcggggctgggcactgccaggggctcagtaatgagaggcagctctcatttaggtgggcagcgggcagggggttgcaagcagggaccgcccatgtgttggggggggtgttgaaggtccttttccacagaggcctggggtctgctgcgggcgagtcctgaggttgccacagcctctgctggccttgctgagcaagcacagtggccccgctgctccggagcagcgtggcgggtggggggcacggccctctctagcctcggtgtctgtgtgtgaagttgggggtacagctgcgccatccttgctgcagggccgtgggggacatagggaaaaacctggtgtacaccccgctgactgctgtggttgccccccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggtaccgctgctgtgggggccaggggctggtgggacagggttgtcaggccattgcagggtctggaggcctccccaaatcaccctcctgtgggccaagcaggacccaaggccagggtgcagggaggcaggtgcctgggccatgccccactcccagggctccgcgaggccattccagggttctcacgtctgtgggacagtgagtgttgggtggggtggggcacagggcagcctgaggcttccggagaggaggtggctgctgatggcaaggtcagcatgggggcagccagtgctgcgcctcctcccttggctgggtctgggcaaggggcccgtgttgtgccactgacccccaacggcctgagagggaagaacgggctgcacagtgcagacacagagcaggtgacttgcctggggccctggtccctggtgggctgggatttgtccctgccccactcctaagctgtcctcggaggagcagagagagtgaggctggggcccagtctgagcccaggcaggggtctggagaccagcaggtccctttctgaggcctggcccgccagctggtagtggcggcgttggatggggggtgggctccctgccggggcggtgggtgctccccagccctgctctgccctgtcccgcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaaggtaggccacggcgtcgggtgggggcgcgggcaggtgttggacaaacagtggggcccgggcttgtgcgtggacacccgagatggacaacagggagtgagtggcctggacagaagcatggcaaggccaaggcaggagtgggggcggggcccagcgcgtgggcacacgtgcggcccagagcgtgggcacacatgggtcctgggcggcatgttctggctggcgttggctgtccggtgaggggatggtcaaggagaccctcaggtggcactgcttaggttggagaggtggagcgggggcatcttctgagctgttggatgccaggggtggtcccgggccagcttcctcccgaggccaactctgtggcaccccgcagggccgccggatggcccccaggctcttggagcagttcctcctttccttttgtttttgtgctcgtcttattaacaaatctgtgtcggggcggtttgcagggaagtccctcccccgatgtcaccaaaattgtcaagtcatccagccagacctgggtcggagtcccgggccccacaggcactgtgacttcccagtcctggctggctgtagtcctcagtttccccatctgtcacatcccctttccctctcaggtttggcgattcctggcctcttagtgggtccctgggtcatggtttgcacacacgtttgggggtgtgcctcagttcctcccatcgggtcccgtgccctgggccttgtggaggtgggaggtgctgtctggggtgaagatctgttggtctgtccctgtccccccgctctgcaggacacccttcctctgtcctctgctgtgctgctcctgaggcccaacacctgtgtggctggtgtgtcttacttcctccccgccagcccctggtggggtccccaaacaggacccacgccactgtctcaccgtcagggatgtcctgagtggccaccttggtgctgcagtttcatttcatcatctctcttgtgtatgtcttctcagccttaacggtcctgttgagaaatcagagcctctgccaggcgccgtgctcctggagggtgtcctccttgggctgcgaggctgagtgtggtgtatgggctggtgtgaggtccttgtgcctgcatagcagagctgccttccagagctggtgtggccatgcccagtgctgccagtcaggcctttctgatggggattcgtgtttcatggagtgctgacgtttgctcaggcccaccctgtgctgtgcaggttgggaaaccgagggcagacggttcaagccttgcgcagggtcacatgctgggccctggcccccatccagaccttgttgctttcaccagagggcagaggagcatgtgcccagcctggagaggtgtgtgcccagcctggagaggtgtgtacccagcctggagaggtgtggacccagtctggttcttccgggtgcctggtgtgggcagggaggcttgctgtggtggcaggtgcagccttgtccctggaagatggaaactgggacaggggcaggcatagtaggcagtggccggggcccctgtgcccaggcgtggagactggcctgttctggggtggaggcccgaggcgtggctggagctggggggggaaggcctcgtgtgcagccttagcctggcagtctctgtgaggatgccacagcacagagagcttggtttagctgagaccactctcagatcctgggggcttcagggagacccctgcgagcttgggggcagatgagagcgctgtgcatggctgatgcctggcctgggcctgcagcagtaagctcgctgtcctttgaaagtgatcatcagataaccagggggggcccagggggcagccagtgcaggcttaggggaagctcaggcactgtgggagcccagaggaggcacctgaccctgcctcgggcacccggtgagacgcaggcaggcaggagggctgttgacgcctgaggaatgaaaaggtgtcggcaccacaggcctggctgcagggagcagtgtccgtgaagtctgaggctgtcatcacacctggccctcggaagtcggtgatggcctttctgagccccgtcccggaccctccaggctgcactgactccttcctaaggccctgcagcccagtcatccatgtgcctgggatcatcagactccagctgcctgggccccccaaagcctggggacgacaccccatcccatcccagtggaaccgtgcagtgttggggctggggggcctggaatcacctggtcagaccgctcccctggtgcccatcggtgactgggtcctgttaggagcagctcatgtgggggaccaccctggacacccccttcctgatccccacacatggtctcactcgccccatacctgtgagacagagaaatggggtatagagaggtgagccgtggggaggtctaagggccagcaccaggcgtggcccccatttcttgccggtccttcctgcttccagtccttcctcttggcagcgcataagccctggagaccagacttagggccgtgagagaaactgctgctgctgtcaagggacctcctcccctttgcctccagcaggattctgaggcgtgaacttgcagtcagaatgctgccgagcgctctcgccccaaacacagctgcagaactcagcctcggtgtggagggcacctctgcgtgggcggtgaggaggcagtgaggcccccgtgccaaacgtgccctgctgccagtgcctctccttgtgcacagggggagtctcttgcctcccccagcctggctgtgtgggctgcacagccaggcctgtggagctccttactcttgggcagtaacggggcccctggtgcagcccaggcactcgccctgcagggaccccacgtggaaacggtggctgggagggcttggcaggcaccctcctccccggcctgcgtctgggtgctgggcaagaccccttggctccagatgggtcctgaagtgcagagcactcccctctctcctcttgggcaaaccactgcaaggcaggctccccgacagcggagggcagggctgttggctgcatgggtgaggcattgcagcagccctggagaaagctatggggccaagttggccaacactaggtgcctgtggcccagagcatgcaggatgggagctgtcggctctggggactgagccctcctaagtgtcaggccccctggcgggcagctccgcccactggccttggtgtcaagtggtccctcggcccggtttgtgatcagacccctagaaacaggctggagctgaggcgtcgcatcccagtgcagtgctgcgagggagtcgcctggggttggtcccagggctggctgaaggcaggatggcccaggtgcccccatgcggtgactctgcccccggcaaaggcccactctggctctggggcagatgggttcccacccctatgcggtaggataccacaggctgatagcatctcaggttgggcaatggggcctgcacgcgcaggcagccaccaggagggactcgttccgcagcattcccgggaccaggggtgggcagaggtggggggacgtgcagtggtgggtgttggccctctgccaagctgagcctgggcctgtttgctgaagccggggagggggcaggggttgggggtcccgcagggacacgtgctctgatggggaagacaggcctcacccttgggggttcccagtccgatggaaaagacctagcttccacccagggtcgtcgggggagacattggtctagagggggcagtggctgtcccccattctgcttcctcctcctccctcaggaaggctgcttcccatttccttcctgcctgcctttgcttcctgtgcccaccctccagctctgaaggactgggtgtggaaacagcagggtctggcgtgtgtgcacctatgtgtgcacgtgtgtgcatgtgcgtgcactgcagggatgtggctgacccacaggtctctgctgtgggaagggagccctggctgggctcgagtgtggccctcttgccttctggcctgtgaactgggcaagtgaccttgcctcgcccagtcctcaggttcctcatctgtgatgggctgggggcatcaggaagacccctgcgagcttgggggtggatgagagtgctgtgcgtggctggtggtggggttggagagcagtggtcacgtgtgggtgtgggtgtggtatgtctgtgtggtgtatgggtgtgcgtgtggtgtgtgtgtgatatgtctgtggtgtggtatgtgtggtgtggtatgtctctgtgtgtctgtgtgtgtatgtctgcatggtttgtgtgcacgtgtgtgtgcatggttctcgtgttctgatgccttgctctaggttgaagccctggagggaaggtaagtcactccctttagagactctagcttgctgtgtggcctctggcgctgctctctgggtctctgtctccccacccttaagaggaggccagaatggtttggtggagttcggtcctgcctgtcttgggcccagccctgggctgcacaagggacggaggaaggactcagccattgccactacccaagccagaggagccagtgggcctggggatgcccctcggctccgacatgcctgcctcggagctgtctgcccttccccagaccccctccctcctgcttgaccctgaggggctgtggcaggtcagagatgtcctttgcttctgaggggctgctgcaccctgagtcctaggccagcttgtctctgggggcctgggaccccagtgatgctggggagggtccgcctgggcaggagtctcaggtcttcctgggaggactgggctgcggtgtgtgagtctcctctgcctccgagcagcctcccccgtgcctccactctgcctcctccagccgccacgctctggtctggagggtaaagaggctctgtgtttacagacacctcccgcccggcctccggcgccagcggaacatgagtcaagcatgacttcgtctagaaggtgattgtgctggcaaagcataaatcccggcccctcctgccccccagcctataaataaagcgatcatatttataatgatgctgggcagagctgccaggcccttcacagcttcaaagtgcttcacaaaacactcgctaattaattctcggctgccctggcggaggaggcaggtgccaaggagcccagctccaggcacctggggagaactggcagcaaggcccctcgctcagggccacccttgtctggggctccccatgccctggggctacctctgagcaggagaaaatccctggcaccgggccgggctggcgcgtggggtgggaggctccggtgacagctctgagcacctccaggccccccgtgtgctggcgcttcctcttggagccatcctgggggtgggcgctgtcattttcatcttacggatgagggagccgaggcacagagaggtcaggggacttggccggggccacacggctgcttgggctgtggcaggctagcaggctctgtggggctggggttgtcggatcccagggcctgcagctttaggctgctcactgtcttgagcgctcagccctgcccctttggctctcagagcctcagcttccccactgggaagacagcagtgccagctatgtcttggcactgagactttagaattctgcccttgctgcccatccttagggtctcagggacctgggccagtggaggtgccgtacccctcagctcagatgctggctgagatctgcgtgtgcgggggcttcctgccccgggggctgctcagcgtgggtggggtcggctctataggctcaggaccctgtatggagggtcgtgtcagtagtgaccccgccccggatgagcaccgccctctggagggctcatggaagtcccatgtgggggctgaccggagccttctgcagcctctgccagacccttgccatttgcccaccagccctgctccccatcctgcccccacccaccatcaggtttccagtagggccaggcctgtgcatgccgactgcggggtccctggctggctcctctgcctggttggtgtatcctgaagctggggatgggcctccccgcctgagtctccctgtgtgggcggaagtccctcgctcaagccagtgggccatgcaggaaactgttggcacagggtggctgagaggcatccacgtggggctgttacagagctgtggtggcatgaagggaatcagggcaggactggggaccctgggcctgggggtgtgaagggaggggcttgcagagccccgagacggctgctcagtgggagctgtagcttcaggagaaagtggcggctgacaccgtggcgggtaggggcagggagggtgccacaggcacagatatgttctcccaccgtttgccaaacccatctggaagccagagggtgggagggtgggatgggacatggtcagtccatgggtggctggtgcctgtgagtaccccaggtgttctgcccaccatcgagacatcctagaggggctgggatgagccccgccacaggcccagagaggtggcagcttcaggaacccctctgccaggccatacccttgggcccttaggagggcaccatcctaggcctcagaccaggaggagaaggggcctgggtcagggactacccagcccagcacactggcaggagggcacaagggagggaggaactggccccaggtccatgtctgagctcggaggagatacggtgggaagggcatttccagggcgagagtggagaggccttgactggagtaggggcgtggagctgtgctggacagaggtggccgcaggaccccatggtcgctgttgcttttctggctctgcggtttactcacttagaccagtcattttctctctcagccatagttttctcaccggtacaatggggtaatgtgagtgcccgccctgtggggcggtgttggggttgttgggtggtggatggaacagaaggaggtggtggggttggggaccagagccccagctcaggactttcagggaaggggacgtgtctcgggggaaccgcccataagccaagtggactcttctatccaaattccatctgggtcctagcctgtcccccggcacttgggatccccagataggctgacagaggggctgaggtggcttcctcagtgttcaaagtggacagtcgaggaaggcaaatccaggtggaggtaagctgggggcgggaggagcctcatgcgcctgggcagccagggctcatgcctcaggcccctttgctgagcgcccacccccagggctgatgagagtcagctgaccggagcccatgcctggtgcagatcctgctgcctgcaagcattgctctattttgtcataatgctcggcttctggttccccccgagtggctgcttcctgggacagattgaaaggcatctcggtgccctgcatggggcatggtcggtggagctgggtgggccgtctctgtgtggccagggtggggccgggcgcctgccctccatttctggcagggcccagtgtccttgggaggggcgtggggtctgcaggtgcacggtttcctgcttgcccaggtgtctctgagcctgtccctcccccgccccccgccgcaggttccccttgcccaggccctcagccagcacgggtgcccctgtgctgcctcatgagcgtgctctgctctgcttctgggcctttgcagggatcgtgtctccagcctgagccatgattcctctgcaacctcctcttccagtcacattgacacctcttccaggaaggcttcctggttctccctgagtccatagaccgtcaggacctttctcgccccatgttggggtccctgctgcactgtctccttccaggccccaggcaggctcctggtgtgaacattgattggaattaatgagagttggcctctgttctcagagcacacaaccacacggaggccaggcctggggcagagatggggtctccatcacccagtgctggtggggatgctggtgttgtgggtgagttggctgggagctggcaccacccggccaggacagccttccctgggagccactggccgggctgagcgtggggctcacctgcgcctcccgggttgtagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcggtgagttgcagcctgtgcaggggtgggcagcctcacatgcctcagtttccctcactcactcaccctcccacctgagcagctgatgagccagagaggtcctgggggctgccctgggccctgtggctgcctcagctcggcctcttacctgaggtgaccccgtgggcccctcgccccagctgggcggcactctcctctcctggcccatgcacgagtagcccatggggcaggggccaggggccaggggcccggggcctggggccctgcggccacatcatcatcctcggccacctctgctggggcctcagccgccgtgtcccctcggagtttggcctgtctcggtgcagaggctgtccctgctccccggtgccacttggaaaaggtatgggaggaggccgagcccccagcaagaggctctgcaggttggttccagggctggctctgccagcagccgtgtggccctgggcaggtgcctggcagtcgcggtggctgctgttgatacaggaagcagctctgcagccccccagctggtcacccccatgctgaccctcctgccccctcccaccccaacagcctcaaggggaggaggattgggtgggccgcagccctggtcccgggctcttctcctgggctggctccagctggtcctggaggtgttggattcaagaccccctggcctcgccctcctctccttggaccctccctgttactggctcgctccctgtggcatctttgcttctggctgtggccttgccagggagggcagcacaggggcgttctgagcccctcctaccctaccctaaggcctaggaacctgtgctgctcgggaaccattgctccctggtgagcttgtctggctgggagaccccacctgtcccaggccccactgagggggtggctccagctgtgcccggggttgggcaggtgagctcctggccacccgtgtgaaggttcaggactgtgcagtaagcttcctgctgctggggacctgggtccagctggccctcagggcccatgtgtcttttgccatggtcaccatggtgtccagtcttcatctgtgtctccgtgtgggtttggggctgggaccagagccctgtggccaccgaagaccttatacaggccgaccatgaggttgccccaacctctgtccctctgtgggcccaggcacaccagcctgccctccgtgctgggtgcgccctgcaggtcactgtctccccaacccccagggccttcgtgcttgcagctcacgtggcctggaactgggccctctggctcttccccaggctttggtctcagctgaggtacctccggccttcatctgtgcccctgccagggtggggactgcccctgtgatgtgggctgagagcacctgatcttttctctgtggcccctggcactggccaccacagggtgaggtgtgttcacagggtaaggtgtgtggtgggttaatttctgcccccacgaggctgctggtgatggctgtgctgctcctcaccaccagcttcggtcaaggacagcgaccccaccctgctcgttggcactcacacaaggccggcatccccactgcctctgcctgtctgagggtgggggtctgctcttgtctgaggccccgtggctgggtcagggccaccctgcttccctgccctttctggataggacaacctggtgcccccacgtccccggctctgctcagacctctactctggctgggggctggggctgcccagcttgggggaagatgaatgggaccccgacagcaggcaccgttctttccggagaaaccctccccttgagtgacaggcacagacccacccccagccctggctggtctgcacgcatgccctgccctgctcccgcctcaccagcctcgcggagggcaggggagggagggtggctgtgagggtttcatgatccagcagaaaatccaaaagcaagtttggcagatgcacaaagggctgccaagtttttatttcgtgaaggacattatttgggggggaatctgccatctgctgtctccgccactgcctgaaagttcagggagtttagaaccacagaggcaggcagggctcgctggggataaaggacacgtcttccacggggagggggtctctctgtgcccgctcactccctgctctgtctcatctcacactgaacgctcctctgtggactggcctgggtccaacttccagaaccgctcactgggccccttctctcagatgggcaaactgaagtccagagagggggcgacctgcccagcgtcacggtcctggtgcctggtttctccccagcgcggggcagggcctgggcgggtcctgtggacacttctaggcaggagtagagcccatcacacgcctactgttacatgaggcacgttggatctccaggcgagaatgggaggctcacagaggttaatcctttccccaggccacacagggaggtggagccaggatcctgcactatccctccctacctaggggaccccctccaggcctagccctgctggtactggagcgagagcctcacacctgccgggagtgtgcctcctcctccgctccggcctcctggctctccagcctgccacattctgctccctgtggccggctgtgcacactgcaggcacatgacagatggtgacccgtgtgcccactcctgcagaggtcccagccagcccaggagggcttgaggctctccttcctacccatggcaccagcctgtcacctgggcctgctctgggccccgtcttggcttccgagagtggccggctagtggctgggaagttcctgggtacaaggatccccagcagagccactgctgcagacacggtgctcggggctggttcccatatccccccgcccctgccaggcctgcttcatcctttctcagggataccctgcagccgatgggcaggcgagaaggatgggcccctttcagcccccagcgtgacagaaggagaggctgaggctaagaagccagcctggctgtggcaggcctggggggcgctgtgcacagatccgggagccctgtgagtgctgggggctgtggctgctgctgatggaaggtttgtggaggaatgagtgagtctgtgtagactgtggtcaaccccactcagccgagggatcccacccctgtgtataccccttctggctcgggcccccaagggctgccctgccctcttccgagggtcctggcgagtctctgtgccattcctcgggggccttctcactccgccctcagaggcctttcccgccgggcgctgcgtttaggctgcacgtctctgatgagcagatggttgctgttggtggaagctcttcaaagggaggcatttttctccttggcagatgccctgaagtgagggatccccgaatcctattcacagtcgttattcctgcagcggcaccactgagggggccgtcatctgagttcccattgctcaggacacagaaggtccgtgacccaagccccacctgccaggagctgaggaggggcctcccctcctgccctgttcaaggctgcctgggtcccctcatctgtgagactgaatggcccccttccggctaggactttccaaaggagccgtgaatgctgctctctctgtgcctggggcctggtatctcagccgaggctcctgccctcctgagctcccacatccatgcctgatggaacgtgagaggccagccctgtccccagcgtgggccaccttggccatcagagatgaaggtggttggtcccaccctgctccagtgctgcccatatccagtttcgtcagctcgccgcacctgccttccagagctgtgggagagactcgtgcgtcctgctgtaacccagtggctggaaacaacacacattttattatatgactgttctgtggccagagagccaaaagcagtcttgccgggctgacatcaaggtgcctgccggctggctcctggaggctctgctggggagtctgccctggcctctgcttctggcacattccttggcttgtggcctcttcctccaccttcaaacccagcagtgtctctctccccttgggccccagcgtctgtgatctcatctcttcctctgaccctcctgcctccctctcatagaccccttgcaatgaccctgggtccccccagtggtgcaggcttacctcccaatatcaggccacacctaatcacctctgccaagccccatgtgccatgcaaggtcgcatagtcccaggttctggggattggggcctgggcatctttgggggccgtattcagcgtcctgcatgggcccagcgtgtggcagggcctggtctgggctgtgtttggtcagtacactggcttctgggactgaatgtcctgctcttcttcctccactgcagccgaacgaccctgtcaccaacatttgccaagcagccgacaaacagcttttcaccctggtggagtgggccaagcggatcccacacttctcagagctgcccctggacgaccaggtcatcctgctgcgggcaggtgagtggcgaggcctatgtggggatggggatgccatgcagatgggacacgtaccaggacactcccccctcccgggatactccgcactcccgggacactcccctgtcctgggacactcccccctcccaggacccactcctacctcccgggacactcccctctcctgggacacactcctacctcccgggacactcccccttcccggaacacactcccccctccctggatgctcccatctcccaggacgctcccctctcccaggacgctcccctctcccaggacactcccgactcctgggacacacttctacctcccgggacactccccactcctgggacacacttccccctcctgggacacacttccccctcctgggacacacttccccctccagggacacacttccccctcctgggacatactccccactcctgggatgctcccatctcccaggacgctccccgctcccaggacacactcctacttcctgggacgctcccctttcccgggacactccccactcctgggacactaccccctcccgggacacactccccgctaccgggacactcccccctcccgggacactcccccgtcccgtgacattccactctccctggacgctcccctctccctagacactccctactcccgggacacactccctgctaccgggacactcccccctcccaggacactcccctctcccgggacactccccccttccgggacactcccccctcctgggacagtccccactcccgggacactcccctctcccgggacactccccgctcccaggacgctccccactcccgggacactcccctctccccggacactccccactccccggacactccccactcccgggacactcccccgtcctgggacctcctatgtactctatgggactgttgggggaagggcctggggcctcagtttccctccatccctcataaggaggtgtaccatgcggggtctctcagtggccttcagagaggtaatgggctgtcggtggaggtttgggggctctggagagggaggctggctgtgttccaggggctgcccaggagagccacgtgctctctgcccttctcctcccactccaaggccgcagctctctttccatgcggtaatggtggtgcacagagccactgcacagaaatgcctgctccacgcgcatcacactccccgtgatgccatgcggcggccaggacggtggctgggagctcagctttggggttttggggtcaggttggcagtggaagcctggatggggcaggccccccgcaaagctggtcccccacctggaaagggggtgtgaggggcgtgctgactggggctggttcttgccgagtcagccggggtagctgtgaggccaggctgttagtggagtttcctgctggtgaagcaacacgttgggtgcccaggtctgccctcactgcccgacgatggtgctggtcactgtcccatgtccccctgggcccaagaagccaagctcccttagggccgggtgtcccagctgcctagaggcccgctaccgcactgtgggctccgccgcctcagcccgactggggagcctcagcccatacaaggcggctcctaagtggcaagtggagaagacacagccagagacgggctccctgtgaagcagggaatgttctggaagttgcttgggtcagggctgtgaccacacaggctgtgtgtatagggcctggcgccgtcgccaccctcctggaaggactcttctggccatactgggccccgccggaggagccaggataatctcccatctcaaagtccttgacttaatcccgctggcctcgtgtctggtgggtccttgcccctctgggcctgaggcatgtggctgtctgccgttgcgggctcagacttctttcagggtatggtgagtattccgcctgccaagggaaccctgcccttgtttgcaggggctcccccagaaccctcggttcagagcccctggctttgccagctgcaggcctgcctgaccccagtggtccttggagagatagccaaggcttttgctgagagagggcggtgctcccaccccaccccaacccaccagaccgatccagagaacagctggccgcacgcagctcttttcctggggatcccagatggttgtgcgctgggggcctggcggaggtccgagtcgggttggatggctgtgtccgtcgccatgtttgtgtggtgcctggccctgtggtcccatgttctggcagcttctggctccagcctcagcctgtgtggggtgttcgtggtggagtgcggtgctgagggcctgcgtggggtggtcgtggtggagtgcagtgctgaggttagagggtttctgtggctgtccctcttaggtgggcacctgcctgtggtctccctgcagctgtcaggtgggggctccccgcaaggcccttcccttagcccagagccctggtgccatgagtccccaggcccttctaggatgcctggaaagccatcccgtggcatctctgcgagggtggcctctgctcctgcccagcggctctttccgggagatctctgcggctgcatgtctctgagtgggactcccagcctgacctccccctgggcgcccactgaggtccttgctgacctgtctccagtgggccctgctcatgcatgcttctggcttcgagggccgcatggtgaggtctgaagctgcatttccggcatgagtcccagccccactacccacgagcagctgaccttggctgagtcacttactctctgtgcctcagtgtccttgtgtgttctgtctgccggggccagcagctcacccatcaggtggtctccccaagccccagtaaggtccactgaagcacacgtccaattcagatgtggaacactggagtttgaagcctgcactggccaggtggctggagaggacctgggttaactccaaggatacactgtgcctggctggtgttggctgaaggactctgtccccctccagggggctcaggtcaggatccatggctgtagcctgactggggaccaggggtgatcctgctgggttttcttctggcaggaggcagtggcagaggtgaggccccgcccagctccggcaggtgccagggccactgagtgctcccccattatgtccctgtgctaggccctcccactgtgttcccagtgctggtgggggaggtcacttccgctgggcgacagcaacgatgggaatgggtgcccagacctgcaattcccaccatcgtgagagccattggccatgcaggttcaaggcccaaggtctctgctcactccggggagtgtccacctgtggctcgcggtgacactgagtgggggtgcagtggccacagccctgcaggggcccagaaactggtggaggattccagccaggctgtgggaggttgatgtcacacgtgtctgctcctgtggggtagggccccttccttggggtgggctgctgccctacccgtccaggaggccttcagaaataaagcattaaaatgaagagttttggcttgttccatggaagctctgggtcacaccctgacccttgtgtttgtcagatgagtaaactgagacagggccgggtcgctcacagctttcaggtttctccgtccaacctccttcccacctgcccccttcatcccaggctgttgctttccaaggccgtgttagctgctccagcggggtcgtctgagggcctgggttgcacaggcacctcctgcgtggcggcagggtggnnnnnnnnnnnnnnnnnnnnnnnnnnnnnnnnnnnnnnnnnnnngagggagggagggagggggcccaggccttaggtagcaggcccaaggtccccctgtggggacagcacaccactttactcccctggtcttgttaatcctgcccacatctctggccccagaacacagggtaagccaggctgggctcttgtcactgccgccctgggacgggatccccatcacaagccccatggggacagcagccgtgactctgggggggccctgccctgccttgtgagtgtggactcatttaactctccagaccaccaggagtcggtgttattactgtcccttgtgctgcggaagtggtggctcagaggtgagacaggaacgtggctgagccaggttggagcccgaggccccagcttccccacctgacccttgactctgtgctgttccttccggaagcgctgtccaggggtcctgcaaccccagcagaggccctgagcgtttgggcagggccacgagggatctgcaggagtaagttccttgggaagggccagcctcttgagttggaggacatagtgaccaagggagcagccccaggcaagactctttgtcctgcgcttggagcctggagtaagacctggtatcctctgcatcactgaggtcctccttctgaaaggccagcgcaccctgagccgtttaaagctgtgtccgtgccgggcccccacatcacagggccaggagccctccttcctgcagcgatggagcacttaggaaggtgaagataccccaaaggttactgtaaagtgggttcctctcctatttttctcttacatccgagaaggaggagggcagcttacaaaggtgtgtggggcaggagaggagaaataaccgagtgaggacatcggggtggagggacaggggacaggggagctgagatgcagccggcgtgccggagggtgcagagagagactccgcactgttctgtccgtgtgtctgggctcctgacctgtatcccgtgctgagggccgcacctcggctcagcagcgccttctgaccccagccgtgcactaggcccctctgctgggcacaccagagtttcagaggcgagtctaccctggtgcctgctgggtggcctcaggggctctcggggcagtgggaggggaggtggccactgctcaggtaaacccccaggcctgcaggatgtgagggagagaggcaggcccgagaggccaggactggccagggatggtgggtttggggccagttgtgccccagcccagatcttgtcctcggccccctgggtccctgcccttggccacaggaagtctgtccacactgggcctggtgtgggaagggagggagagccctttcctaggagagcatttgctctcactggatgtcagacccagtgcctctcagcctgggaaaacctgacgggctgagccgtaggaggggcaggagtgggagtgggcccggggctcctgtccaagtctctgtgtgatttggggcaaacccttcccctccctgggccacagattacccacatgtcagattgagggggcctcttctagattagacttctcccaaatgtgatgctacagatgtttcattgggcaaaaacaaaaaaaaaaaaaagagggttctgtggtcaaagaaaatctggctgggcagtgtggaagctgttttcgcggctggctcggctgagccctgggatgccactgcatgctgcggccttggttgtgtttcctaaacccccgccccgggggaccccactcttcttactccccatcgcaacgggctgcctgctgccacctggcagggagaggggatgcatgacaggcggggaggtgccagtcccgagtctgtgacggtatttccagccctggcttttccatcagaccgcccgtggtgccgtctgcatgctcccacggtgatggggcacagaccccaccgttcctccctcattttggttgcacagcctggggccagttgggtgccatccctgcctggtctgtcagcacacctgggcggggcggcctcgggggtgggaactccctcctggggccctgggattactcagttgtgaaatggggagaatggggacggtgacacctgcccccgggttccccatgacagggtgggtatgtgctgggagggtgtggagggccgagccggagctggcacggtggtccccaccaacttcttgctgatcacttaccccctcatgcctcagtttccccctctgtaaaacaaagttaatgccagttttccaggattacagttgggattaagtgggaaattaatgacagtgtcggccatagaggctggagcctctagagcgctcagggagtgtggaaggtgctgaaggtgactgtgtgactgcaggtgactccatgtcaccctgtctataagagctgttaaaacagcagtgcgtgtgtgcgcgagggtccctgactgtgtgactgcaggtgattccacgtcacccggtctccaggagcccttaaaacagcagtgcgtgtgcacgcgagggtccctgtttcttcctccccgatgcctgctctgcttcatctgcactggaacctcatgttgaggggctgctgttacctaactgtctgccccccaggaacccccactatgttgagaggctgctgttacctaaccacccgccccagggaacccccactgtgttgaggggctgctgttacctaaccacctgacccccagggaacccccactatgttgaggggctgctgttacctaactgtcccccagggaaccccctgatgttgaggggctgctgttacctaactgtctgccccccagggaacccccactatgttgagaggctgctgttacctaaccacccgccccagggaacccccactatgttgaggggctgctgttacctaaccacccaccccccagggaaccccccgatgttgaggggctgctgttacctaaccacccgccccagggaacccccactatgttgaggggctgctgttacctaaccacccgccccagggaacccccactatgttgaggggctgctgttacctaaccttcccccctgggaatccccccgaaagaggctgcggctctcacgcacctgccttcagttggataacctgctgtttggtggcattccacgaagggcacacagatccccgagagtcctgggaccctgctggcagcagtggttctggggccatcctgggaacatccctgggtgctctcccacgtgctccgtggcaggagtgtcctgcacacgcgggaggaagcttctggggcacatgagtttgtgagctcccgggttccacaaagctcaagggactttgtgtgggacttctcagggcctttcgtgtgccggtgtgtactgtagaacgggcattctcaggaacctcttttctgtggaacacttcatgggattggggttccagagcctgtcaggatgggtctgtgacatgctgcctctgtagggtcccaccaggggctggggaaggggcgagccccgtggggcctggagacagctgagtgactgtgtgcctcctccccaggctggaatgagctgctcatcgcctccttctcccaccgctccatcgccgtgaaggacgggatcctcctggccaccgggctgcacgtccaccggaacagcgcccacagcgcaggggtgggcgccatctttgacaggtgggggtggtcccgggaggggcgagggcgcttcggtcacctccgccaccaggccagctgagttcagccgccttggccccggtgcacatcctgcctagtattatttcagtgcatgaagggtgcacacatggaaaaagagaaaagcatgaggaggaggctcagagccctgtgccagccctgcctctggggcatctgtaaccacagggagcacttggcctatctccctccatctcttcttttttcacgatcccatgtatttatccgtgggaaggaaagcttcgtttctttttaaagtgattataccgtagatgcagttttgtaaaagtgtcaattccagttggcatgtcgcaggctgcttgaggctggcacggtaatgccgtggcagcccggggcgtggtgcggcctaacgcctgtccccgtgcaggcaggggtgtcgggaccgcagtgcttcacacctcccagtggagcaaagggctgcacctcagccacttctcaggggacacactggaggagcagcactggctggagggcccaccctcgtccgggcctgggtggtccgtgtccgttcatgttgccctcctggagtgctggccaactccgctctgccaggcgaggcggacagtagcttccttgtccctgtctctgcacagcctttttttttttgagatggagtctcgctctgtcgcccaggctagattgcagtggtgcaatcttggctcactgcaagctccgcctcccgggttcacaccattctcctgcctcagcctcccgagtagctggaactacaggcgcccgccaccacgcccggctattttttttgtatttttagtagagacggggtttcaccgtgttagccaggatggtctcgatctcctgacctcgtgatccgcccacctcggcctcccaaagtgctgggattacaggcgtgagccgccgcgcccggcctctctgcacagtctttctccacgagtctagagagccacacacaccagactgggccttctggggaccggatgtcagcttcagctggagcgggaaggctggggaggggcactgcggggtcccttgggcaggggtctgcaacacaggagccgtgggtggggaggagcaggccacctggagaacgtggcccctgaacacgagagccccaacgttagaggtgagtagaggccatgcaccggcacttacagggggattaatgccccagcagcaatgccccagggggtggttcaggtcccagagtcccaagggtgatcctggaacttgacctccatgggatgtgccaagtgcaaaagggtttgtggccgcagacggtgggcaaacggtagttcaaacagtgtccttgagggtctttgccgcaggacttgtcagggcctttaagaagttagtgtacaggagggtcccacgggggctgcagggtgcagtgtgcagtgtgtattgcccacagaagcttctttagaggggtactggggatatggctttgggaagcgaagccccagccacttgcccagctgacagatcctttgtctggctggtagagagatggcgatgacagaggtttcagggttacattctctggggtcccacagcagtgactacagaggccccggcatttcctcgccttttttgcgagtggaatgcaaagtctgccctcagtggcccaggtcttttccatgcccgctgccccatccctctgcagctgtgtgctcctgcctcagagcagacatcgggggtccctcccagctcctgttctgtcccaccctgttctccagcctccttcagatcttcttccaggaatcaaccagggcactccccattctgcagaccctcagggccgcccttggcccacaggggagagcccaggctccttaggcaaccatccccacctggtcacctcctttcccccgctgtggcccacccttacttcctggacacagcagttgagctttggggttggtgggcaggctgctgaggctagggggcccagtacactgcagaggctggtgtgattcagaatccagctgcagggctggggcagctgagtctgaatccaagaacgcccccagcgtctccatggagggagctggcgggctttccccgtgttgaggctggtggattttttttctctggtgacaagaagtagacatgcctccctctggcagcccccacccagggacaccaggccctggggaaaggtatcttcctggactgaagggagcggctggggctgtggcatgggaaggggctttgcctcaggtggtgctgggtccacagctgaggagggacagtggtgtgtctcactgggttcgggaggggtggactctgtgccctctgtgcagctgcggctcacctcagtttagctgtcacgaggcccctccttagcacctcggttcccagaataaagccccgcaggcagaccctagagggagaggagaggagcccaccctccgggcagggccaggcaggcctggcaggggcggcacctgggcctgggttccagcccactccctctcggggtgtctgggagtccttgccttggcttggcccatctcagcggccctcgggccacgccgggctctccagaggccttgggtatctggggtgtggccctggtgagggctgcgacctaactgggatggggtgtctgccctcctcctctgcagggtgctgacggagcttgtgtccaagatgcgggacatgcagatggacaagacggagctgggctgcctgcgcgccatcgtcctctttaaccctggtatggccttcctgccttgaggcttctggccccgttctctggtggggcagaggtgcctgggcctcctcctggctgtacttcttgcctctggctacatgtggggccaactcccaccctccttgagctcagtgtgcccccctcccagtgaaagtgtggccatgctgccttctgctcaccttgagggccagccaagggggcatggtccctgggcacagggggacccagcaaggcagttgtcatgaggggcttggtggtgccgtctgggctccgcggttcacagtgttcatcactgtgcgtcggaatccagactccgaaagtggccagctgtggttgtgaacttccggtgctgaagttcaggagtcccaagccctgcaggctggggatgggtcaggcctgccgggtgttccagaggggaccaacctcatccccaagcctcgggtccagggtgtttctggggctgggcccctgtggttgaggagagcagggcttggggctgtggggctggggctgggcacaggcctcctggccgacagtgcggcccttctccagcctctgggttctcggcttgaaaagcctcctaggtgctactccttcgcccaacaagtgctgacacgtgcctgtttgctcggtgccctgctggcatgggagggccccttcaagctgctggatagggcttgcctgcctagagcttggggtttagagggtcacgcccaccagcaggcacccccggcacgtgagggcaggagcacggttggtcgagggtgcgggccacttcctccgggagctgcaagttaggggccaggggagtgggaggcacggaggtggggtgggctggtggaggcagcccaggcagggccttgaaagtcttgctaagtttgggttttttcttggggccacagggagccaagtcctgaggggttccagccgggagggagctatgggtttctgtgtttggaaactcagctcattgcgtgataggggcaggtggctggggtgtggagggagaggtttggggctgctgtggggagctcacttgggctatggtggagggagtggagccctctcggctcctggccctgaccttctgaccttgccctttgtcagacctggctctgagggaccgggccgggatggagatgggcatcttcttgtggggagagcttgtttccagggtcattttatcacccaggctgtgcatccgggccgtaatcctgccagctcggaggctgagtcatgccacggcccggcccggcccgaggaatccccattcaggtcctgtgtggtctggttgctagagctggggcaccagcaggacctgggcaccggcttgcagggagggtgagattgtctggcacaagcagggtccaggcacaggcttgcagggaaagcgaagagaccagggcacaggcatgcagggagggcgaggagactggctggagcggaggcagctgggggagccaggtacgttgccaaggagcccaggacacaggccaaggtggcattcacagggggtccctgggccttgggggccaaggtggcattcacagggggtccctgggccttggaggttttggtggctgcaatcttagcctctctgtccactctaggctcttgagcccgggtcctgagctcaggactccgcaagcacaccgaggatgggtttccgcagggtctgggtactcctgggggcagcagcgctatctcccatccatgttatggggctgggacccaagggcagcagcagcatccattgtctctcccagttcccaaggcggctggaaggaaggcagcagatccctgacactttatcgatggggaaaccgagtctctggaggtcaaatagttgacccaaggtcacgtggctggcaagtggcagagctgagcctggacccagagcagcctggcctggccgtgggttccacagtcgtccccctgccaccaggctctgggggagcgggcggaggcatgtccagcggcatccctccaccacctgctctgcccatggtggggcagcctgggagaccccacacaagcctgggtcctgggggcaggtgcccgagacacgccccagctgagggttctgacctgtggcttcttcctttcagactccaaggggctctcgaacccggccgaggtggaggcgctgagggagaaggtctatgcgtccttggaggcctactgcaagcacaagtacccagagcagccgggaaggtgggtcccgccccgtcccacacacaccccagacccaggctcttgtctccagagcccccaccccctgcaaggccattttatgtgaatgagaaggtggcaccctccccaggcccagcccatgccagcaggtcctgagcaggcagcaggaggtcctccaggccagtgggctgtggcgggcacaccccacaggcccacgtcgtatccccactggaaggattaccttgcacctggcgcatagtaggtgcttctctttgttcagtagatagatgaaggctgtgcttcaccccccactgcgctcccctaccaagcagaaccaccagaggccaggcgacaccagcacatagtaggtacttcgcaagcatgtgtagaatggatggccagatgcccacacatactaaacactctctacaagtgtgtacggaataggcggtcacggcctgagcgtagcgctcatgtttcccccctgcccggctgtgggccctggaagggctggggctccctcatttctgagtccacagtgctgggtgcacagtaggtgtccaggaagagaaacgtttgtggatccctgcctgggattcaaagtcagcgctccagattctgcctcttctctctaaaggggcatctcctggcctcttgatcctcagactgtggggcggggagggggtcgggggaggtggggcccagcagacctcataggacacccaggccttcccgccaccagcacatacacagttaaccgtgtccccgctgcctgcccagccctcatctggcttggtttaaagtgaaacttcccggaggacgaggacaggagggggtggcaggcagcttgtttttcctggctttctgccctggcccatctcgccagctcagcagaaaacagcttgttctctggcccaactccagcctctgcgctgtttttgcctttaaaacaaggcctgtgaggcagccaaccacagagcttttccctgaaagaaagacttcgttaataattaatgaggtcctgcagcccctggaggggccgtgtggagagactcaggccgtgcacaggggccctgggcagacacggccagccggaagggacacctggttccgtccccatagcaccctgtcctcagcggcagctgctgccctcatgcctggccctgctatccctattcccagagccccagacttcccccctccctcccgcccccccactggtccctgccccaggaaactccccagggatgggccaggccctgaggaccaacccgtgctccctccctccccggccagccttctctgaccatgctgtgcccaatgccagcagagctatttctgaggaaggggtggccctggtctggggcccacagccctgcacaaggtgccgtgggaggcactcatggggtgctgatgctttatggaaagggtcttgcaccgttacacagctcccaagtcaggcctggctccacctgcagtgggggtgcagcctgactccccctcccccgcctgatgctctttgacttcttggttgcccaccatgtgccgggcctgttccctgcgactcaccagtgtgctcagcagccctttcccttacaagccccgcagtctcttgctgtgatggctgctgcagccagatgcattactgatactcacacccgctcccggctgtcatggcccacagtttttcattttttgagagacagtctggctgtgtcgcccaggctggagtgcagtgctgcgatcgtagctcattgcagcctcaacctcctgggctcaagcggtcctccctgcaggcatgcaccaccacgccttgctactgtttttctctttttcttttgtagagacagggtctcactgcgttgcccaggctggtctcgaactcctggcctcaagccatcctcccacctcggcctctcaaagtgctgagattacaagtgtgagccatcatgcccaactgcctgcaatttttaacttcttcacaaagagctattcagtctgccctagccagctgctgtctggcccctggcccttcatctccgtcctcagacccagggatctcccttcactctgtcctggctctgggttgccactgcctctgtttccttctagcctcccctccttccttctggaggcttggcataggcagattcagggctacagaccagcctcagaggggttggggtatcagacacagccccatccccagggaggcctccagtgccagggcagaactgcccatgccccttgcccagccctcaccagacctgttccctgcaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcacccccctgttttctctctgccttggtgttctggtttcagactcccgactccccgttcagaccagagtgccccggcccctccccagcctgagtcttctccttgctctgcggggtgggctgagacttgtccttgtttcctgcagggctggccctggctcgggcagggtggggcatcaccacctcactggccttgctggaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttg

SEQ ID NO: 17537 - DNA, 79756 bp, Human
cttgactcacaggctttcccaccatttgtttcttcccaacagtttactaggagaaatttcagacatggagaaaggttggaattgaataccatagatccaccatctagattcagtacctgctttgtcacatattcgtccatcagtccatcttactattttttatgtatttcaagatagcattttggcttttttttcttagtctgttatcactaaatatgaacctttattctcattaaaataatttcaggcatcattaagcaaatacatagaaagggcaatggccaacaaaagggcctttcaagttcttgccatatggtgggtgttcagtaaatattgttaaattagtgcacttgcattagccctgttagactagccctgtcgctaaacttgaatttgcctttgaggacaaacaattacttttaaaccatatgtttcctaggcgcatgtgatccccagtttataggatggacttgaggaagatagtctgtgaaagacaatcacttagaatttgaaaaggatttaaattatgtattatatattataaaggtatatataaaacattttaaacacataccttgtttttaccacggtgattctctcttgggatacatgcacagcagtgttccaaggagtcagtgtttctggaccctgtctcaaggatcctcttgaggaagagcctgcaagagcagtccctccttactccagccagaatagctttgtcctagtctgtcttatatgaaataaaaatttcatttagggctggtcatagtggctcacacctgtaacccaaatactttgagaggaagatctcttgagcccaggagtttgagaccagcctaggcaacatggtgaaaccttatctctacaaaaaatacaaaaattagctgggcagggtggcatgtgccagtagtcccagctactggggaggctgaggtgggaggattgcttgagcctggtaggtcgaggctgcattgacccatgatggcaccactgcactccagcctgggtgacagagtgaaactctgtctggaaaaataaataaataaaagcttttattttaaggaaacgttttaaaatcatggctgtttaggtaactcgaccagcacacactgccctatgtaagtcttggtatggtggaagagtacccaaatcttaaatttctgagttaatgtggctaaagatgctgcattatcattcttattagataaggagcagtgaacattttaatagcaagctattcttctaaagatgtgtgaatcttagatgtgtgtgcgtgtgtgtatgtctctgtcttcagtttctgagagtcagtgttcccagaatgaacagtttgtgtatttccacttcttacctcctaagagaaagaagatagtctgttgttgttgttaatgaaataggtgtttgtttgtttgtttttttaagagactgcagggtctcactgtcgtgcaggctggagtgcagtggcatgatcctggcttactgtaactttgacctcctgggctcaagcaatcctcccgcctcagttttttcagtagctggtactacaggtgctggctacaatgcccagctaatttttctttaattttttggtagagatggaatctcgctttgttgctcaggctggtctcgaacccctggcctcaagcaatcctcctgctatttagtctcccaagtagcagggattgcaggtgtgagctgctgcactcaaccaaaataggtatatttcgagtaacttttttagggttgatctctaaatgcaatgtgggcagctgccagaaaccttccctgcctccggaacagaacagggctatcaccgttggtgttattcttcctcagagtagagcagatgagtcattttggtaatgtcttcctttcttccaaaacagccacagccactatcatgtttgtaccagcatgcttagaaagtgaactgtacaccttttgtgtttttactactctgtttgtgtttgtaacatcctcttttcctctccactcctgataggctcgggttatgtatgattttgctgctgaacctggaaataatgaactgacggttaatgaaggagaaatcatcacaatcacaaatccggtaagagaactgtacattcgagtctgattgtcccatgtggacttatttttaacaaatccggtaagagaactgtacattcgagtctgattgtcccatgtggacttatttttaagattttatttttttgtaagttaatcattcaaacccacatgatttttttcctgttgcttatgaaatattgatggtgaagtaagaagctgttatataaatacaggaaaaaagttccctaaagacagttatgtatgtaattgagtttattatgtctgcttattttgtatcttcttcgatatgtttatcttacaattttttaaattacttacaaccttttaggtaccccatagttgtcctggaacatggttcagtgtgtttacccctagcatgataatactgtatctctagaataagtaaaagatgatggtgattttcctaaatgtcttaactgattgatcctatcatcatttttctaagctcttttcctaaatcagattaggttgccagaaagcaatatacttagaccagctccagtggagttagctcagctcccagtggagttctctttgctgaattacaagttattgcctcagcttttattcaaacaagaagcaactctatgtataaaaagcatttctgcatctttaccaaaccctgtttgaaattgtgtacatatacatacacacatgcatcttcaggtacactcatatgtatacatatgtacacatagatacactcatcttcagatgtgtgtctctgcttatataactgggtttattatgccctcccagagaagcatctatgtgatctcttatctcaggttctttctcctggagattgggtacattttgtttcataaagtcaaatctttgtagactattggatttctgttatggtctgtgttgtcaggaagcttagaggcaaacataatattcatttgtgtccaatcttctttgcccaagattctgttacagttttttccattatttctgtgtgatacttgtctcattacatttaattgtcctttttacatgtaactttattgtaactgttcttaaaatatgtagcaaaattatgagatgaacatcatttgaaataatgtaacaaaaattgtatcaattaatagtatttcattgcaggcttatatagatggagaaggaacaaaagcagatagggagaatttgtctttgtaaactgagtaaaacttgaacccatcgttacctgctttcttcacctggctgatttcgtgacactgccctgtgcatgcctgtccttggtccacgcctccgcctctgggccccacactgcaacgtgtctcttctgtgtcctctccctcgtgaccgtcactcatacttaatgtgtgtgcagtcttgggagaggtaccctggagatacaaagacaggaaacccggcccttgccctgtgctccttgttttccagagaggtctgcatgccagtgtttcttactgaatgtttccagaagggaacttgttgtgtctgtgctgtagaacacgttggatcccacacacctctccccggcctcactggctgtcctcttgtgtccctcccctctctgcctcacgagtgttggggttcccacgtcattccaccttcagcccatttctttacactatgcggtctcagatttttgtattgccgtctctgtggtgatgactttaaacctgtatctgcagcttcctcctgtggctccagcctcagaggaggccagacaccttcacctagttttttcacaagcacttcacactgaccacgtccagactcagctcatcacccatgtgatgctcagcctactcctacttctctgtatttctctgtatttctgttgcggcgcctttccattcagtgaaccaaggcccccaaggctaagtcacttaaagccattggtttctctccctagagttttactctgtccagcctcttctctccaccctgcgcttcctgccagcgccctgagctaagctctcatcctcttgcctggaccatgcaccttcctcactggccttgcctcaagcccagggtctgtctaaacggccagtgtggccaggtcattcctcgctggcagcattttctgtcagctgtaggtctgtgagacaccccaccatgggccccatcagacctcgccagcctttccctgtgcacgtgcacaggcacacacacgtgcacccatgtacgtactctcacgcactctctcacattatgcatacccccacacacactcgcacacacccttatgcgtgcacatgcacacacatgcgcacacacctcgcaccctcatacacctctcatgctctcatacactttacatactctttcacgtgtgcactcttacacacacgtaccttctcactctcacctctcatgcacacccacagtcgcatgctcacacacataggcagcactcacacgtgtgagcacgcacacacaccctcttcactctcacttgccctcatccgcactcatgctgtcacacatacacctgcactcacacatgtgagcacacacacccctcactcacctgctctcatgcacacccacactcatgctctcacacatacacatatgcactcacacatgcaagcacacacatcccctcagacactctcacctgctctctcacatccccacgctcatgctctcacatatgcactcacgtgtgagcacgcacacacacctactctctcacctgcgctcacactcacactcatgctctcacacatgcagcactcacccgtgtgagtgcatgtacccctcagacactgtcacctgctctcacacacgcacactcacatgctgtcacacagatgcagcactcacccgtgcaagcacatacaccctgcagatagtctcacctgctctcacacatacatgcactcacctgtgcaagcacgcacacccctcagacactctcacctgctctcacacatatatgcactcacccgtgcaagcacacacacccctcagacactctcacctgccctcacacatacccacactctcctgctctcacacagatgcagcactcacctgtgcaagcacatacaccctgcagatagtctcacctgctctcatacatacatgcactcacctgtgcaagcatgcacacccctcagacactcacctgctctcacacatatatgcactcacccgtgcaagcacacacacccctcagacactctcacctgctctcacacatacccacactctcctgctctcacacagatgcagcactcacccgtgcaagcacgcacacacccctcagacacactcacctgctgtcatgcacacgcacactcgcatgctcacacagagctcctgtggaaggagagagtgagaactgtggcagtgccaagatcgaggagggagaatgaggaacggcagaagtgatggtagtttttgaatagtgagcatatttagaaaacgtactttatatgtcttggattgaaaaaagaatcggccaggtgcagtggcttacacttgtaatcccagcacttttggaggccgaggcagggggatcgctttgagctcagcagttcaagaccagccttagtaacatggcaaaacctcatctctacaaaaaatacaaaaatttagccgggtgtggtagtgcgtgcctgtaatcccagctacttgggagactgaggtgggagggtcacttgagcccaggagttccaggctgcagtgagccaagatggtgccactgcatgtcagcttgggagacaaaatgagacagtgtctcaaaaaaaagaaaatcactgggtagaaaaagattatgtagtaattttgtataatatgctaggtgtgcatgttctcattcataggtgggaattgaacaatgagaacacttggacacagggcggggaacgtcgcacaccagggcctgtcgtcgggtgggaggaggggggagggatagcattaggagaaatacctaatgtaaatgacaagttaatgggtgcagcacaccaacatggcacatgtatacctatgtaacaaacctgcacgttgtgcacatgtaccctagaacttaaagtataataataatttttaaaaatttttaaaaatgctagatgtgtataagttaaatagattcagttttaatcatagcagagattaaagattcttcagtcttaccttttttttttttttttttttgcagacaggctctcaccctgtcacccaggctggagtgaggtggtgtgatcttggctcactgtaacctctgccttctgggtttaagcaattctcatgccccagcctcccgagtagctgggattacaggtgtgagccactgtacccagcctcatctaatttctttattgaagtatttaatttttcttggtaaaatagcaacttgtcctcaagttgctattgtggtcagaaagtgacaaaagttgtggcttaaagtgattttttaagagaatgtgattattcagattcagattattaactaattagggcattattttaaaactgtaaaaactcttactatgttaagatgagaaagtgggacctgccccttaacattgttaataattaataataatatcaacattaatagtttaatatttagataaagtttcttccaaggatagcaacttctattctgaataaaagttacaatttttcctttgatcatagattgaaatggcaatactgggatatagagttctactttattacttagtttattaatattatttatccagaagaactgaggaaccatggatcagttcactttttctgcataacaatcctaaaacttactagtttaacccagtaaccatttgttactgcttaggaatctacaagtcagcttgatggttctcctgagctgcactgcgtgtgtctgcaatcactggaccctgctggggactgactggtctaaggtagcctcactcatgagtctgccagttctctgggttggctggctttgaatggggcaacagggagactgggtctctgtcatcatctagcaacccacattaattcgtatagcgacttgggtgccagaagagtcagctgaagtgtgcagaagcccttgaggcaaggttctggattccctggaggatttccacttgattctgttgaccagcgaggtggcagagggcagattccaggcctgggatgcgcatcccaccgcttcacattcagagctgcaagccacttttattatctgccgcagaccagtacacagacaagatgagggtcatctaatcatcagctgttttcaatctttgatcacttattattgaagtttgatttttcttgtttttaggttacatcattttctgaagtaaagagaaggcttaagaatttaagattttgaacggtgttctctaggaatgaaaagcttaatgttaattgctttttttatgtataacaattcctccacacaaaatttctccaggaaatctcaactgtaatctttttcttttttttttttttttggtgacttattaggatgtaggtggaggatggctggaaggaagaaacatcaaaggagaacgagggctggttcccacagactacgttgaagtaagagcttcctgtcattcattcattagagctcatctttgccaggcatctttttatgaattatcaacttacaagaagtcagcaactttttgcaaaacaaaatttccattgtaaatataataaatgttaactatataaaatatggaaactacattgaaatagaactaagaaaaatattacctgtagacccaagcttcaaagaatgactacagatatttaggttaagtttcttccagggatagcaacttttaattggtctgaataaaagttagtatttttcctttgctaatattatctatattataaatatatattataaattgtataaattcaataagatatatgaaattatatctcaatatatctgttaatatatacattttaaatatatatttatatttttataagcaaaatatataaattttataaaatgtattataaattatataaattataaatatagatatatatttataatatgacacatataacgtatttttcctttgctgatattgctgccatctataatattgtttattgtacaatagactcacagtttaaatagatttttttaagtgcatatctcagttccttctcccattcccatagacagaggggtgtcttgggggagctgctgtggggatctcctgggtagagctgttaggatggatacccaggagagcaacacagcagcctgggctggtcctgcctgggacacccccaagctgagccaaccacctggcgccccctgctggttgtctttcggtccctccaaaccgagcgaaggttcttggtaagcttgtctttcatgttgggtgacagaaagaagcgaaggtttcctgatgccctgtgagtacaactggagctagatcaagaataaaggtacctttggttcacctccaggagaaaagaattccccccagaggatgtttacctgggacctgtctgcagagtgagatctaaggccgtccttctgttgttgatagacagtgagggtggggagtcatgacccctcagagaatccgatgcaatctctaggctttccctcagaaacgtgtgcccatgcacacaccacagccttttccatacaactgcaaccccctattcacaggcccctggcctcactccgtaggtcttatgttgaagtcttgttttacttgtatgcactttgcatccaggagcccacaaattgacaagattgagaaaaatctgagaatttaagttgatattggcagtaattggattttctaggattctgcttatataaaggaatagtgattacagatattcttgggtttgcttacctttaagaatataaaaccccctctattagaaatagatcctgcaggcagaaaatcagtaaggacgtggttgaactcagcaccatcaataaattgatgtccacttagggacatctatagactgcttcatcaaaccacagcagcatacacattcttttcaagcttacatggaacattctctaagacagaccacatattctgagccataaaacatacctcaacatgtttgaaagaaatcatacagtgtctgccctgagaccacaatggaatcacactagaaatcaaaacagaaagatagatggaaaatctgtaaatacttagagattgaacaatccacttctaaataatgcatggatcaaagaagaaatctcgagaaattaaaaaatagtttgaactaaataaaaatgaaaatacaacccattaaaatatgagtatgcggcaaaagcagtgcttacagagaaatttgtagcattgaagaatataaaccctttttgacaattcttgcttgccctcgaagactccctgaagtgaccgtaatctatgaaaataattgcggctctttctcctattcagattttacccagtgatggaaaagatcaattttcttgtggaaattcagtggctgaccaagccttccttgattctctctcagccagcacagctcaggccagttcgtcggctgccagcaacaatcaccaggtacgtctcacttcctccttctggatgtggctggctttacggaaaacagagcgtatttgtgaaggcttgtgatgcattatagctattgccattccccaaaagcaaaaacaaagtcgcttttaggttgttctgtggcatttctgttgggtactaacaaagaaatcacctgttaagcctgataatgactgtttgcaaaatttattataagagaaaaggcagggtattgagggttgcttttagaagtctgtcatgatatgaacacagaccccagaaactgcaaataccctcttagataaaggcatggaaagaagacgaagaagaggaggctcttgttgttgaggaggtcagtgtcagagcctcggcctggatcaggaaatagatgccctggccctggcatgttgcttacactctcagagctagaggccctcatcctgcgagtagaagcagtgcctgtgaaagtctaccagatccaggcactcagcacttggtactcttattgtattgcttccaggaaacttagaatagtgggataacttgagaagaatacaaggaaattttacattaattttaattaaaatttgactagtttaggtgaatttgtctagttcatttattgccaaatgatgacacagagtaagtgacaagaagaaaattgagaagacaggtatcaaaatattgttgctgctgggcacagtagctcacgcctgtaatcccagcactttgggaggccaaggcaggtggattgcttgagtgctggagttcgagacaagcctgggcaacacgatgaaaccccatctccacacgttaaaaaaaaagttaaaaaaaaagaattaaaatattgttaactgcttacatctttagaaatgaatgggctttaggagatgttatttcttgattttttttttaactacataaaaggttttaaattctatcaggcctgatgataatcatatcacttacaagtatttgcttataaaatatctgtttattagccaggcacagtggctcacgcctgtaatcccaccagcactttgggaggccgaggcgggcggatcacctgagttcaggagtttgagaccatcctggccaacatggtgaaaccccatctctactaaaaatacaaaaattagctaggtgtggtggcaggcacctgtaatccaagctgctcggggggctgaagcaggagaatgacttgaactgggaggcggccactgcagtaagccgagatcgtgccactgtactccagcctgggcgagtgagactcctcaaaagaaaaagaatatctgtcaattgaccttccaagtgagtttatataagtttatcaccatatactaactgcaggttttatacatttcaaaacagctttttgtagacattctgaattacaaattagactcagatatttaaaatttgcaggcaaggtgattgatcactgtaattgaagaattctcttctgtattttattattctatactacttgagaacattggccaggtaagggttactcactgtgaaacgtgaatagtagttatacctcactggaagttttcccaggggttctcaacctgagcctcattgccgtttgaggccccgcgccctttcctagtggggcgggcccatcctgggcactgcaggatattgagcagccttcctagcttctacctaccaggtgccagtcacatgcacgccacctcagttgtgacaaccaaaaatgtctccagatatagccaagtgttgcctaggagcaaagccaagccagttgagattcactgagttatacagaagcacccatgaaatgggtttgcattaataaaggacaagattttaataaaagaattgtaatgaggtaatgagatcatagaataagtgaggcaaacaaaaaatagaaatatttatcttattttaattctagggactgaccagctattatctcaagataggtggaggcagtttagctaatgaaaagaaattaaaactcagatttaagtcatgttctgttaggaaatatattccttggtatttacttgtagtttaatataaactggtataagtctaaaatttgtttcgtttaggttatttagaaggtaataaaagaaaaaaaaagcggggggggcatctagtctaacattgaatctaatcagatcctttgaaagcaaagaaaaatgaactgaaactagaattaacaaaatgcagaaagcatagccgtcattaatttgagcatttgaatttaatgtaaatcaagtaaaaatattttaactgctatctctgccctctgttatctgggatatgagaacaatttaagtaggccaaaatttgggtacattttgtaaataccatgaaagatgtcacgagtaggaaaccagatgaccattaattggtagctttttaaacattttcctatcaggtttgcccattgctttcattttctgaatgcgggtaggaagatgtgtgctctgaggtgagctgcttgggaggctctgattgcctgtgctctctcccagggtcggttttgttttgagagcgggaacctcagagaagctgggcctctctcctgtccatcaggcccatgggcacatcccctctcaggcatgcatctcttcagcttggcacactctgccaacttctgagccagtgtctctttactcatcttagcatcagtaagtttaaatttgactctcctcccacacaagcaagttgaagccccacattcagttggttatccaacttcctgagtgtagtatttttctttaagtatatctttttaaagatctctttgaataacttatttcgagcctgctactctttccttgactttgtattcttaatctgtgctgcatttcagagtaactagttcataaatgtataacctactatgtaagatagcactttcttttggtttttcttaaaactcctaatttcaggttgcttgggggaccctttggttctagattcttactgagtagtctcaggtgagcagagttgctggtgtcaaggcagtgttgctgcatccaggtccctggcccactgtgattgctttcctcttttggtggtgagaaaacgctttatcagccaaaacgcagttcagcttggctgcagtttagactagaattgtcagtgtgaaaggaatatgatgagttgttctttaaatggactgaaacagtttgatttggaaaattataaagctgtttattaaactacttggagaaaataatagacagcattttttttatgatcttggaatatggaagcccaccattttttttttttttttgagacggagtctcgctcagtcgctcaggctggagtgcagtggcgtgatgtcagctcactgcaacctctgcctcctcctgggttcaaatgattctcctgcgtcaatctcctgagtagctgggactacaggtgcccgccactacgcccaggtaatttttgtatttttggtagagatggggtttcaccatattggccaggctggtctcaaactcctgaccttgtgatccgcccacttcagcctcccaattgcatccggcctatggaagccctttctgagactgacagcacaaagtctagtggccattaaggatataattgatacatttaagtaaacaagtaatattaaattagcaaaaatacttctgacttatgacggatacaggctaattccattcatatacatacactcttgctaatctgtaagaaaaagatgaagaattcagaaaaataggtaaagtgtataaacaggctgtcctttggtgggggaaggtactaatagttaatatacttgggaaaatgctcattttaagattcttctatcaaactagcagagaatgaaaacagtttaaaagctagtgtcatacaggtgtggtcagacaggcaatgtcatacaaagcgagggaaaggataaagtgatgaagcttttcggggctggttcggtaatgtatatgagtatttacaatgcatatctctaaggcccagcggttctgagttcctcctgcagatctgctcgcagaacgcaggtttctgggcaagaacgtttcctacggcattgtttgtaacagcagaaaaccggaatgtaaatgtctgtcagcaggggactgatcagatgaactataggcagccacgcagtggaaagctgagcttcccttagggagagtgagggtagatttagatgtacagatagaggtatgatttttttaaaaggcacctcagtatgggtaatgttatctttcttgtgtttcagtgcacacacatacacacacaccatagatgcaaagtgtgtagaaaatgtattgaaggatacccaggaactgaatcaaactctcttcattttcttattcaaatacagattttatattacccagataaggacaaccattttattacctttgaaaagaaagcatagtttttagtggttaatattagtttcattattagttacttatcggttatttcacagtttcaagagtatttcacgttagtggctgaaccactagaatgaatggaccagctgatgggaatgaatctcaattgttaaaaatctctactcctgtgtgtgctagtcttgtttttcatcagttattgttgtttagattacatcactgctgtgattctgaaaaggtttcagtatagatcttaaactctcagattactgcttctttagagtacttacttttgagaaattaatagaaagtttttgtttgtacctttctaaagaatgagaacaatgaggtttaaaagctacttaaaagttctgtaaacctagatgtcttatctgaaggttttctacttgagaggtttgttttctgtctccttcaaatactagaaagatgtgtatacttggaataaagctgcttttgttttgctgagagcccttctggcctctgtcacatgctctccctggcatctctctgtttttctgtttcacaccccgccagtccccaggtgagtggtgtggtgggaagcatgtaagctttgctgttagatccaggcttgccagtgcggctccactgtgtaagaattgtggctttggcataagacctgcctcctgaacctcctgaatagtcagtggattaggccaccaatataaagtagtgccggacacatggaagatatttcataaatattttccttcttttcccacttcttccctcctttaaaagggggtcttcaatccacttacccttttgtgttccagcctctctcactattctaccctctctaatcgtgtagattcccttataaagtgtctctctaatcttgaattttctctttgatttgcccaatttctagctttttgttgaacagttctatcagcatgtctcctttgtatctgaaattcatcttcaaccgaatcacttatttccccacaaaactagtttctcttcctgactttcctgtttctgtttctctgaaatgttacttctttctgtgccctctttttattctgctttaaaaccctaaccgagtgccatcgtgagccacagttattgagaggcgtgctctgcatccttgagatgtggaaagagggaactgattgagatccattgttctaacagatttcctgtcttttctctcctccttaagaggcaacctagcttggtgtcaaggcagtgagtttaggagccagactgtctaggttttaatcccagatctcacacatcctatgtgaatcagggtaagctgcttagcatctctgtgcctcatctgtaaaacctcatgggatttttggaaaaagtaaatgaaaaaagagttctaaagtatttagaagagtacatggtacttagtagtggtttaataattgttaattatagttatctcatataccactgcttctaaaacaagacattaaggacaggcacacttcatttattgccctttgctttattgcacttgacagataatgcattatttacagattgaaagtttttggcaccccctgcattgagcaagtctatgggcgccattttgtcaacagcatgtactcacttggtgtctctgtttcacgttttgttaattcttgcaatgtttcatactttttcatcattattatatctgttttgatgattcatgatgagtgatctttgatgttactattgtaattgttttgaggcaccacaatggcgagcttaattgacatgttttatgtgttccgcctgttctacccgccagccataccctcgtctttctccctctccttggacctccctattctctgagacacaaccgtatttcagttaaccaattattaaccctgcagtggcctctaagtgtttcagtgaaaggaagagtcgcatttctctcactttaaatcaagagctagaaattattaagcttagtgaggaaggcttgtcaaaagctgaagcaggccaaaagccaggtcctcttgagccaaacacttagccaagttgtgactgcaaaggaaaagttcttgaaggaaattaaaagtagtagtccagtgaacacttgaatgataagaaagtgaaatagccttattgctgataaggagaaggtttgagtggtctgggtagaagatcaaacaggccacaacattcccttaagccaaagcctaatgcagagcaaggtcttaactatcttcaattctgtgaaggctgagagaggtgaggaagctgcagaagaaaagtttgaagctagcagaagttggttcatgaggcttaaggaaagaagctgtcttcataatataaaagtgcacggtgaagcagcaggtgctgctgtggaagctgcaatacattatccagaagatctagcaaagattattgatgatggtgctgcactaaacagattttcagagcagatgaaacagccttctattattggaagaagatgccatctaggacttgcacagctggagaggggaagccagtgcctgcttcaaagtttcaaagaacaggctgactctctttaaggggctaatgcggctggtaactttatgttgaaaccagtgctcgtttaccattctgaaaatcctaagggtccttagaattatgcggaatctactctgcctgtcttctgtaaattgaatagccaagcctggatgacagcacatctgtttgcaatatgatttactgaatatttcaagcccactgttgagaccaactgctgagaaaaaaagatttctttcaaaatattactgctcattgacaatgcccctggtcacctaagagcgctgatggagatgtacatgaagattgatgttttcatgcctgctaatacagcacttattctacagcccttggatcgaggagtaattttgacttctaagtcctataagaaatacatttcgcaaggctatggctgccataaatagtgattcctctgatggatctgggcaaagtacatcgaaaaccttctgaaaaggattcatcgttctggatgccatgaagaacattcatgattcatggaagaaggtcaaaatgtcaacattaacaggagtttggaagaagtagattccaaccctcatagaagatgttcatgaaggaagtaactgcagatgtggtagaaatactaagagaactagaattagaagtggagcctgaagatgtgactgaatttcttcaacctcatgataaaacttgaacagatgaggagttgcttcttatggatgagcaaagaaagtggtttcctgagatggaatctattcgtggtgaggatgctatgaacattgttgacaacaaatgatttagaatattccataaacttagtagataaaatagcagcaggatttgagagaattgattccagttttgaaagaagttctactgtgggcaaaatgctatcaaacagcatcacatgctacagagaaatctttcatgaaaggaagagtcaattgacatggcagacttcattgtcttgttttaagaagttgccacagccaccccaaccttcagcaaccaccaccctgatcagtcagcagtcatgaacatcaaaacaagacccccccgccaccccagcaaaaagggtgcagcttgactagtggaaggctcagatgatcgttagcgatttttagcaataaagtatttttaattaagatatgtattttttatacataatgctctcgcacacttatacggtatagtgtaaccataactgttatgtacactgggggaccaaaaaagtccacatgactcactttaacgtgatggactggaaccaaaccctcagcattgctgacgtatgcttttatgtcatctccttgtttaagaaacttcagagtctcctctattgccttctggaataatcatttgctacatgtcagcagggctatcccaggagaaggtctttgtgtatcagagttaggcaagcagacgctgaacggttcatggtagggaaactgtagaagaaattcatctgaatttgaggttgaagtacttttccaagctcagttctatttctgtgatgcctcagtgtggctacccatcatcaccttatctttaagttatgtatttgtctccaggcaaactgatgattctccaaatatgtcccatgctgtctcaccttttatttgtacctttggcttgctcttctgagaataacagagtgactccttccatctttcagaagcccatctcttcaggttcagctcaaataccatgtcttctataaaaccttttgttttctgttttacttctctggattcccttagcacaatttgtgactcttatacaaattatattgcttatttgtaaattgttaagcttgataagcaaagaatttatctttttttctattcccagtgacctataagagactttgtaccataatactctgttcttgtttgaataattttttttcagttataaatacatcaaaaggtactttacaatgtaaggtattaaaagacttacagatttcctgaatccctgccttggagaagtttgtgttcttaacaccgaccacaggcctaggagctgtccatcactggcctgttattctcccatctgacgggctacccaatcaaaaatgggaagattctcttacagaaaattctctggcattgttatttttttaaaacagtttggatattaaacaaatgcttgaagttaagtggtatttaaggatataacatttttctctacagagattttccatgtaattatatttgttgcaaaggaatttttattggttataggatgaggaaggcaatggtaattttatgttggaactacattttgctttcttagttctcaaaagtctatttttaggccattttaggccttttttggtagtccatttaaaaataaattgataaaagaaaccctcacaaaggttcagtattagatgtgcttataccttcattaactcacataagtcttataatgccttagacatctcgtaattgcttattgagactttctctttacagaactttattgaaaaggttctttccatctcttcactctcactcccacccccccgtatgaattctttttagttggtaatagggctttttaaggaagatcatataccagtgttagaggatttatggacatttgccttcagaactgcatgaggctgtcattactaaccttgtgtgctttttcacagatccctgacatctatgagacagctttgttcatctcaggaacctttcaaaaatacatgctggtgaagtttgttatatagggtggtttttgtttgttttgtctaactggaaacaaactattaaagcaaagtctttttttttaaccttaaaactgcagtgatgaaggaccagccagcattgttatacgtacatcctgtcatcagcacagtgtaaaagcttatttcacatggacttctcttaggtctgtctggaagcaaattatttgctgattgtagcgccatcctattctgtactcaaagctacctattttaggactttgagctatctgagtaagtagactctctaagctaatacaaacattatccatttaccttaagtaaatttttagtgttttaattatctttatttaaaaaataaacacctgaaattgacatctgtaggttcagaatatgacttaacaaaggatttgttaaataatttcacctcttttggtaattcccaatcagtaatgttgatatgactggctataaatagattgagtctgctgtgatctaccttcatttttagaagaatgtacaagttttatgttccaccagtggttttctaacgtcagtacagattcatctgtagaattaggtcatgtcctttgagccaaagatctgtaaagaacaaaacaggaaacttgtcaaattcttccgtattttgagctaaagtggttagatttttttatataagagaatattataacctcttcagtcccttttgaggaaaagagttaaatttttgtcagaaattctggtttagatgttctctggtttaagaatcagatattatttgctttctattcctacttcctaacacagttgcacgtggtatagtcgtaagatgggccgtggcatgataggccagatgacatcatcacaggtggtgtggaaggatgtgacaggcacagtgaggagttccttatgtggtgataggcggacccctgaatgcctacagggccccatcccaagataataacatagaaagtagttagcctgcgattgggaactcctcttaactggtggacttaccagatgggatgatctgtactgacctgaagtggacgtttggtgtctgctggaaggaattaggtggcccataagagctgcgaccactcacagtatgttttgagctttcatagaccctttgtacatgtttggtagaaagccaaacggaaagcagctttaattaaatatgttaccattttcattaattcttaaacctagccctccttcgaggcctgatgtagttacgatggagacagacagacgtcgtggtgccattgctcatctctgccacgccacagttgctgttctcatggtctgtgcagtgagaactcttcctcttgggccatgtcttagctgcttactaggaaaccagtgaactgagtcaggtctaaccatgtcatccaaacaagcgcttgccctgcttactgcatttttttgttgtcagaagtaggggtttatttcttactggtcccagttccccaaggatgtcatatgaggagcaagaatacaacataaaaaaaaaataacaaaaccagaaactactatttttgtggtcagcagttgctaattagcattattactgtctttaaaaacaattagtaaagtaaccttttattttattgttacagaagcagtacatatgcattgtagaaaattcagactagaaaaagaaaagtatcccatttccacaatcactactctttacactaggtgtcttattttctctctgtgaacgtgggtatacacacaaacatacagatataaattgtatataaatggtaatggtttaccaccagttggtaatccttgccagaatcagaaatgttattccttccacgcttagctggtttcatctagaaagcagcactttcctgtatcagctggagctagttaattatgtcgaattccaatttggaattcaggatagatggctaattccacctctccttaattgccatgtttcaaagtaagaagttattttatagctactacaaatagtgaccaatgaagaaagcattcctgtctttttttctgacagtagcatggatgtatggatttacattgatttcataatgtgttttgttttttttttctttgtgcttaaagttatcaccttttggaagcccattcaagctgagtcttctacctcattaatatttgaaacctctcttgctcttaaatagtgctaagtctttcatctctgtcagtactgtatcagcttaatctttctcttcattatgggtcatattttccttgcttcttttcatgtctgataaattatgagtggatgtcagacattgcaattttcaccttgctatatgctggatatttttgcattcccataaacatttttgagccttgttctgggatgcacctaagttactttgaaataatctgattatttcaggttttatttttaagcccagagcaacatttagcttagggatatttttgcccctttcctgaaacaaatcctttgtagtattgtacccgatgccccgtgaatcatgaagttttccatctaggctggtgggaatagccctgtgtgaggggttgcactcttgattcactcttgattcttccgtgtgtgtctttccctgaccttgggtagacccctcacgtgatgggctgatcagtgcagatctgcagtgtcctctgcagtctccagagctctctctctgcgtctctgtcttccccagactctgtatcctcccaccacagagaccgccgagctttgtgtgggttttccatgcctgctccgtgtcctggagagtctctccacgcagtgaatgggcacttgtgggcttactctgtctgtctcccgtatctcaggatcacttcttcactgtctggtgtccagtgatttgaacacggtttcctatatttcatcatattttttgttttcattgggagcataaactgggtccctgttactccatctttgttgtctgctttgcgtattaactgattttcaactccaagtttattttcatctctcaggtgagaataataccaccgcttatttcacaggagagttgcgcctgaaaaggatgctgtcgtccactatataaatgtttgtagtactgacttccctacaggacagttgtggaaccgggatttgaagcctggaagctgggctccagaatggtcctcttaacacatctgctgcagtttacccatcaattggcttcttggaagcgcatcagtcagttacctcttctcacaagatgctgtattgtaggccagttagaccctaagagcacacaccgggagacattgtgttcacagaccagctgggctgttgtgtcattcacagctgcgattggtaggactcactgtggctctgtggttagcttcaagttgaccaggtggctttgctgattttgtctggactctctcacatacatgtctaatgcctctgaaagcaaaaggttcagaatattaacattttttttaacttggctatttctgttttttcctctggagtttgtttctctggctgtatgacttgcatgatacttaatccattctttctgtgctgcttatagttatttttagggtttcattaatactgtatcatgatgccaaacaacagactttagaaaatataatgcattgaagataacccattgctacacagttggggctttttgcatgtaatgtttgtgagtgagtggcatgctagagttttctggagaatttggtcctgccatgaatgtgctggttttagttaaaaactttgacctgctttttcactcttgttcactgggcaccttttttattttaaggtggatattttggctcagattggttgtgtcgaaagtctcagccagtcaccaccttcttctccttctccttctccttcttccatatataaggtaaatttcaaacttgaacacaagaggaaataaacatttaataaaccctaaaagtcatctttttttcccaagtgaagtgattatgtcaggtaaagtatcttacaggagctcttcttggggcatggtgatgtgggatgtggaatatgtaggaactgggaagatcgtgaggatttacaccgtggaggcctcttagaggaggcttgattactgaattcatcccacgggcagtgagatctaatgaaaggtctttaactctgtggttgactgtgaggaggagtgtggtaccacggagagagggaaaagaagaggagaatgaagacattgtcctgtaaaaattcaagaggaaggggaggtgtaaggaaagaaacgaagaggcatctcagcattggaaacctgagtgaaggagccgaggggattattgcatgaccaaatgtctgcagttgagagaccaaaggggttgtggggatggagaacaaaaatgtcagagacatcaggcgcagtggctcacgcctgtaatcccagcactttgggaggcggaggcaggcagattacctgaggtcaggagttcgagaccagcctggccaacatggtgaaaccccatctctactaaaaatacaaaaattagctgggtgtggtggtgcacccctgtaatcctagctacttgggaggctgaggcaggagaattgcttaaacctgggaggcagaggttgcagtgagccgagatcacaccactgtactccagcctgggtgacagagcaagaccctgtctcaaaaaaaaaaaaaaaaaaaaagacaccaaaggatccttcaaccagatcattgtagtctagtttgttacagtaaagcttaggttttgaaaaaagtcaagatctcagcatttagcaacagaaaatatttgtgctgaaagtcccaagaattaggagttgctgttgttgacctttacagtaaaaatatttctgtcttcttcctcttttatgtatctgaaggtaacagaacgttggctggaatagaaaatatcttaagcctgttatctcttcaattaaaagtctctattaatatgacctggctgtgcagctatttgtaaatataactgtctggtcttttcctgcatagcataagctaataggtatgttacttagatggggatttactcaaagaaatgctagtctttattcttttctttatattttagatgagccctcacatattaagataacctctactgaatgcatactgtgggctagatgctttgtatgcattatgtcatttaatccttacaggaggataatgttatagccattgtataagtgtggggactaagagagctaagtaaattacccaaggccacacagctagtggtaagtgataaagctgggattcaaacccagatagcaggctttgagcctaagttcttaaccactatccccatgtggtataatgattacttgagtcaattccaatagcttcctaaagggagttaaactccacctagtgtaccaggattcgtcttgcccctttttatcccatattgtatatttgtaccatgtgcagctttcctacactcaccacacagcaccaccatgggtgtgcgtgtccgtctcccccacccctcgtggccattctcagtctgttctgtggtccagtggctctgcagtcaggtacaagccagtctactttctgaagaaatttagctaatgctgtaaatcctttgagtgaatgtgtttaaataagtctcccaatgtcaagcctgcataaatatatttctctatttgcattatgaggagaggatagcttttaaatttagaacgttaaaccagcaaattgttagtatattgctcctgggcctaaaggggcatttgatttagctggggtgggagttaggaagagagtcggacataatcatctacctgtggtgattacatagatttaagcgtgtcccagagacccaaccagacatgctgtaggagtgtattcattcaacagatacttaatttacaaagcgtttacccagggccccacgttcacgggcagcaggagatggcaggttaccctgatggacacagcccttctctgtgtccttctaatggagctcagacgagagtgattgtatatgtcgattttgtttgttgcattttccaatgtttgttaaaatttcaagcatagaagagttaaacgaatttcatagtgaataatcatatacccaccttctagattttaccattcccattttactgctcttgctttctctcatatttgcccattcctccatctcctgtgcctgtctgtatcatccactttcagaactcagacactgttattttaagggtactcatagtgtcacatgctaaaaattcttttttctttctcttttttttttttttttttttttgagacagagtctcactctgtcacccaggctggagtgtagtggtgtgaactcggctcactgcaacctccgccttccaggttcaagcgattctcctgcttcagcctcccaagtagctgggattataggctcctgccaccacacccggctttttgtatttttaatagagatggggtttcaccatgttggctaggctggtctcaaactcctgacctcaagtgatcctcctgcctcagcctcccaaaatgttgggattacaagtgtgaaccgctgcgcctggccaaaaatcattttttctgtagtcacatgctgaaaatcacttattctgtgatcgaccacaacaagttaattttttcaaaaagactcaatttagtctttttatacataaggcaaagtcttagtatacatagtcttagtatacataaggcaaatctgatttcctccttttggtgatcatgtcatgaaggttagaggtctgacaaagagtaagatatatttcatacaaatgatcaagaacatcacatttaaaatatttgagtccttgccactttatgcaaggcatttggagaatcttttgggggaaacattctccgggtaagacagagctgtccccgtgattcactggtgggactgaccatctgatttgcaaataatgaagaaagtgaaaggaggcggctggatgtcagccagcaggctgtgggaaggccagagcccttctgatggggtagggctttgctaaattgaggaagatgaggtgtgcagataagagtacagtatagtgtgaggaacagcagagatgtagaaaagtttggggaaatgtgtgaagtttgaagcttcagagtgaaggttagtggcaggtagggagaatggggaatgcagcacgaggcaaagttgagacctgtgctgaagaaactcctgattgagccacaggaagcttggaggtgactctaggggcagtgagtgctaatgaagggattttaattacccatgatggacagttaagagctttgcaaaataaggagtgggaagagaaagaggatgaagatgctgctcagtagaaaggaagaggagggaaaggtggaaggaaaggacagagaggcgccacaggatggaaacctcagcccaggagctgaataggttttaccgtgacgaggtgtctgtagttagggaactaccaaggggatttgggagttgagagtgaagaaggcagagatcgacgtatgggaaggatgggttcagagagaaagccagtgattggttacagttaagaggggaagggacctgccagggcagtaaaaggccatctgctgagggactgagtccgagggccgtgacggaagctgcaggaaagatctccagttggtagggttttgagaaatgtgttatcagcaggagttgggttgaaacaagataaagagagcgttccaggaaaaaaaaaaacaaaaccaaagagatagaaacaaacataaccacaaagatttcataacttaggtggagagctaagatcacatacataaccaactagtatgacagttactacacacctacaaattattgaccaagtgattttcaaagaacaattatttgtttttgccctaattaaatggattttaattttttgaggacacttgctatgaatagttcacctccaggtttttcctccatcttgatgaaaatccttcctggccagtttgctaagactgaactgtcttctggaaggccccagcgaacattcactctcctgttctagctcacagtcctgtgttcctttgtgatgtacctcacttagcttctggcagtcttctgaatccagaccactcacttctgaactctagcccgaggttacacagcggaagagaggtagagctgttaacggaattccaactcactaggctcttgactgtggccctccgagcccctccatttcacagccggtccttgatggaaaccaggctgaggctgctgtaccaatgatagtctgtccctagtgtcccaaactttggtactttttcaagttcttatttgaaaaaacttgtaacttagagtttggaggacacggaatatattgctaaataggagaataaaactacatttccttaaagaaaactgtagaaggaagggtttctcttagctgaagtgtgactgccaggccctcagcatgattgccttcatttccagcgtccactggggtcatctgagagtccatcccgaagccgaatgtcaccttgtaaagctgtgtgtttgagaagtcacagtcttgtggatgaaacatctttctcctgttagtatttgacatagagtaaaataacaagtaacttcagttttttccttagaggtatatagggcagtagaatgacatcatacttgcacatcaaaagcatgtagtctgtttttgatgcacctggcacgtgacagccagctgtctgccccatgtgtcggttggtgaagagtcaaaacagaccagccactagggtgtctgtcctacaacattaggggctatattagacagggtgggtaattttcttgcaattatatttttttctttttttaactagcaccatttgtgtgtgtgtgtgtgtgtgtgtgtataagactcaaataaaggggaagacttgctatttcatgttatgaaatagattcagtactgaaatattgtggagtgaaaggcatgaataattttaatcaattttctatgaattcagtaaacagtgattcaaatgaaaatcagtattttaactcaacattctaatgtgaaagttcagattgttttagtttaaatattaagctgatgctaaagtttatacataaaaataaacagctaagagatgttatgctaaagtattgatggtttttctatgaaagtgtggtactagtacaaatagatcactaagaaacaagagagtccagctatagacccaaatctgatatgtgatgaaggcggcatttcaaatcatgggggaaagatggattgttcatgaaatggtattagggtgaccgactgaggacaagatgttcagctggatccctgtatcatttctttttcttttcgcttttcttttctttttttttttttttttttttgagacagagtctctctgtgtcgcccagtctggagtgcagtggcgtgatctcagctcattgcaatctccgcctcctggattcaagcaattctcctgcctcagcctcccaagtagctgggattacaggcgcccaccactacacctgactaatttttgtatttttagtagagatggggtttcaccgtgttggccaggctgatctcaaactcctgacctcaggtgatcctcccgcctcggcctccgaaagtggtaggattataggcatgagccactgtgcccggcccctatattatttgttttacttaactcagttccagacagatacaagatttaaatgttaaaaaaaaaaaaaaaaaaaaagctaacaaaaaactgtatttgcctcaagggtgggatggtgggggcagggctaataggtgctaagtgtactctctactggaatattctttgagattgggtgccatctatttcccattccaaaagtttatttgtaagattaataattaaactattaaattactcaaaggaattatgggagagaaatactttttaaaaagaagtatgaaagtccctttctatgtaagacaaaacccctcagcgtgacagttgtcagaatgtgggaatgttattgcattctctttcaaaagcaatttgacaaaatccatcggttctaaatacacagtctccttaagcctagcattttttcttctggaaatttcagagaccttttggattgcagttttcatctaaagaaccaccaggatggctgattaatagaaaggagaggtttataggcagtaacattttacagactgggaagagaccttctctggtgtgtgctgaagatgaagggacacattgggttttatgcctcacagggcctgtatcacactagagtcacatatatttaggagtttgggggcaaagcgatacgtatgtatgagaggagtcaagagcatgtgcagtaggtaaacatatgtaacatccatccttgttgactttgaggtgagattttagcattaaaatgaggtggaattgggctctttatgtgaaaaggtgaactgtgggacacagtttgtgcacagcctcagcgagctgctgaaactggctttaaggcctgcagttgcttgtcagaagaaaatgtttctaaggccagtcctctgcccagtcagagttgtcttggtctgggttgtaaatcagagttaggaggggtctgataggtcctgttcttagtgagtttagagccctagtaatttaaaaagttgctctattcccttaaccttaggatccatcttagttgataaagcagtgtctgttttggtctgtccgatcacatggtattatagtacccaaagactgaaaacaagataaatgaacatcagcatatactggtcaagttgtaggaaatatatacaatggaattttatggagacaatgtgaaagaatattgtgtccatatgtgctgatgtaccttgcagaatgttttatgctgttaagagaaaaaaaaaaagtaccgagcaaaaataatacaatttaggccaacttagtgtttaaaaacaaaaaggatctatctctgtccatgggatgtttgagtaagtatatacaaggaatttgttagtagcatgaaacaaaaattatagtaggccattgtttcagagttcctgcactaggccccagcagaccaggccaaaccagaatggagttccttgtgctagatgctccatagtcaaactgaaacttgaaggaagcagataggtcccaaaacaaactgattttttctcgagaacaggagatcccagtctacctgagttagcataataaggagtcccctctgctttaacccttacgaaaaagtaacctgaagtaaactgatgttaaccatcaactttttttctgttgttctatttccttattaacccatccttaaaaaccaagtgttctgttaatgcccagtgggagtgctcgttctagattgtaggaaggaggctgcccagattcatgaatctcaagtaaaggccaagtcgatctgtaactgaatttgttgtaattttgtgtcttttgacagtagtagttccttagaatgactagcatctcaggatgttaggcgtatttctcaaattgcatatacttttattgtttgaattttttttattatacatgtattccatttcaaattaaaaagcctacttaaaaatacaacagatcgctataaagcagttagaaataggtcctcatgttgagtgggaaaaagaaaacttgcaaagagatacatacagtatgacatcctttaggtcaattttaaaaatataaagcagttgtttgtgaatgtgtacatgtgcagctgaagtatgaaaacacacataggaatggatacaggttcagaaaagtagtggttacttctggagagaaagaaagagagggctgtagctgcatctaatagtttctttgttgctgttttcaaagttcctaagcaaatacggtaaaatgtgttcacatcagtaaaattagattgatgctaccttttgtgctttcctacatgtttggaaattaaaatattatgtatgtaaaattgttttgaatacatttctattaattgtttttagtactcctgttgtattcaattgtgtcagttcattattgaattgagtcatggtttccaaaagtcacaaaaattctccttctttttacccctctcaataggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccaggtgaggagaggggtgcaaggtcccaccctgcccgcccatggctgagtgggagagacagggaagaccgaactgtttttgctgttcccacactcagcacaacacagaacagttttgtgaccacagcatgggaagggaggattgccccacccaccaagcagctgtgcagcagacaccagctgagtgtcctacagtcatgacactgtctacctggagtcagatcaagggggttcccaccactcccaccttgggttcaattaatctgctggagcggctcacagaactcagggaaacactttacttactactgtcagtttattacaaagctcaatttacaggatgcaaataaagagccagatgaagagatgcatagggcgaggcatggggaagggacgcagagcttccatgcccccctgccccaggtgcccctacatgttcagcaccccagaatctcttttcctgtagctcaaggatttttacggcggtttcatcacataggcatgatcgattattgttattattattctttgagacagagttttgctctcgttgcccaggctggagtgcagtggcacaatctcggctcactgcaacctccgcctcccaggttcaagtgattctctcacctcagcctcctgagtagctggaattacaggagcccaccgcccaccgccacacccggctgattttttgtatttttattagaggcaaggtttcaccatgttggccaggctggtctcaaactcctgacctcaggtgatccacctgcctcagcctcccaaagtgctgggattacaggtgtgagccaccatgcctggccggcatgattgattattaactcaacctctggccccacttttctttccagagaatgggaggtggagctggaagttccaagcttctaatcctggcttggtccttctgttgaccagcccccatcccaccaggagtcacctcatttgaacaaaagatgctcctaccacccgggaaattccaagggttaggagatctgtgtcaggagccagggtcagagaccaaatatcagaacaaaagatacaccttgcacacctaacattcaggaagttacaagagttttaggagctctgtgccgggaactagggacgcagaccagatggctatttcttacctcacaataccactctgggtcattgagttgaaaatagattttattcaaaagaactgcttgcagttgcccttattcactagtagcaaacctggattcaattgtagatggtcattaactctaactttagttcagtcttacttatctgtgtgaagtcacagattcaaacgctgggttggtaaagtaaaagcagaatgggcggtggaggctgcagaaggctgagggcccctgctgtcgcccgtggatcactgcatttgcagggaagctgagcccacgttctgatctccacatcttcagagagatgagaagtcttggttatttgtcaccttctgattttaacatctcagcagctaacacgtttgttttaaaatcttgagccagaaacgtgtatgtggatgggatgtggctcatcctgctggtttaagacctctgcattcactgttttaacttcctgtttgactaggctatgaatagaaatactgaggcagaagagaaatgtgtggaatgggaaataatttgggaattaagggtatttatgtctgatctgaaattaaataagaaggtagtctcccattattttttaacaattcctgaaccctgtctcctctgtaagcacattgggccaagaattgaatgtctgttctaaacagcaaggacctcacttgtaagcccaaagcagggtgcaggtcccggctgaaggctggcagtcatagacaggagctgcctgtcagcaggaccaggggtgtgggctgggtagaagcgttgggagactcctggggtctggctctctggtcacttggcccacatccttctcatagtttgttcttctcccatttggcatttgtctctcggcttctccataatggcactcttaggacctgacactaaaggacactcaggccgttagagtaggggaggaaggagaaggaggagagcccacaggggaggaaggagaaggaggagagcccacaggggaggaaggagaaggaggagagcccacagcaccttatctgacacggggattattgtcagaatagtagctactgatgctgcttaattacttcttcactctcatctttttctcccacaccccaactcggtctttttaatgtccccctcgttgcccttctctcccctttattgttagtgttaaacagctgcttttcaaagttctgtcgtccctttcgtcctccccaagcctctagaattaaagggtattctgcttatttgtaaatgtataagactagatttatcagtgtctaggcctctagaagtcttttctactgtgtaccacttaacattcttacagtctgcatttatctgaagtgatgtggactgacagccctttaaaaaaattatctatattttcacgcctgtaatcccagcagtttgggaggccgaggcaggcggatcacaaggtcaggagatcaaggccatcctggctaacacggtgaaaccccatctctactaaaaatagaaaaaaaattagccgggtgtggtggcaggcgcctgtagtcccagctactcgggaagctgaggcaggagaatggcctgaacccaggaggcggagcttgcagggagccaagattgcgccactgcactccagcctggccaacaaagcgaggctccgtctcaaaaaaaaaattatctatatttgaggtatacagcgtgatgttgtaatatacatgtatatactgaaatcattactacagccaagcgcttaacatatccctcacctcacatgattacctaagtgtgtgtgtgtgcgcgtgtatatgtgcaagtgcgtgcctgtgggtgtgtgtgtggtaagagcacctaaaatctccctcagcaggtttcccaaatataatgcaatatcattaactgtagtcctcatgctgtacatgagatctctagacttatcctacatgactgcaactttgtacctttgacctgcatctccctagttccccgtctccctgcccctggtaaccacctttctactttctgcttctataagttttttagatttttttaaagacctgttaaaagttccacatgtaaataagatccatgtggtatttttctttgtgtgtgatgttgagtgcattttcatatacctcttggccattttttggtcttctttggaaaaatgtcaatttgggtcctttgtccattttttaattgagctttttttatttgctattgaattgtgcgagttcattatatgttttgaatattaacaggttatcagatacatggctcgcaaatattttctcccagcctattgcgggatctggccagcagcccgcaatgcaacggggttctctttgtgttcccaggcggatcggcccgttgagaaataatagacacacacaagatagcgaaagctgggtccgggggggtcactgccttctggtcctgcagtgccaacaatgcactggatataccagcatttattattaagtttagtgagggcgggggtaggttagtgagggatttagggtcatttgattatgaggtgagatggtcacatggggatgaagtaattctttaacataacatctgtatgcagaagtacagtatacagagataagaatttacaatatagtgtatgcatcagtaatttctgacagagccttaaaacagaaacacagtctttccataacctatgattagcaagatattaatcagcagtaacagttgcagcaaaagctggttacaaacaatccgtagaaacaggacgtgaagctagacaacctgttagaccagaaattctcagaagggagtatgccttaaccctaaagaggcccagaagagccctggcaagatgagggcgtttatagccctatcttatccatatggacggtgcccccatgtgtctgtttataggctctttacaagggtcactttccattcccagagctatgaatatctgcttttctgggataggaatcttggtgatgtgaaacctccctgactgcacatccattcataggctctctgcagggggaagcacatcacatgctgttggctcattctggcagtcccacctggcactgtctttacacaatcctgcatgcaattttgtatttacaataatcaggagcatttcatcttttattccatagcaatagtttcagggggtctccctacaccagcccataggctaccttttcattttgattgtttcctttgctgttcagaagctttttagttccatgtagtcccgcctgttatttttgactttgttccctgtgcttttggtgtaatactcaaaaaaacatttgccaaggccagcgccaaggagcttttcccctgtgtttccttctaggagttgtgtggtttcaggtcttccatttaggtctgtaatctattttaagttgatttttgtgtgtggtgtaagacaaggtccagttttattcttttgcatgtagatacctggttttcccagcacgacttactaaagagactgccctttctccactgtgtcatctcggtgcccgtgtcaaaaatttaaaagtaatctgatagccctctttaagttgcttctgatttgtcttttgcactaaaagaatctgtaattcaaggcttaaaattgactacacagcctttactcttaacatccatattatactcctatactatacccttttctccatcaaaaaaaaattgatttgcccagtaggtagttactgtcagaaaattaagtaatttcatttttattttggtcttttttttttttttaactgatgatcttccattttcacctctagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaagtaagtttaaaggggagccagggaaccagggccgtggtagaagtatacattaatacaaagtatataccctaccaagaggcagctggccttttccctttccagtgatctcctaagttttggatatgattcagttatttttatttggatcttaactgagaagcttacttaaaaaaaaaaaaggatttttgatttacaaggttaataagtgaaatatttattttatttaatgatttcccaaactgttttcattacttctagctttatcaatttatgacatattaaggtttcattgctaatgtcacaggaaagctaaaaagaataataataacaactctcttttaaatgttttactgttttgttaatcacttgccatgtgccaggcattgtgcagagaggtttgtatcattcgcatgtagccctcatatccctttgtggtacataaaacccctgttttactgcaggcaaactgatgcccagagagacgcatcgagtgttccagtcaggaagccaggccctcaggcgccaaagcacgtgtttcagctcctgtgcctaaaaacgtggtccggagctttgtgttagcttaggtttctcttagatttaaaacaaaaaaaaaagtgttgtgttttatttttttgttttgagacaggcgtctcgctctgtcacccaggctgaagtgcagtggtgcgatcttggttcactgcaaccccaacgtcccgggttcaagcaattctcgtgcctcagccacctgagtagctgggattacaaacatgtgccaccgcgcccagctaatttttgtatttttagtagagacgaggttttaccacgttggccaggctggtctcaagctcctggtctcaagtgatccgcccgcctctacctcccaaagtgctgggattacaggcttgagccaccacacctagccaaaaaaaaaaagtttttaacagtacttgtagataccctacttaacaggaaagcatgtgggcaccagtgaccactgtaggattctttggagagacctaaataaggctgtagtctatgccagtgtagcttgaaggagatatattagtaatttatgacttccatcagaattttcaagtactccttccagcagttatgtttagtttattttttgaaattactaatactttttcccaatattccaattccatgattcaaggcagatatcaaagaatgttaatctgtgtctggaaaaattaaaaacataacatttgacatatatttagacatcaagatctaggtctagatctagtttaataagtcctacaagttctccaaagtatatttaaatagcttcagtgattaaatgagttctcttttgactgcacacttttgctgcctcttacccagtttcttccattatatattttcctgctcaattgcatgcataataaagtgaataattctctgtcttgttagtcaactgtgtcttgtttcagagtcaaatttgaagttttcagtcatggtcagtagtgatgtgcatcattgtcagctgttctttaaatgtgaatataaagtatattgaaaattcatataaattagccccattttgaaaacgaaggaagcagagactgagaaaaatgagtggccacgttttcatggctgatgagtgaggttccagctcatgcctgggggtctctgactctggtttttggtgctctcctctgctccacacttgctctctgatttgcttataaccttaaggcaagtttcgtgacctgttggaacctcagtttcttcatctcgaaagcaaggaggttggctttaagaattctttctgctctaaaatatcattccaggctgaaaccacattaaagcagtcctaacttgaacctgtgcctctgaggcatctctgtctctctgtagtgctgtgaacgatttaacaccctgtgtatttgtatttaactaaactgtataaatgagtcacttaaacttaaaacaattataaaaaatgtttttaagtattaacactttttcagcaattaatccattttatatgacagctgtattctagtcatggaacataaatcttatactagaaaaagagatctgaaattaaatatacttgagcactataagaattcaccttgggccaggtgcagtgcctcatgtctgtaatcctagcactttgggaggccgaggcaggcagatcacgaggtcaggaattcgagaccagcctggccaacatggtgaaacctcaatctgtaccaaaaatataaaaaagtagctgggcgtggtggcacgcctgtaatcctagctacttggaaggctcaggcaggagaatcgcttgaacccgggagacggaggttgcagtgagccgagatggcaccactgcactccagcttgggcgacacagagactctgtctccaaaaaaaaaataaaaggcatcttgatgatgctgaaataattaatacattgctgtcctcaaatttttctgtggtccataacagtgcccaaaaattgaaatgcttacaagctggtcaaggagttgtcatgatatataatccccacagaagcgcacctgtagtcccagctacttgggagactgaggcaggataatcgcttgaaccaggaggtggaggttacagtgagccgagatcgcgccactgtactccagcctggcgacagagtgagactctgtctcaaaaaaataaataaaatagagtaattaataaataaaagtgttgcaggttagcctaattcattaagcattcagtatgctcccaaaactcctccaggtcctgaaaacacaaatgcttcctctaagtccctctggctgctgtaataggtaaatggatagcggcagtcaggtgtgatgaatagaatcacaaaatatgctcaaaatgcctaggaagactctacctgcggctgcagggagtacttccaaagagaggatgacttagttgccaatgactgaaatgtactgagtacatactaggttctttacataaatctttaattcccttatcaccttagaaggtaggtcattctggtctcattcttccacaaggagatttcagcccctaaggctacctaagtgttggagtcagaattcaaaccccatgccatccagctgcaggacacatctggtctcttgtgtaagctgcgttttaaaggaatgtctagagaaaggagactcaagggaagtcagctgagaatgcaggaaaagaagacacgggcccctgagagcatcacactggcctttggcttggcacatgaatgaaagtagaagcaatgcgactggaacttcgtagaaataagattccttttcccattgtagatattttgcttccttttcttctgtttactaaaagaaaaattctaaaacccaaattaatcttgtctttttcagtagccctttggatggctatgttctagctgtcctctaatttcagaaatgtcctttggatatagatgtgatttctggaagtagtcaagtttatttaagtttttgagtcttaagtgacctcccccccaccccctccccatagccaaatttattgattacactttgggtctctactaaagagacttgttttccgctgtcatgaactgcttctgaaggcaattccaaaagaaacaagcacatatgctgatgagcaggacagcccctttgggacagttgtggcctctggagagagcctgttgaaaggcaactttaatttggatgtagaaatgccagcatgtggctattgccccctgtggccaactcagattggcgtgctcactactcactgccccagggaactaggggggcgttttttcaggtctgcccttcactctggggtgaccgaatgtttcagacacagtcaagcaaatagagtgcccgtaaacatcacaccttctggagtcaaactgttctgtttaccagatcaagcttaattaaatgcctaattggccattgaacaatctgattacattaggtttcatttaccacagtttccagttctagtgcacccgaaagacaggacaaggttaaaactggtaagtaaatgtagacgagagttgtaaaattcttacaaggaaagtcttaagactgatgaacatttatattcatgattagatttcctggatttgcgaaacctggcacggaacagtatttgttggccaaacaactagcaaaacccaaagagaaaattcccatcattgtaagtttgtttatttttgtttgctttctttctgattaagctctttcttataccgtactttaaagctaagcgagttattcatcttttggaaagtatttttaaatatatttaatgccccacataactgataatatatgttagtgttgtaggagtactgaagataattaacacaaattaatgcctgtcattatattgtttattctttatctttcagacttttagtattgaacaaatatactattttgatcatttttttctaaagtgtcttgaagtgtattttacatagtttttctgccagccctatatgtttaactgatgaactcaattcaaatatttatgtttcttcccttgtaaagtacatgtatgttatcagaataaggtaccctttcagatatatgggtaatagtgtttttggtaatagtgttttttccagtaaaccagctgtcaaattgagataaggagctaccaaatggaagctgggagttaaagacatcattgagaatatctgtcttagaattacttggttattgcataatgtgacacaagcccttcggtttcattccacattttgattggtggtagattttctgtctaggtgatatttagttgtagattcccaaatgaaattctggaaaagagaactgtagctatcttctgatcctattgacttaaccctgtaacaattagattgggaacctgaagccttgagtgttctcatcctggactcaatcgaggatgaggaaacatctggtcttattctgtagtctttggaaacttgataaaattgcaggaatagtattagattctctaattacttgtgcctgcatgtttgaaaaactccaaatcctggaagcctccaagctgaagagctgtaaccaagagccctttttatgctttttccctcaaagcaaatttgggataattaacttctgagtagttatattaaagatttttttttcctgttttctctggacttaataaaaattgaacatgtaccattattcttttcatgacatttaaaactcctcaaaatcaagagcgcacagctctgcctcagttttgtttttttgtttgtttgtttgtttttaagacagagtctcactctgtcacccaggctggagtgcagtggtgtgatcttggctcactgcaacctctgcctcccgggttcaagcaattctcctgcctcagcctcccgagtagctgggattacaggcatgcaccaccacgcctagctaattttttttgtattttatagtagagacggggtttcaccatattggccaggctggtcttgaactcctgaccttgtgatccgcccacattggcctcccaaagtgctgggattacaggtatgagccactgcgcccggcctgcctcacattcttaaaggggactttgtcccaggtttgcagtggtggtacagagctaagggttccagcctttcattgaccggcaagttttaagtagaactgcacccatgcacccagtaggcaggtctgcctgtgtgggcgtctatacatggaagaagctgaggaaagccaccgcgtcttcaggaggcccagagaaagcagagactaactctttgctctaaaagtgcagtaaccttgcccactcatgaaacagagccccgtgaaattgggccttagccaagcacagttgctgctctcggcccactcactgagggaggtcccgaaagtcatctcctctgcagctttcagctagtttcttggatctgggctctccctgagggggttatagtaattgttctcagagattttagtctctttttaaactactcttatccttggagtaggtcaccttcctgacctaacagcctctgaactttaatatcccaatccgcttttcccatcttcctcttaaaaaaaaaaattaggactgggtatacctttttttcctttttatgtctgtctggccttgcctctctgaggtctcagccgaaacaaatctctcttccttcagcgcaatctgtgtgatttttctcattttctttttactttcttatggtactttttcaagtctgcaagaataaaacctgttccataaattatttcattctccttgaatctctgaatgaatctctgagtgaatctgcttcctgaatagtggtccttttacagtccatgtgtttgttttttcattctcttcttggattataactcaattatttttcattttcaagccaagaagatagataacattctcagtataataaggacttctattgctctgaaatgtgttttgataagagctactgtcctgcagtctgaacctctagaatctgtcattgtgatcaaagtttatgaaatgaatgaggcagaaccaacttgagactattggtgactcaggtagtgattccagaagcctgtacatgagctccagcatccaggttcctctgcagctgcccccatggccttggatgctgttttaaataagatgaaaaaaccaggtttgggacagcagacctattgtcacctagcagtgcctagaagaaatgatcctcaggctcaaaacttacacgaggtctctacacccccacatagaatttagctggtttcccttcctcacctcccaccacaactaaaaccccagtgagctagtgtaagcctcgcctgaatttgtgaacttttgccctagtcacagatagaagagaaggccagtgagaaaagaatggaggcctaccctcttcaggcaagccttgcccaggtggacgtgatacccgggggttggaagtgagccagcccactgtgcttaggcacatagcagtccacggaagaaaacagctagcctggttcttgcttttaagatgtagtacctccccctccccccaccttgccactagtagtaaaacaatgactatcaggctctggccaatctgattaatcgtttctatgagccagaacaatgctactcaaagtatggtccacagaccacttgcccatctgaaaactgcttgttcctgatccaccgtgagataggtacagtacatgagaatattttgaaaacttgaggacaatttggtattgttgaaaaatcaaaatgtgtaatgttatatttcaccaaactattagtctgtgatagattcgaaatttttaaaaactagtccttcatcacgtgtagcttgagacagctagactagaaagaaacattgtcttgtaaccagcactgtccttgggagagggaagctggtgtctcctctccatgggctgagctactcacgtgggagcagaagggtttcccacaggtgtgttctttaaacataatatctaacaggaacagaaaccattgaaccatttatgtacctttcaaagaggaacaagaatgaccctccaaaggacttctcattctgaaaagaattacttgctgattcacatcaattgtatttattatttttccatgtaacaaaattacttctttctggaacattggcataggttggagattatggcccaatgtgggtttatcctacctctacttttgactgtgtggtagcagatcccaggaaaggctccaaaatgtatggtctaaagagctacatcgaatatcagctaacacctactgtaagtatccacgttatcaaaagcagaatcatgtttggatcactgattgcagcttgcttttttcttcattttctagagttggcattggtaaccttttctctttcccttattttgtagaacactaatcgatctgtaaaccacaggtataagcactttgactggttatatgagcgtctcctggttaagtttgggtcagccattccaatcccttctcttccagacaaacaagtcacaggtgagtgtgtgtaatgctaaacccaggatgacaaatagaaagactccagtcagattatcttcctgtaagtcagtgatggcattttccatcctgtagagcagcaggatgcaggagttggaaacagtaattaaatacagctatgaagagagaaccattgcatgttgtacatctatctggaagttgcctaaacgtctcacaagaacgtttaatgtgcaaatcacaggttttggtatgtgtctggaattccagcagtcattgtcttcattgctgtaccttttctacaaaagaaatgtgtacatttaaaatatgtgaaaaatgacacctgaaaaaatagaaataattcaaatagcctaaaatggaaataaaaatgtatgacccacatgatgcaaacaggttatgcagatgagctgcattatttcattagatgagtgagcactggacagagaagccacagaactactaagtgttaatgaaggaagaagctgccaggttttctacttattttgattattaccctctcccttttcttgttttttaaaagtgccattttctatttattttgattattaccctctcccttctcttgttttttaagtgccacattccctcccctcccccagccccaagaatcttttggtaagtaacccatagtgttactagagcaccttgtaagtatgcagggcaccttgtaagtatgcaggtagaaagggtttgtttttgtgtcagggaattgtttttgtttttaatctccagcctagggtagactctgctactctatgtagtcactgagggactcagcatgtgtgtgttaaaataaaggttgtgtgccaggtgcagtggcatcccagcactttgggaggccgaggcgggcggatcacgaggtcaggagatcgagaccatccaggctaacacggtgtaaccctgtctctactaaaaaattagcccggtgtggtggtgtgcacctgtagtctcagctcctagggaggctgaggcaggagaatggcatgaacccgggaggcagaggttgcggtgagccgagattgcgccaccgcactccagcccaggcgacagagcgagactctgtctcaaataaataaataaataaataaataaataaatgttgtgaagaaacagacttaaaggttagacagagttttagtatattgctagaaaatgttcacatacatgaactagtgaaaatagaaaggagtggattgtgagaggaggtcttcaaaggtcagagccagagaggcctgtaagagatgtaaaagagacactgagatgctcacctgaacctagggagaagaaacatggagggctgaaggaagggttctttccccaaaggtcagggaagacaagaggcggtggaattctcactgcactcgcaagagtcgagagaaacagttcagggagggcctgcgacccttcacagccaggtggcagtgccagatggaaacatgtcagcactgccgtggagtttgtcccacgtgttcctggacacttcccgagtgcctctcatctgtcctcacagataggcattttcatcttcactttatagatgaggaaacggaaatccacagacattaaacaggttcccctctctattgctgaaaaaggaattcgaatctgatcccatagcttactctgtttctgttaagatgtggactgactaatctttccctagaattagtattcatacaatgagtaaattattctccttaaaacattactttatattttactttgttttatgtttatttttccctgaagtgttttgtggagatggaaacttttgttttaaaagaagttttgattttgatttttttggaacacatttcaaaaatttcaaattgtcatagcaaaattgaaaatggggctgcactactgggtagataaacacatctccccagtcccctgggtgacacttgagtggtccctcgtggtgctggggcggtggagtgacagccagatggccgtgggctgctgctgccttctgcccagaggcactgaccgaacccctgcttctaacccagttcagacactccctgtacctcaacccggttcagacactccctgtacctcctttttgtcatccttattgctttcaatcacagttttctcttaaaaaatacagatttctttccatgaaaacttcagttctgccatataaaattatagtctatttccttgaattttgtgctctcctttatcaacttggttagcacagtgtgtgctccacagtgtttaaatccatggcttaatggcctatttcaggcttgtaagaaattctcatatcttttagattttaatacattgtttattctgaatcagataattcagtgctcttttaaagcttcagagagtcacggttctccttccatactaagatttgtttaaaaaaaaataagttcggcatgcagccagggaggagaaagtcatagaaaagcaagaaagcagcagcccctcggtgtgaagaaagttgagctttgattcactaactgggatatgagccaaggaagccgaacagcacagaagggctctatttccccctcacttgtgtgcctcctgcctgggatgcccacagatcattattatgtaagaattcccctctcgctcaactactggagaaaagaaaaaggaatgcttagtaggtgatgctatgacattcctgtggactcgataattcatgaaaaaatgtacagttaacatttctttatttgtttagagatttttgttttttatggaaataatattgaatgaatatagttttattcctggtaccaaactgacatattcatatacttagtgaaaaccttagtaaggttcatggaaaacagggaaataaaagttcctctttttttctaattatttgcaacttggtctgaaaattctaccaagcataaaataacatctgaagtcataagcttagagataaaccagctatgtcagaaaaattttcacaagaataatttttgaataaaataaggatcactaaatttcaaccaatgataggataatgaactctgggtacaactcacctagccataatggggagttcatcgtatcccaggtccagactggctttccggccaggaggtgaattgtcttttttccaaggcacaaggctttgtttctgcttaatctactgctagtaaatgcaaagtttgcaatgctttagtacaatgatggtgtctagactcattgttctgttcaagtccactttttaggtaataaaagttttttgatatgtaggtgcataatactatctatctatattttatttatttatttatttatttatttttggagacggtctcactctgccacccagcctggagtgcagtggcacaatcatagctcactgcagccttgacctcttggactcaagtgatcctcccacgtagctgggattataggtgcacgccaccattgcctggcttatactcataatttctaaaggaaagttcaggtttcattttttaaattttatttttaaacttaggtacagtaaattcactctttttggtgtacagttctgagttttgacagctaccactgcagtcctgcaaccaccactacatttcatgatacagaacagctccgtcacctccccaggttccctcgtgctgcccatccccctggtcctaaccatggcaacagctgatgtgttctttgtgttcataattctgcgttttctaggatgtcattataaatggaagcatgcagtgtatagtctttcgagtctgactgctttcatttagcataacacatttgcaattcaatcattttgttgtgtcaatagtttgttcttttcgtggccaatagtattccagtgtttagatataccatagcttgtttatccattcactcattgaaagacatttgggtttccagcttttggcaattatgaataaagctgccgtaaacatttgcatacaggtttttgtatgaatgtaagttttcattcctcttgggtaaataagagtaaaatgactgggtcatttggcaagtatatatttaatgtttaagaaattgcccaactgtttttcaaagaagctataccattttggaatcctcaccagcaatatatgagagtatcagtagtagttccacatccctacctgcacttgatagtgtcagtttttcctcattttaaccagtccgataggtatgcagtggtatctcagcatggttttgatttgcatttcctgatggcgagtggggttgagcatctcttcatgtgcttatttcccatctgtagatctttggtgctgaagcttctgttcagctcttgtgctcattttttatcagtctgttttcttattgttgaatcctgagatttttaaaatatatatatgtattttctagaaacaagttctttgttagataagtgatttgcaaataacttgtcgcagctgtggcttggcttgtcattttctttttctttttttttttttttttttttttggagacagggtctcactgtcgtcgcccaggctggagtgcagtggcaccatctcagctcactacaaccttgacctcccgggctcaagcagtcttccagcctcagcctcctgagtagctgggactacaggctctcatcaacacttcttgttaattttttgtatttttggtagagacaggatttcaccctgttgcctaggctggtctcgaagtcctgagctcaagcggtccacccacttcggcctcccaaagtgttgggattagaggcatgagctaccacactagccttgttactttcttaacagtgtcttttgcataacaaaggcttttaattttaatgaagttcactatatcagttttttctttcatggactgtgcttgaggtgtcatggctaagagcagttcacaacattttcttctaaaggttttaggcttttcgtttagatctttgatgcattttgaggttatttttgtataaggtgtgcagtgtggtagaagtagtgcatttttttttcacatcgggatatccagtgggtctcacaccatcttttggaaagacagatctgttttccatttattagaaacatgtttgtaagagaaaaaaaatcagttgattgtatttgttggtttatttctggattctattctgctccattgatttatgtgtccatccttttcgctagtcctacactgtcttgacttgtgtagctttatggtaagtctttaaatcaagtagcgtgaatcctccaacttggttcctttacaaaattgttttggctattctttttcttttgcctttcctagtaaatttaaatgtcagtttgtagatatttataatcatgctggaatttttattgaaaccgcattgattctgtagatcaattttcacatcttgatatctcatcttttaatccatatataaaaatatatcgtatttgattttcattagggttttgtagtcttcaacatacagattctgcatatattttgttagatttatgtgtaagaatttcaggccaggcgcggtggctcatgcctgtaatctcagcactttggtaggccaaggtgggtggatcacctgaggtcaggagtttgaaaccaacctggccaacatggcaaaaccccatctctactaaaaaaaaaaaaaaaaaatatatatatatatatacacacacacacacaaaaattagccaggcgtggtggcacacacctgtagtcccagctactcaggaggctgagtcaggagagtcacttgaatccaggaggcggaggttgccgtgagccaagattgcaccactgcactccagtctgggcgacagagttagactctgtcaaaaaaaaaaaaaagatttatatgtaagaatttcattggagagttgtattgtaaatggtactgttttttaaatttccattttctagttatgtattgcatatagagatcgcttgatttttgtatatccaccttttatctgtggccttgctaaactcactcaatagttccaggagcttttttgtgggtatggattctttggtttttttgtcttttcttttttttttttgtttgagacggagtctcgctctgtcgcccaggctggagtgcagtggcgctatctcggcttactgcaagctccacctcctgggttcacaccattttcgtgcctcagcctcccgagtagctgggactacaggcacccgccaccacgccctgctaattttttatatttttagtagagatggggtttcactgtgttagccaggatggtctcgatctcctgacctcatgattcacccgcctcggcctcccaaagtgctgggattacaggcgtgagccaccgtgcccggccctcttttcttttttaatgtagacaatcatgtcagcttggaatagagagttttatttcatcttttccaatccatgggccttctacttctgtttctgccttattgcacttgctaggacttcctgtatgctcttgagtagaaatagtgagagcaatcatctttggcttattcctgatcttagggacaaagcattcagtctttcaccattaactatgatgttagctgtaggttttttgttagatgtgcttttatcaagttaaggaatttctcttctatttctaggttgttgaaagtttttgttcatgaatagatgctggattttgtcccatgtattttgtgtactcatcgagtgattgtatggcttttcttctgctattaatacagcaaatcacactgatcagctttccattgctgaaccagccttacatgcctggaataaacctcactcgatggtgatagattattcttatatattgctggattaaatttgctaataatatctggttgaggatttggttcacgatggttattggtctatagttttcttgtaatttgtttggttttagtatcagggcaatgctagtctcataggatgagtttggaactattccctccttgtttatattctggaagagattatatagaattgatactgttctataagtgtttgatagaactcaccactgaaatcatctggacctggagtgttctttgtggggaggctttaactatgaatttaatttccttcatagctataggactattcaggctgagctttggtagcttgggtctttaagggagtcgatttatttcatagaagttgttaggtatagttttagagttgctcatagtatttctttgtacctttaaagatgttaggtctactccttcatttctgattttgatcattgtcacctctctttttttctttggttttatgtatttttatttttctcttttctattatattgtttctgctcttttatcatttctatcgcttggtttgggtttgatttattctttttctagtttcttaaatatagaaacttagattattgttttgagatatttccgctatcacaggcattaaatgctaaaaactttcctctaagcatgcttttgctgcattctataaagtctaccttattgagttttcatgttcattcaggtcaaaacattttctaatttttctcataagttcttatttgatccatgggttatttagaaatatacctatatctcagtatctatgggaattggttccagaacctcccacagataccaaaatccattgatgctcaagtccctgatataaaatggtatagtatttgcatataacctatgcacattctcccgtatattttaaatcatctctagattaattataatacctaatacaatgtaaatgctatgtaaatcattgttatactgtattgttttgagaataataacaaggaaaaaagtccatacatattcattacagaaaaaaattttttccctcaaatatttgcaatctaaggttggttgaatccatgggtgcagagaccgtggatacagagaaccaactctatgtttaatttccaactatctggccatttcctgaatttttttcttttgacctccagttttattatgttcagagaacatactttgcatgatttttagtcctcttacatttattgagacttattttatggcctagcatatggtctgtcatagggaatattccatgtgtgcttcaaaagaatatgtgtctgtagcagctgggtggagtgtttcattcatgtcagttaggctgggttgatagtgttattcaggtttctatatccttgccaattttctttctagttctatcaattattgagtatcgggtattgaaatttaacattatgattagtggactatctctccttttaattctgtcactttgttttatgtattttgagtctctcttgttaggtagacatacagtttgtaattttaatatcttcctgatgtagtgacctcttatatcatgaggtgtcccccattgtctctagtaagatttcctgtgttaaagtgtacttgtctaatattaatatagccactccatttctgttatggttactgtttgtatggtatatcttttcccatccgtttactttcagtatatgtgtgcctttgaaatcaagctgtttctcttataggcaagatagttggatcttacttttttatcaagtctgacaatctctgcttttgattggggtttttaggccatttgtatttaatataattattgacatggttagattcacatttgccattttgttatttgttttctgtgtttgcttctttttcctcctttactgccttttctttgtgttaaatattttacggtgtattgttttaattcctctcattgtttaagctaaatttttgaagttattttcatagtggttgccctaagggatataatatgcatcttttttaacatcacagtgcactttagattaatattaattccagtaaaataaagaaatttttctcctatatagctttattcccttccctcatttatgccattatttttatatatattacatctgtatgttatgaatccaacaatacattgtggtaattactgctttctacagtcttttgtcttttaaagacactaaggaaacaaattagaaaaaaatatatctatagaatcttttacattaatccttatatttccggtgctgcttatttgtctctgcagattcaagtcaccatctttagtaatttctttttagcctgaaggacttcctttaatacttcttataatgcaggtctgttatcagtgaattatctcattatttatctgggtatgtctttatttttagaggatagtcgtaccgatctggctccattgtgtcagaaagcaagtcagctgttaatgctgtttatctcacgtgcccactctactatgcatgatcagtcattcagatattttttgtctcactctctcttcttcctctgggattctcattacaagtgtttggtgtgcttgatgtattctaatattttacgtttaagttttttttctctgtgttcttcatgttagttaacttctgttgatctatcttcaaattcactaggtgttttttttcttctgctaccttaaatcttatgttgagccttatctgcagtgaattttttatttcaattactatactttcaactccagaatttccatgtgattcttttttggtaacttctctctcctttttgaaactctgtgtgttgattctctgtcatatttttctttaattttttaggcttcctttagttctttgaaaatccttatagaatctgctttatctgccacattgtttttttctgccaaattcaacatctgcggacactcagagatagtgtctattgactgtttgtttttttctcagtatggttcatatcttgctatttctttgcgtatctcttaattttttgttgaaaactggacatttttgagaatatattttagcaactccagattctgagtttacctctctgaaggttgttgtttctgctttttatttgttaagtaacttgcctaagattaaatctctgaagtctgtctccctggaagttcagttattgctgtttgtttgtttgtttgtttgtttgttttatatttgtcttcctagagtttgctcctgtgtctgtggattggtagtaagcctttgattgactgacagaggttgtacccaaccacctcaggccagtaagttggggctcctgtcctctgtcaatgtaactgtaactcgatgtaactcattcaaagctcaggtcatttttaagttgccctggcttttactttctaccagacccttttgtgtctcctttacttgtatgtacagcctcagagttgaccaggattgtgtgcctggcttggaccctctctggtctccaatgtgtatgcatacagcctcagcctggaatatgcatggttcaaccttggctatcagggctgttgtcccttcctgttcatctgtctctgagattgtcactgccactgacaccaccattgaacatggcatctcccatcactccaagcgagccttctaccctcacggagaagctgcagctgcccatcttcacagcctgtccaccctagtggtaccaccatgtcgaacacgtggggtgggtggcacacaggcagcagatgcgggggagacaggagcagcctcccaccaccacagatttccaccatcgtcgcctgaagttcagttcttcaagcataaacacttctcaggtggccattcgccttttgttgatttctagagcactcatttggttgtttttattactgttgtctagctttatagttgcttttgaggggtagggttagctgatctctccaggccatagctggaacttctaccactagaaggctttcaactaatagtagtttttgtttgtaggtttataaacattcttagtgttcacttgatgtttgttatgctattcttgtcaagctgactttctacttttaaaacagaaaggaccactcattaaactgttttagtagagtcacaagttccagaatagcaacttccattattgcattagtggaaaaattcctttggtatttcagtttaagtaatttaaaatacctggaggaaaaaagctatagccttgggttactcttcataatgctaaatttaaacttgtatagatgtaatttatattgcatttggacacattttgataatatggaaataccatgtcgtttgtaagaatgacattaaattccactcatcactcctttcttgcttataggacttcatgtggccacacagaaactggcctgttagcttataggaaagagacaggttttcatgttgagataagatttaatttttttttagtactttaaggatacttgaagaaagtagcaccttgaggttgtcattattcttgtcacaatatgtgaatatgttaaattggaattatgttcttaaaaactgaagtctgttgcatcttacctgtgggcctttgagcattcgttgtgttgcttgttttttagattagttaaaaatctccatggtttaccttttgctaaatagctttctacccaatagccagtagacatagaaatggtttttcagttacagtatggtaacagtcattcattttagacaaagttgtatgtcattcttggtgtgtcgcttgcaggccgctttgaagaggaatttatcaaaatgcgcatggagagacttcaggcctggatgaccaggatgtgtcgccatccagtaatctcagaaagtgaagttttccagcagttcctaaatttccgagatgagaaggtaggacattgtgttaatatggcatcagagaatattgagagttgtctcattcacaccaaacttatttctgaaaggagttaaaattatgttggttagttatttctcacttcctccagtgacagtgaggggacagaaacctaaatccccaccataggaaatttgtcatgatgtgtgaagaactgcctgccagaagggcttccccctacactgggagtgggttggctcaagatgggcaggggcagggtgagggatgtaatagggtcagcagtttttccctagatgtttttaaaaataggaggataggccccaaactctgaaggtattatcagcatgaagtgaggggagtggagtgactgattttcccgatcacgttgcccttacaatgtaacagcatgatggcaggaaagggagaggcagacatgagccgctcttctcagagccaggccattttcatcactgtaatggtgagtccagagtcagtgctggcctctctctctgcctgcccctgtggcctgtagtctgccagtggtcatctgttcttcattaaaatcaaggaaacgttggctgcctgacatctcaaaagtgtctgctttggaaatagttttctctctcagtaagcatttactgtactccttattgtatcattttattctctaaagatgtttcctccacaatttctctcaacaaatactgcatctctcagcaccctaaagaataaaagcaggagttggcccagaagccacagcagatgctaaatacattatcagcctgggaaataaattatgaagctatttttgtctttaatgaaataatagaatatcatataccctcttggaacttcgagaggtttacttgctaaacttctttgtagtaattttcacttgttgaagtgaacacatagtaagtcttaaatattagggctctatcggtgtatgtttacaggtgtatgcatacacttaacatacatatttgggccttattttcagttattgactatttctagaattgaccagctcatgtgatatgttatatgtcaccagattgggaattagacaacatggagatgcttcaccatgtctttgtgaatttgtgtatatcacaggtctcctcaccatgtcttatgaatttgtatatgtttatggtgagatagggtactcagtcacactgtgtgtcatgtagctatatagtagtgaaactaagttctttgaattcagtaaatatttgggttactttgtagttacagaaactacagggaaccacctccaagtttgttgccttcctggttcccacaagactttaacaagagcttatttgatagattttccaaggatttgatttagaaagcatttctgaaggtcatgttttctgcatggtggagttaataaatcctagacatcagttgtgttggtttttttaaatgccaccttcaaagagggatcaacgtgtcataaaagtggtataagagaaaaaagaaagaacttggagtcagggcccttgagttctggtcttagtgccacttctagctgcctctgtggtcttagtgaaggtatttaatccctttgggccagaatttcctcacttgctaaatgacactgtagaactacatagaaactatgattctgtggtaagtagcagctcgtgtaaataaatggtagacacagaaacccccaaagaatctgcagagacattattagaaataagtggttagtaaggtagctggatacaagacattgcatatttatcagcaaaaacagaaattgaaaatctaaaaaaaaaataacctgtcatttacagtaacatcaaaagtatcaaatatccaggaataaatacaagaaaatgtacaaaagatctacatagaaaactatgaaacattattgagaaaaataatagaagacctaaataaattttctaatactgcgtctcatggactggaaacaataaagatgtcatatgtagaaaatcaaaatgccaagcatagccaggatgctcttggaaaataatgaaataggaggaggactttattgcgtatcagaactcattgtgaagctaaaaaagtttaaaagcatggcattggcataaggctagacaaaccaaccagtagagcagagtagacacttgatctatgacaaagatggcactgggcgtagtaggcaaaggatagtcttttcagtaattggtgctgggtcagttggatggcaaaatgcagggaaatgaaatgtgctcgctacctcactacaatctgcagttgattttattaaggttgttattgatattgttatgtttttaaaacatgtcccaggctgggtgtggcggatcacttgaggtcaagagttcgagaccagccaggccaatatggcgaaaccctgtctctactaaaaatacaaaaattcgccaggtgtggtggcacacacctgtaatcccagctacttgggaggctgaagcaggagaatcgttggaacccgggggtaaaggttgcagtgagccaagatcatgccactgcactccagcctgggcaacagagcaaaactctgtctcaaatatatataaatatatatatgtatgtattatatttcaaattagctttaaagtaagaaaaaaaaaatcccagaggtaaaatggaggagaatacctatgaaacaagattggcacctcccggggagcagtggtgcctgggcagcttttcccttggccacatgtgctgaaggtggagctgtgggtctcctgtggagtcacagcagacaggcacttggaaagtttctttcactctgagttttggttgaaaggaaagcacccaaaactatagccaaaggagtcattatacttccagaaaaatctcaaaagtattgcaagcaacagtagtagctattggatcagaccttaaaggtgggggtggaaagatttaaccagttagctcagtgaaagttaaagttttcccagaatatggaggcagcaaagtagttctagacaaaggtcatttcttatttagaggtggtgccattcttggaaagtgtgtaagccgaagtaaatccctactgaaatggcatcacatgccaccacagttccgaaagccttcatcatgtaaatgacttccgtatctcttttactaaactaatgatatttttaaaaagattggcaaaagtgttggtaattatcgaagctgaacctggggggtttattatacttttcttcttttgtatatgtttgaaagttttcattgtatatggtcttcttgaaaatgaattccatgtggctcgcagatttaaatgtgaaaagcaacatagtaatgcttacagaagataacgtggaacatcctcctatcctagagagcagggaagaatttctgaaatatgacatgaaaaagactatgcaggaagatgtggataaattagactacattagaacttcttttttcagccatgacaagcgaaaaacaagctactgagtagaagatacttgcaacatatataagcaatgaagggctagattttagaatataggaaaacatcagtaagcccagtggaaaaataggagatgtgatcatgtacttcataaaataaggtatctgaatcaacaacagatgtgtagaaaagtacctaatctcattagcaatcaataaatacacattaaaaccacaataagatgccactacacacgtgccagaatggctaaaactgaccataccaagtgtcatcttggtgaggtgagatgctgctgggattcataacgtgttgggggaaaatggtaagactaatttggaaaagtttggcatttactgaagttgaaccctctcatatgacctggcatttccactcctggatatgtactgaatagaaatgcaggcacacagacaccaggagacatctacataacagcttcattcataacttgataagggtggctaccagtagtagaatagataaataaattggggattactcataaagtagaatattatacagcaatgaaatgaatgaactgtagttctacacaagattttgactgtagttcctaagcaagattgagcaaaagaagccaggcaccaaagaacgcatttatagggctctttgctagcttgaaaaactagcaggacagggtagcatgcatgcgtaggtggtaaaactctaaacaaagtgtctgagtccatttgtgctgctgtaacaaaatacctgagactggataatttatatacaacagaaatttatttctcacagttacggaggctggaagtcgaagatcaaggcaccagcatttgctgtctggtgagggctgcatcctccaaaggagagaaatgctgagtccccacatggtggaaggtggaagagcaaaaagggacaaaccccctccatcaagcccttttatcaggatgctaatctcattcacaaggggagaagctctcatgacctaatcacttcttaaaggccccacctcttaatattatcacattggctattaagtttcaaaacatgaattttggagggaacacattcaaaccatagcagaaaagcaaagaaatgaaaaccataagagagagattaccggttacctttgtggggaagggaagaggtagcagtgtttggggaaaggacaatgcgggggcttttggaatgggagctctttgctccttcctggcctagttggtcgttaggcaagtattcactttgtgacaattcattgcactggatatttttgatttgggtactctgtgtgtgtatatcttaatatttttaaaaaaatagctcataatactggtttctgtcttatattttagaaaagcatttacctttttagaaaacagataacctaaatatttgaggcactaggtcagaatgcatagggtgggccgagcacagtggcttatgcctggaatcccagaacttttggaggctgaggtgggcagattgcttgagcacaggagttcaagaccagcctggctaacacagtgaaaccccatctctacaaaaaatacaaaaattagccaggcatggtggcatgcgcctaaagtcccagctacttgggggctgaggtgggaagattgcttgaacctggaagctcaaggatacagtgagctgagatcatgccactgtactccagcctagaaggcaaagtgagactctgtctcaaaaaaaaaaaaaaaaaaaaaaaagtatagggtgtttctgtttgctgtttttatataggtagccattggaaagagaacatggctgaattggttcattctttaaagatttggtcccattaggaccattctgtggaatgacactgttcatgccctgagattacattcggagtataaaggtatttagtccatggtgcagagggagatagagtgggagctgcttcctgaaaattagaaagataaaggtgataaatgagctggtcctgtttgggaattttgaagaccagtttgactgtgctctccacttgaaccttacaacattctcatttacaggaatggaaaactggaaagaggaaggccgagagagatgagctggcgggagtcatgatattttccaccatggaaccagaggcacctgacttggacttagtagaaatgtgagagacgctgccaggttttctttcttctcaatccgcaccctcctcctttggccatcaggcttcagccagtgtagccgcagccgaaactcaaatcagactagacttttatgaaatgagtgggatttgtagtccaatgacaagggaaacatcatttgtacatagaagtactgtctttctaaccgcaacatcaaattacaatctttctttcaccttgaagccagtgatttcatagttgacacggtgctgagtagctgtttccaatagtgtgatgaaaccaagcggcatggagccacctaaaacccactcaatattcagacagcaaatctctttgaacattgccttgaggaagcagtctctaacctgctttttctgtatgcttttttaatctgttgattgattttaatcatgtagttttttaaatgcagggtcagttgaaactttggagtagttccttttctcttacggacttaaaagaaatttgcgtggtttttaattttaagcttttttttttttttttttttttttttgagacggagtcttgctctgtcacccaggctggagtgcagtggcacgatctccgctcactgcaagctccgcctcccaggttcacgccattctcctgcctcagcctctcgagtagctgggactacataattttaagctttgttatcataaaattattgcgtatgtgttaccaaaagtatagacaagtaacacacacacacacacacacacataacccttcaaccacgcagagagaaaatcagtgttaatatgttagtgtttagtctcccaaatcctcctctgtacgtatgtaattataggaaagattgtttaaacaaaaatgacctcacactagacattttgttttataatctgcttttttcatctaacagtatattgtgatcttttcaggttggtaaatacacttttgacatccttagaaagaactggtatctttaggatcacttaggtgattgtgtatccaggttattgtctccgtttcatggagtacttggaatgaatggccagctagcattagcaacccctgttattcttttatagatttgatggtccccccagtgattggaattttcctaaataagatattcaagaaattattattttatttactttagaataattttaaaattcacaaagaattgtataggcagaaaggaagcgaagttaaaatataaatcagcgctttttaagtagttctttaaatgtctgcatcaagcctgtatttaaggctaacttagtgaaaggggagttgttatcatgcaagaaaacaagtgtctgtggttatatttggcccgagtatccccacagcagtgctgtttctcctgcttatgtgactgacggccgccttcacccacagagagcagaagtgcgaggctgtggggaagttcaccaaggccatggatgacggcgtgaaggagctgctgacggtggggcaggagcactggaagcgctgcacgggccgtaagtccactcctcacagtgcactgggctcgtagggggtgatgcaggctcagttttatgtcccttatcatagaggggaacctgctgcctcgaacagaagtgtatttggtggacggcagtaatgtccctcctgtgattctgcttgatctcacttcacctgagttaaaccacagaaaactgaccagcaaagccaggttaagaaatctcatagggaacaccacgttcacttaattagttccagtaatttggggctttataatctttggaaaattaatcatttttgcatgttttcagagtgcttgtagttattcttagtctcatgattttattttttaatcttcatccatttggtaagatgttgtgtatttgactaaaaccatagtgtttagaaaaaccaatatagttagtagtagaaaatatgtcacagcagaagcactgccgaggggagagtgtcgctgtcagtcacggctttctgaccactctgctgtgtccctaagaacttcctgcctccctccttctcctttgtttgtaggctttcattctgctgaaggtttttcctgtatttcctagaactgtgcagctctgtcaccacacatgtggcccaggatagaaaaatagtcccgtatccagctgtagggctaatgccacgggctgctgccctgttacacccacaggctcagaggctgcagagtgacttgtcaggccctgaaatgctgcgactgcactgctgtcccatgcgcagatgcctttaactcccttagagtcctaggacttctctcctttatatctggtctgcccttattgctgtgtcttaacctctagagaacagggccttctaatctatcactaagaattttctggccttcacctcataacaccatacaggaatattggttgtattcagttaaaaaaaatgttttatattttgaattatgagtaacatatacctacttttctatcagcctttgatgctcagcataggaaagggatctgttcttgtaatgatttttttaaaggtgatatttttacactaaaaaaagaaaacaatcagaatttgaaatccaataataattttaaagagaggaaactaaatatggagtgacttgtagatgaattaataagatagcacagcaaagacaatgtcagtattactattcaatccagatctgaaaatccaaagccttacatcaggagtcagtaaaccatggtccgagcaccatatttggcttgccacttattttgtaaataaagttttattggaacacacccatgcccatttatttgtatattgtctttggctacatttgtgtcataatggtagagttgagtagtttcaacagaaacttgtggctccataaagcctaaaacgtttactatctggcactttgcagaggaagtttgccaggccctgccttacctcaaccattggccaataactacctctgcctcttcctctactagcagtaataccagtaccagtggtgctttaccatccacatattatcttataccaacaaaacaacttgtagcataccagctgttcgtgcttgaggggcagacatcaggaataacagttgtttctttcccatggcaaagaaatatgatgctgtatcctaaatatatagaattagccctgagaaaataatgtatacaaatgcagcatctagaaaacaaaacctgtgtcaagactttagtcatagaggatgactcaggaacaaaaagcaaagttgacgttgttctctaaagcagaggcccccaatccccaggccatggactggtacatggaccattaccgcacagcaggaggcaagtgaagcttcatctctatctacaggtgctccccatcactcacattaccgcctgagctccgcctcctgtcagatcagcggtggcattagattctcatagaaatttgcaccctattaagagccacgcatacaagcttgtgagcccttatgagaatctaatgcctgataatctgaggtggaacagtttcatccccaaaccatccccccgacccactgtctatctgtggaaaaattgtcttccatgaaaccagtccctggtgccagaaaggttggggaccgttgctctaaagtataaatgaaagaattcagtttttaaaggcaatgaattaattttgactgtaaactcttgcaagaccatcataacacatcatttaaatctgtatgttctttgaaagccatttttcctgagtgtaaattttacaattgcattttttaaggatatcataaaaatttgggattatgatatctttttaaaaattaaatcccttatgtctaatgtctgatcaactccatgtcctgtgtaattcacaaggctaaatgtagaaagtagggaatactggcctcaggccgctcttttgtggggtggggaaagggattgactcaggcatatctcctcctgtttctcaaagtagttctttaaaattcctaatgtgtagaatgaaaactctagcacacactctgcatggtgaaccacatgccaggtgcctttaggtagagaggcaaaactgaggtaccacaggggtacaatttattaaaattaactgagctcgtgtaatttggattcatgtttcctgataactgcagcttatagaccttacctcaaatgtctctggcctaaatattttttaaagaaacattaaaagttttctttttctcctttaatactgcagtgagtctttaaatgcaaataatggtttcttttgaaaggcaaacagatgctccatttaaggggactccatacagatgcaaagaaagtagcttaaggtgcagagactcttgggaagttctccaaagtgatcctggaatcttagcaccttaaaaagaaaccttaggggtcatttattgaaatcatctcttcatgcagatgagaaaactcagacccctcttccctggtcatgcgaagtctgactgttgtatttttctccataccttgttgctttcagtctttggtggttatggtttgcaaatggtcatttatgcacctgtaacagagtgggaaaggctacgtatttggaatcacaagtccatgtccagcatttattagccatgtgaccttgggcaagtcagttatctgagccttattttcctaatcctcagcatgaggatggtgtctctgcatctggtagaggggctatcatgatgatcaagcgcggtgtcgctagaagtactttgtaagctagaaatcatctaaaggagcttccatttcacttacatctcatttggtgaatgagaatgtaggagtgattgtcagtaataatagcatccaccattagttgaacagtcaattaaaataatcgaaagaaatcaattgaaaaaacaatcacttttgcaacagtattttgtgaaggaatatatagactattttgaatcacttcaaaagttactgtaatcacttttaggaaatagtttaatcccatttcagtttgctcagaagactaatcgtttattcctttttgtctttcagcattacccaaggaatatcagaagataggaaaggccttgcagagtttggccacagtgttcagttccagtggctatcaaggtgcgtctttcttcattcatccagtgggcctttagagccttatgtagacctgtcacctgcttaggatcctgcagacgctaactccctcctcagtgaagcaccctggttgtgggtgtgtaaattggctaggctgccgcactaaggacttttgcaccctcatcctaggacttttgagaaaagccaaaggtggttataatttgtattttcttgctagctcgtttgcctttttttgctctctggtgtagcgcttttgtttcaatgccatcagtttcatttctctgccaagtcttcctgtgacagaggccagatttggctgggcacagtggctcacacctataattccaacactttgggaggctgaggtgggcaaatcacttgagtccaggagtttgagaccagcctgggcaacatggtgagacccccatctctacaaaaaaataaaaaattagccacgtgtggtggtgcatacaggtagttgcaactatttgggaggctgaggtgggaggatcacttaagcccgggaggcagaggttgcactgagccatgatcttaccagtgcactccagcctgggtgacagagcaagaccctgtctcaaaaaaaaaaaaaaaaaaaaaaaaaaaagccagatttcatcaaggccatttcaaggaaaaatgtttgaccaagtaacaagtgtgtgttgcctgttttctccttaactcataactgtttcagcttatcctataaatgtgtatcttacccagggatccctttgtggtttacattggcagcacttatgagagcaagttagctctttttctttattaaaagggaaaggaacccaggcaacataaggagaccccatctctacaaaaaaataataaaataaaaattagccaggcatggtgtcacacacctgtagtctcagctgttctggaggctgaagcagaaggatcgcttgagcccaggaggtcgaggctatagtgtgccatgatcacaccactgcactccaatatgggcaacagagtgagaccccatctcaagaaaaaaagaagaaaaagcatttgtcagctaggtggcacctattaaatctgttatctcctgtcacttatagaagtggtagaattggtacaggtgttgatcctgatactcaaggcagacagtgctttggatgtcggtttctgaatattttaataataaactaataagaagtttctcaccaaaatgtaagatttagggctcccacatggcaatagttctcattgccctggccttaccatgtcttacagttgacacttttagaccagaagcgggctttgaggtctagactgggaactcaaggccagaacagagaagcatcttggcccaggtaacaagtgggtgatggaagagctgagagcaagccacgcccattgcttagggaggaggcagaggtcttggagcccttttagcatggtggctctgtgatgtctcaacagggtgagaagatttgtcctagagatgctggaattttggccatcatgatggcccggctccacaggcatccatgggttccccactgggagctgcttcgtgattctttaacattttctggactgtgattatcaatacataattaaatgttccatattgcaaatagcactttttcaagtattaaaaatactcagtgtatgttttatgttgaatatcattctacttaagataatattttaaggaagcattcaagttcctgttgactggcttttctcccattacaaaggacagtgaaggtcagcagtgtggagtactgtgtccatcacatccacttgctcagatgtgttggcgtcttagagcagtgctatactatgcgatcttgcaataatgtaaatgggtttgattcctggaaatattgtgattatagtaaaaataacttccagtgctcctttacaagttcatgtactaacttgaaataatacagactattagcatggcccctgcacaaaaccatgaaacattgcatattcttatggatgagcatatggaaatataagcaataaaaattcttaaatgattatagggaaggagagagagagatggaaggtaaactgattatatcttgttttgtacagttgactttggaataatgtaaatgctttacataattattagaaaacaaatttaaatcaaaatggaaaaaaaatttctaatcaaaagcaaaataaaacaaatgatacatcaaaatgaaggcatagcacacagaggaattgtttcaaaacaccttaaaatggcattttatatgcccccaggagcgggtgcctcaaggtcagaaagactataagaatgttagttgttttcactaaacatgtagtcaatatcatgttggtattgttattctaaaacttctaaaactatttacatattgtaggataaagcaaatacgtaattatgttactgttgttagcaattaagatttttaaaataaaaagttttaaaataaatgaagaaaacccctaaagtcataaatttgctttggaaacagtgtgaactcattacatgatttccttcttaaaaaaaaatacagtttgcctttctgttaaagctctagaaacagttacccaatccagtagcaagaagcattccctggcaccaatcgtaaggtccacgtcccaccacagtgaaccagggttcctatcaaaagacttagataccaattggaagagcctaccactggccaaagaaaagaaaatgtgagcattagtgaaaataataattaatgtggaatgaagcatatcaaatatttttaaatccagaattataaagatgctttttaagaaattaatctcagttacttttggagaatggtggtggattaactcattattttgaaaactataaagagaaagaattaagcacttaacctgcttttcctgttcaaactctacctctgggtaaccggaatattgataaaggaaagttgatccttatggaagtatttcagctaataaagaaggaatggtagaaatagaatagcaccattttgcaaactcatactaaaataaaagatccagacaatggtcattctaggtaacgatcattttctaacattctaagagtagaaataactgaactggtggtgtgtgactctgatcaggcctctaggtctaatagccagtgtgaagagaacacagggacaggggagtgtgtgacatatcaccagagacacagccagcagcatccagaatgcaggcaccagggcacacgacaaattcaacaccccacgaaaagaaaggtgcagggaaaaaaggggccgagggagaagaatccacagagttaagaaacgcatcagttctgtgccgtatggacctttacatcctgattcaagcagccagctctccctgagaggcctcattatagccgaatgacagtctcgtcataggtgtcataatggtactgcctcatgttttagagtcctcatctattaggcaagatttatgaatgagatgctgatgtccggtgaaagcgggtcggggtgtagacgaacacaggctggcgagagctgccagtggggaaggcagatggtgggtgatgggcattcattctattcccaatagttttgaaaatgtttgaaagtttctataataaaatttaccaataaaatcaataataaaattttaacaagtgaaaagaaaatatgcataacttataaccactgataaaattgatcattttcaggtgaaacagatctcaatgatgcaataacagaagcaggaaagacttatgaagaaattgccagtctcgtggcagaacaggtactaacataatcacacaattccaattaagatttgttgctatctagtccacatatttaatttaaaacctgtcttaggacaaacgtcccaaataagtaccctcttcttttctgtttctgtgtatcttttttaattgtgtttaatcatggtttcttaggttaagacaaagtggatgaatacatttgtcatcaagaaatctaaataggccaggcacagtggctcacacctgtaatctggcactttgggaggccaaggcgggtgaatctcttgagtccaggagttcgagaccagcctgggcaacacagtgaacccccaaaaattagctgggtgtagtggtgtacacctgtagtcccagctactcgggaggctgaggtaggaagattgcttgagcccgggaagtcaaggctgcagtgagccatgatcataccactgcactccagcctgggtgacagagcgagaccctatctcagaagaaaaaaagacatctaaatgaatgcactccagtattgatgcctctgatctgttcttagccatcaggggattctaaagaacaggaaagaatgctggctcagatctgtatggaccattgcttagcctctctgagctgtggtttccttatctgttaatctgcagtggtagtgcctaccctgtatgattcttaagatttaatagctcataaataaaaagcacctgctacagtccccaggacagggtaggtccttgtcatagctacatagcttttattggagtctttagtaccccagtttcaggggctttttagataacagataataagttcccttaagaagaatctaagttattttctaatcccttaattaaaaaaaattttttttcagatgactttaaactatgtgtatggatgcacacatgtgtacacacactaatgtggttgtgggctactttgctgatacttctaaaaaagcattcattttaataacatagctattaaagttataattcagaaaaaatggaaaaatttaaaattaccacttaaaatgattagttttaatatttttatattctctgctcatatttagaagttaaactacaacaactcatttgtttgtgtgtaaacatacagcattagctgaacttccttcatggtggtattattttgggccacgtcaaaataactaattttacaaaccaacttaaaaattacatgatgttttgttgttttctttacaacatatgattcaaagtatggcagtcttgggagttattttcttttagaaaaagtgatctgaatgcttaacactcaataatttagtgtagcacatgcaggatttatagtctttgggtataatagttctcttttccttgattttctgaatttctctgccagtaacaatcagcttgtatcttgttatagccaaagaaagatctccatttcctgatggaatgtaatcacgagtataaaggttttcttggctgcttccctgacatcattggcactcacaaggtaacctgatcgtagacatttatagaagacaacagcaggtgaaggaggcagatgtgcgcagtagtcagtattggttttatatgtttattattaaaaaagaaacaatctataattcccattagaaaggttttgtaactgaattttgacattggtttggggtgtcctcacatatgaattctggttttctctccctttttaaaaatctgtacatcacctcaggcatgagttgtgagtattttatattttatgtcaaccatagtagtctatcgtatattatgatgtacttggatttgttaggaaaatctctgcaaagggctggtctgtgatcttaacagtcctggcatgtggccattttagcattctgctttataacttaaatatcatgaaggggtaccataggtaaattaggtttgtacaacttcagataacttaatataaaactcagaaaaattagcttgctgtcgaaatgtatgccagcagcatcagagttgtaggcctggagcctaattaatgcatgagtatagagttgttccttccagacagcggtaaataacgagcagcgtgatgacactggagtgggaaatgtttggcagcttttctagccgcttccatctgagtctttaaatggattcagcgcctcttaaaaaatcaaaggaaagcccaggacttagaatcagcacacttaggcactagcttataaaatattctgttgtataaaaaaagagagagagtgcctgtgtgcacatgctgccctgtacctagccacatgacttccaaaacctgctaatgcctgatttccattacgtgctactcctcaaatggcagcggcttctgaatattacagagatggtgtgctgtttgcttttctcttttgttgtagcataaaactgttcattttagcttagtgacatttgtcaagaatagcaacctttttgcttccaagggacttgaaggaagttaaatttagatgctttcctctcttcttattttgtggaggtatttcctgttcagtagcaaatcagttatagaatatattagcattgttatattttaaactaatgactaatcatttcagctttattcatactgttgcattttatatttcacagggagcaatagaaaaagtgaaagaaagtgacaaactagttgcaacaagtaaaatcaccctacaagacaaacagaacatggtgaagagagtcagcatcatgtcttacgcgttgcaaggtaagatgaaagggtccttatgaggtgctggtggaagtttttttttccccagcaaagtttcccttgatagagagaaatccagatgtgagcagcagttaagtaagtgagaccttttaagcccctcgtttgcaggatcccggtgctgatgaaaatctgtaatatttatttaatttttcacctgtccaccttatctggctatagatgacagcttgattaaaactgtacattttattatttctgagagacatttaagattccttttgtaatctgtggtatcataatgctctattaaatgccagagcccagcttttagcagtctgtaacctgcgtgccttgggatcatggaatgtgaaggggtttgggtgtgtcattttaggcacaatttttttgtgtcaagaaaaaaaaaagatgaatttctataggtttgagtgtttttgagcagatgagggcagcaagtggatttttcctgttggcggatgggtggatggcacttggatgggcagagaatggagagcgtgttctgttaggaacaaaagccacaaaattgtggtgctagattgtgtcatgggcatgaaagagtaaaacatacttagaggttattgggaaataaattttgattgtgaaggaacttgaaagctctagacttgatgcaggcattaagaagccattaaaagggagtaaaaaaaaatcaatcctcaagggagaaggatttgctggttatggaggggagattggaagatgcagacactgtccaagagcccagccagaagaccatctcactgttgtagtctgagctttgagggcctaaagatgtggtactggggagaagagaatgaagcacatttgcaggcttttccaaggaacagctttcaagactggggcattcatgggagaaagagaaggatgagggaggtgtccagagccaggccactacggcaaaaacgaggaaccctgattgaagtttcgggttttgaagggtttgaaatggggagtttggttttgaacttgtgtttgaggttatccaaattgagaaatacaaagctttgtataacttcaagtaactgaatgtaaaatgtagaacagtttgcatgtcatgggaatctgtgcagccgctggctttctcagcctggagggtttgggagaaggcggcataggaggcatccgagggaggcaatgaggtcctctgatgacgaagactcctctagagttgggggcaggggcaggggggacagagaaagaaggaatccatgtattcagcaaacatgaagaaagttgtccctcagcatccagtcctcctgccctgtgagaggttgagttctgacagcgtcgctggtgctcaggggcagcaaggcttcccgtactgaagaagggtctcccgctgtcccacacgctgcccagcctttcaccagaaacctgctgaagcaattgctgtgcaggagggagcggggcagggaccccagctgcctgctaggtccagtgcagacacaccagaggctttgaactgcagtcatctgtaacaaatatgaccaagtattttctatttgatcgattctgttagagtaataggctgcatttgggtgatttatctgtattggattttatagttttgaatatgcaagacagtgaaagtcattcatttactggaaagtaatgtttgtcattagcttgttttgttttgtttgttttgtttgagacagtctcgctctgtcacccaggctggagtacagtggtgcaatcccggctcactgcaacctccatctcctgagttcaagcaattctcctgcctcggcctcccaagtagctgggattacaggcacctgttgccatgcccggctaatttttgtattcttagtagagatggggttttgccatgctggccaggctggtcttgaactcctgacctcaggtgatccacccacctcacctcccagagtgctgggattacaggtgtgagccactgcgcccagctcaacttgtttttctaacctcttagtaaagtgatttaccaagaactgacaacagcagccaaccagattaggtcaggttgatgattaattgtaactgagcagagaaaccaggtgttgtcatttgaaaacttgagggaaaactgattgatgttttgatttgggttgtagctgagatgaatcactttcacagtaaccggatctatgattacaacagtgtcatccgcctgtacctggagcagcaagtgcaattttacgaaacggtgagtgggcgtccacgtgcctttcgcatgtgcttgaggagagggttcctggtaaaccactttgaccatgtaaagttaatctgtttgtattctttaatcctaagtaataaaccaaaggagcctaaattttggacaggatttttttaatctcctaattccatctgccctttgctttttggataacactgggttaaaaaagattttcttctgaagcaggggtcttggatgctagttgcaaggccccaagaagttccttattgtgcagctccttccccccgtcacagcctctctgtgcctctgtgcaccaggaacggtgctgaatgagatgaggtcacccagccgtccctgggactccgttggcagctggaacaggagcctggcaccacacaggaaaccaaaggcagcctttgctttttgtgaatgaggttttcacagtgcgccatggaaatcgcagagagaaaaccaaaaaagcgagatgtgggatggttttattcacaaaacaataacgaaaacttaaatttttcttacctctgcttagtaattttgttgtttaccagagtctatagaaaacaaaaatctagtagcatgtctccctcagacacctgcaggtaaggtctgtaatgtagaatccagcctccgctggcggccttgctgcctacccagctcccctctggccatgggatctaagccatgttcatggggagtggtgagcaagccctctgctcagccatactggtggcatctgcgagctggacactgctgaaaacgcctgtctccagcagccagttcttaaaggagaactgtgcttgatgtacctaatgcatatttgtgaattgtgtcttggacagttggtttgggagactaacttacgggaggaactcacctaagccctgtcctcccttacaggacgtgggccctatgctctttaaatgcacacttttcccgtcagttggtgccattgtggatttgcctttcattgtatattagaatataacagattacatttgtctgtgtgagaaaataatgcaagggcaactctcaaaattttgatagtgttgatttattgattttcaagtccaggtatggtatagtgacattgtaattcagaatagaaaaccatgtatttcatcactgtctttgcataaacctaagtagctgatataacattgttaggttttagatctaagttttatggcaaagtaacccttaagttactaaaatttgtgtatgtgttcatggagcagacatatattgagtgtttcttatataccaagccctcgtgctggatgtttagcatccagggatggataagacagctgtgccttcaaggagcaagaggccctggcgcagagaccactgcagcgcctcgttagcttcacaggcaggctcgtgctgtctgcacactcagcagtgacagcagggtgtggccagggcgacacaaccttcaggggattctggaagctcatactcctccaggaaagagggggctctaggcaaacatgaaggcctgagcccccagctcatctgaggaaaagcaggtggtctggaagcgccgctagggcagaggtggggagcatgtgtagacgcctcccggcgggaagggaccaccagggccagctcgggccccagcgctgccggtgtcattcggggttaaggtctgtccagcagcaacgcggggcagggctggtgccaaaaagaccagttaaagaattggaatttgtgtcatgtttaacttgttggagttgtgaataaagaacactgtgaggtcgtaatgggagtgatatctcaacgttgttttgttttgctttcttgtcagattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttgatgttttgatttttaatgatttgtatcaacctgtaggtaccacagaagagctgtagtcatacaatcacataacttttacaaatatagtggaaaaaaagtcagtatttggagaggagagatgaaggcgtggtggaagaaaaggtcagtctcgttgtcaagcaagtgacgtcagttgcctcccaccaggagcagcagtcccgggatgtcaacccactgcatggtttgtaggtgttggggtcaccaagaaagatgactcacagaggcactgggtggaacaacgtaacttgattcattttcttattggtgactttat

SEQ ID NO: 17538 - DNA, 49721 bp, Human
  misc_feature (1)...(49721): n = A,T,C or G
tgttatgggtgtaaacttgtggtaccgctattgtatatgcagtctcattcattgactaaaacattgtgcagtacatgactatatattgatctaatgagtccctggaattcattcagataaacaaatagtttatctccctaagttttcattaggaggtgacttctttgagtctaatgcaccaatacactggtgttgattttaggatttctggaagagatttcttatttgtttattactttaatttttgtggtaatccttgtatttaagcaaaatttaaaagcatcaaacacttattcaatgaaaaataagtctcccttccattcctgtttccaaacttgcagtttctttccttggaggtacttattggatccattttctttcttatgtgtccttttaagatgtagtttttctttttctttttttttcttttgagacagagtctctctctgtcacccaggctggagtgcagtggcacgatcttggctcaccacagcctctgccttccaagtttatgggattcttctgcctcagtctcctgagtagctgggattacgggcacccgccaccatgcctggctaatttttttttttttttttatgagacagaatttcactcttgtggcccagactggagtgcaatggtgcaatctcggctcaccgcaacctccgcctcccaggttcaagtaattctactgcctcagcctcctgagtagctgggattacaggcatgtaccaccacacctggctaattttgtatttttagtagagatggcgtttcaccatgttggccaggctagtctcaaactcctgatctccggtaatcagcccaccttggcctcccatagtgctaggaatacagatgtgagccaccggggccggtccaagtgtagattttcttgtctttaggcagcattttaaagttttatttgcctacctagatcttgcatgttccttattgggtttatgcctgagtgttatgggctgaattcggttctcccacaaaatcatatgaatcccaaattcctatggtgatgtcctgaccaccagtacctcagaattgagtatattggagataaggccttaaaagagataattgagttaaaattagttcattagagtgtaccgtaatccaaaataactgatgtccttctatgaagaggacacagacactcagagggaagaccgtataaacatataaagatacatggagggctggggccgggtgcagtggctcacgcctgtaatcccagcactttgggaggccgaggcaggcagatcacgaggtcaggagatcaaggccatcctggctaacacagtgaaaccctgtctctactaaaaatacaaaaaaattagctggcgtggtggcaggtgcctagtcccagctacttgggaggctgaggcaggagaatggcatgaacccaggaagtggagcttgcagtgagccaagatcatgccactgcactccaacctgggtgacagagcaagactccatctcaaaaaaaaaaaaaaaaaaaagatacatggaggggtgggcatggtggcttatgctgataattccaataccaacacttgggaggtcgagacaggaagattgcttgagcccaggagtttgaggccagcctgggcaacacagtgagaccccatctgtacaaaaaataaaaaattagccaggtgtggtggtgtatacctgtagttccagctactcaggaggctgaggtgggaggatcacttgagcccaggaggttgagactgcagtgagccgtgatggtgccccctacactccagcctgggtgggccttgttttaaaaaaaaaaaaaataaaaaagacacatggaaaaggcaacccatgaatggaaaaaagaaacttcagaaaaagccaaccctcccaccttaactagattattttgaagcaaatcttaaatatcatatagttttatttgtaaattatttaataagagtgttttgtgagtttaattataaaacatctttttatttttggcaggtagatcatggcaaccatagaagaaattgcacatcaaattattgaacaacagatgggagaggtatgtctagtttacggttgatgcactggcccaccaaacttttctaattcctactaaatgcatataccaggttctggagttccagaaataaaagatattccctaacttaagatagcttttcaagctactgagagatagttgaataatcagacaattcatagtagaatgtggtaagttctgtgacaggtcattgtatcaggtgcaatgggagcacagaagaaaattgaaaggaatgaagggaaggaaggaaggaaagaaattaaagagctgtagagtgagtaggaatgcttttgagggaattctttttagagggtacaatctgagcctagttttggtgggatcagtaggagttcagcatcaatactgacatcttcatttttttaaatggttgtgtcctattacttagtaagagataccacataatttggaagttctcaaagtattatctggggacacttcagagaatcaaccaggtgaagaccatttttataataatactgaaatgttatttgccttttcagtattgttctctcccaggtatacaatggaattttctacagactgtgtgacatgtgatgatactatatgatgaaatgtgtcagcatttataaggtgtacataactcaatgaatcattgctttccggatgaccagtgtataatgttacaaaattatgcatgagtgaaggatccatttaaattgcaggatagaccaacagattttaatatagtttatgactctacattgctgctaacctttgaaaagctgccacttgttgagttgatgtagtgtcgaacaactttcacagtttgaaaagggtattaaaatatccttccccttttcaaccaataaatacgaagctgaattttctttaacatatatacatatatgtatgtatgtatatgtatatatatggtgaagaaataggtttccggctgattttttgtggccattttttgtgctcacgtgcctggctgatgttttatatattttgtagcaacagggttttgtcatgttgcccaggctggtctggagctcctgggctcaagcagttcactggccttggccttccaaagcgctgggattacaggcgtgaggtgctgtgcccagccttgttataaccaaaacaacatagtctaacagattaaataaagaaacagatatgagattccaacttctgttaaactagatattaaagcaatttgtagaaatgtaaaacaaagccactctctgcactacatttttgtttgtttggaaaataaactttttagtcattaagaaataggttataatgggtacaaaaaaataggatgaatgaattagacctagtatttgatagcacaacagagggactatagtcaataatttttttttttttttttgagacaaagtctcgctctgttgtccaggctggagtgtagtggcgctgtcttggctcactgcaacctccgcctccctggttcaatggattctcctgcctcagcctcctgagtagctgggattacaggtgcctgccaccacgcccagctaaattttgtatttttaatagagatggggtttcagcttgttgctcaggctggtctcaaactcctgacctcatgatccgcccacctcagcctcccaaagtgctgggattacaggtgtgagcccctgcgcccagtcaataataatttaattatgcattttaaaataactaaaagagtataattggattgtttatagcatacaggataaatgcttgaggggatggatgccctgttttccatgtgattattatgtattgcctgcctgtatcaaaacatctcacgtaccccaaagataatacacacctatgtacccacgaaaattaaaaataaatttaaaaaaattatgttaacatttaatgggttgttaatttttaaatgaatcaactatttttaaaatttctctttgaatttctaactcacatgcagaaaaccccatctctactaaaatacaaaaaattagacaggtggggtggcgggcgcctgtaatcccagctactcaggaggctgaggcaggagaatcgcttgaacctgggaggcagaggttgcagtgagccgagatcgcaccactgcactccagcctgggcaacaagagtaaaactccatctcaaaaaaaaagctctttggaaccctcagtaatattttagaatataaagagtcctaaaagctaagaactgtttacataatttactactcttctctattgaaggctctttggattgcccaaatattcaattattacaattattatgctgcagtaatgtccttttactcatttaagcagaatgtttcaacccaggagcagttggaccatgaatgcgccaaatgctcttctctaagaagtcagtatgaactattagtcttttatccaaacaatttgctttagacataaactgattagtgaatcagaactttgttttaaattttgcatagaaaagaatcttgaaataatttcaggaaaataaaaatagaaaaaatttggtacagaaggaacaggattggaattttggaaaattagaaacaaacggactttgccattttaaaattgaatcaaggaatttaattggcttaatgatgtttaatctgggatatatttgctgaataacagaaactctcaatgctgaaatagttctgtgtattcatgaacttgttcctcccccccagatggcagatggcagttctgtcctcccaattgctcaagccaaaattttataatcatccttgactcttctttcttcatattccccttcagtctatcagcattattttgttacttctctcttcttaaaataaataaataatatataaataagtaagtaaatcccaatttaattgtttttcacccccagcatggctgctaccctgttcctggtcagtatttctgcccatatgtcataaccagatattgatggtacctgcagtagtgtcctttctgatctcccttaattttacttctgaacttttttttttttttttttgagacagactctcactgtgtcacccaggctggagtgcattggcgcgatctcagctcactgcaacctccgcctccctggttcaagtgattctcctgcctcagcctcccacatagctcggattacaggcacatgccaccatgcccagctaattttttgtatttttagtagagacgggatttcactgtgttagctaggttggtctcaatctcctgacctcatgagttgcccgcctcggcctcccaaagtgctggggttataggcatgagccactgtgtccatccccttttttttttttttttttttgaggcagagtcctctgtcgcccaggctggagtgtagtggtgtaatcccagctcactgcaacctccgcctccagggttcaagcgattctcctgtctcagcctccccagttgctgggattacaggcacccgccaccatgcccagctaatttttatattttagtagagacagggtttcgtcattttggccaggctgggcttgaactcctgacctcaagggatccacctgcctcagcctcccaaagtgctgggattatgggcgtgagccactgcacccggcctactcttgaacatttgcagtctgttcttcacactaaatttagaatgctttttttatacttcttttttttttttgagacagggtctcactgtgttgcccagtctggtctcgaactcctggcctcaagtgattctcctgcctcagcctcccaagtagctgggattatagataatgtcactgtgcctgtctgattcctttttaaaaaataaaatcctgtcactcctctgctccaaaccctttggtggctctccatttcacacattaggaaatctagacttttgtttggcctacaaagccctctgagtcccagctgtcactcagatcccatattctactgtaatccctgtcttcccttctgtcttactcatcatatatctctattgctgtgccttgtgcctcacatgtgtcaaacacctccctcctgccctgggacctacttatatgctctgtttcctctacctggaatgttcttcccctaggtagtcctaagccttggtctgtttcttcactcaggcctttgcaaaaatgacacctccttagcgtgagcttccctcattgccctcattctgttactgtctcaccttgccttgtttttcttcatagcatttagtaccgcatgacaatattattatttgcttatttattatctgtctttccccactaaaataaaagcttcatgaaggcaaaagttttgttttattcactgctacatcccagtatgcagaacagctaatataaatcacccaatatatgtttgtctaaatggaacatgggagggaaggggaaggagggaatcaaaatagtgaggtcaaaatgttcttactattgtacctttgtttgcacatttgtttatttctgtaggatagaattttgtggcaatagaatcggtagtttaaaaggtacgtgtgtgttatattgaatatatatgtaatgtgcttttctaagaagataattgtgtcattaaagaaaaattattgagtttcattgattatttttcatgattttgttagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcaggtaaataactatagaagtgtcttttcctcttacatatataaaaaaaaaattttaatcataagccctgccatgaagactttagatctatgtatattcagtaggaaaaaaatgcataaaattatgtgtaacacagtatctacagtgacagccctctcctatgggccactgtactttcctcacactcatatattttggggattctttgttgcatacagtaagatccactctggctattgtagccaggacaacagcctttaataaaggatacagagagcttgcagaattgttaggaaggttgaagaaacagttctaggccaggttttcaagatcgactattggagcatgctgcaaaactggcttctaagagacctcctacttcataattaggaaattgtcaaatcaggagcagcttttgtagctgtattttccagaaccaagctgcctgtgctacaaacaggaagctgccaaatcaagaagtttggactatagctgctggcttcaacattgtgcctcctttgttgtcatgcacatcttcatgaaatagcaagcagtgcagtcatgggctcctgctttactctggaatgaagtagtatatgttaacattacatcattttagttttcgctagaatagaaaattacacattattcttcaaagactcaaaaacttttatacaccacatgcctgtggttatgtcgatgttttcactgctggttgctatgattgaatacaaatataatgtactctgaagtttgccttcagaaactttttgaagggggtctacttaaaattgggttctatcttttatgatgaaaaactcacgaaagaaaattcctctttggattgaaaaactctgaattcataaaacacgaaattttgtctgtatatcctgatatcatctattcatccaatgatatttgtattagttttggaaataaaggtagaaagtggatacagtcacagatttataagaagttgttttatcaacaagacaaaagtcacaaaaaaatgtataacattatatgtaccttaatttttctttaagtagtagacttgatattttagaatagttttagatttgcagaaaaactgagcatatagaacagagttcccatattactcccccgtaaatacacacagttcccctattattaacattttacattcatgatataattaatgagcaatactgatacattgttaactgaagtttataggtgtttagactttccttagtttttgcctaatggctttgtttgtcccaggatcccatccaggataccttattgcattgagttgacatgtctcctgaggcttctcttggctaggacagtttctcagactttccttgtttttgatgaccttgacaattacgtgaggagtactggccaggtatattgtaggatgtgccactattggacttggtctgatgtttttctcatgaatgtgggtaaatcccttaatctctcaatatctccttccagacttaggaataatagataaaagattagcaccatttgcaacaggtaggctattaaagagtaatacttgccatagatgctttcataggacatctagtaccagaagcttaagtacttactgaagactgatttttgtggtgatataagaagaaatgatgctatatattacatagtaaggggcagtcattttaagaaccatttaaagttcataaaatcagaagtattcctggaggaattcaaatgccattccattttctttaattgaatttatttgttcacatttcaagattgaaagaaaatgatgaaaaggttgaaagataaacctaaaggaagaaactagtttgctgttttttgttttgttttgttttgtttttgagatggagtctcgttctgtctcccaggccaaagtgcagtggtgcagtctcggctcactgcaacctctgccgcctgggttcaagcgattctcctgcctcagcctcccaagtagctgggattacaggcactctccaccacacccagctaattttttgtatttttagtacagacagggtttcaccacgtaggccaggctggtcttgaacttctgacctcaggtgatctgcccgcctcagcctcccaaagtgctgggattacaggcgtgagccaccgcacccagcctttttttgttttttaaagaagaaactagtttcctttgccagtatcttattagctgtgcctagtgatgagctttttaagtccatacctttgtatagcgagcacatctgcatgattataattacctcaaggaaatttatttatagccccttttctatttaaaaggtttagagttatctctttatgccattataagcttatttttgtcgtcattacatgtggaaaggttctgagctcttcatagagtacaaagtttaaaaataacttgtgaaaaagaaagcaacaaagcaagaccaactgaatgttctttaatttttttaatagaatgagtgctgttgagtaacaacaggttttcgtttttgttttctttttttttttttttttttttagctcctaacagataattctccagaccaaggaccaaataaggtttttgatctttgcgtagtatgtggagacaaagcatcaggtaacattaagaataacctcctaaaaacagaaaaaaaaaataacctcctatatgtgtcgtgttgttgaaataactaccacactaccatgtttcttctactaaaagtaagaagagaaataaaggagtatgtcgtttttatggttcatatttgtagcctataacatttaactaattttttcccagagttctttgtttgtgatatagagtctcactgttgctccggctggaatgcagtggcgtgatctcagctcactgcagcctctacctcctggattcaagaaattctcctgcctcggcctcccaaggagctggggctaaggtgcatgccagcacgcatggctaatttttgtatttttattggaaatggagtttcaccatgttggccaggctggtctcaaactcgtgacctcaggtgatccaccctcccctccttggcctcccaaagtgctgggattacaggtgtaagcccccatgcccggtcccaaagttctttattcacttatattttttaacttcagtgcaatttaatatgatttgtaatgaaataaaatgcatatttcacttttgaaagtgaacatgtaaaaaaaaaattttttttttttttgagatggagtcttgcgctgtcaccctgactgtagtgcagtggtgcaatctcggctcactgcaacctctgcctcctgggttcaagcaattctcctgcctcggccttctgagtagctgggactacaggcgtgtgccaccatgccctgctaatttttgtattttcagtagagacggacttttgccatgttggccatgctggtcttgaactcctgacctcaagtgatccacctgccttggcctcccaaagtgctaggattacaggcgtgagttaccacgcccagctgtagaaacattttttaatgtgaaaactagaaattttggcaaaggaatcatttaaaaataatgacttctgatctttaataatatattacattaggccaggtgagatggctcatgcctgtaatcccagcactttgggagtggaggcaggaggatcgcttgaggccaggagttcaagaccagcctgggcaaaatggcaagactgcctctacaaaaaaaaataataataaaactggtcgggtgtggtggcgcaagcctgtagtcccagctagttggggatatcccttgagtccagtagttcgagactgcagtgaactgtgatcgcaccattacacttcagcctgggccacagagcgagatcccgtctctaaaaaagttatgataaataaaaataacttctaaaaatgtttttcatgtcagaagctcaaaaatcagtttcatcttatatgttgtttaaagggaagaaattggcttatgtcatttctgttctgaaataatgtgacttttatattttcttaaacattttctctctaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactgtatgtattagcttttaaggagaaaatactttttaaagattccagcaaactacaagagtattgaaattaacaaaatatgtcaaatatgtatactttttagtttacagttttccaactaaaaatataagaatacagacctacgtatgtacttttttatttattcaactaatatttattgaatacctgtgtaaaaagcacgtatttgtagtttgtgtttggcaaaaagaatgagagatgcaaattggtttgttttactaatctaaagcaactttgttgaacttgcacataatttctaaagattgatggttatctttggagtttagtatggtagccatgtctcctattagcagcattaagcttacctacagcttacatttctaattgtctgtaaatcctatattgtgatataatagtttaacacatttttgtagctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtaaagtaaaacagacactgagtagctggtcattttgtttttcttcccaatgaaactcaggccaaaatttgtgctgatttgttacaggtcaacaggactgttagattcaggaatgttcatgaatattcatccatctggagtaaaaactgagtcagctgtgctgatgacatcagataaggtgtgtttagtacaatttaaagcttagataattttaagcattttaaaatgttttctaatcacttcctttgctttggtaaattgctttgttcttaaatattccatattacaagttgcctttttttttttaatataaattagaaatgttcggctgggcacagtggctcacatctgtaatcccagcactttgggaggccgaggcacatggatcgcttgaggtcagaagttcaagaccagcctgaccaacatggagaaaccccgtctccagtaaaaatggaaaaattaactgggcgtggtggcgcatgcctgtaatcccagctactcgggaggctgaggcaggagaatcgcttgaacccggtaggtggaggttgcagtgagccgagatagtgccattgcactcccgcctgggcaacaagagcgaaactctgtctcaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctgtagtagttcaccaaaaaaatcagatatgttcataatctcactaggatgattatcccttcaacatgaaagcaacaaacacgtactcttccctcatcttgaaatacgagtcctcagtaagacatttattataggtgtaaaagtcttttttttttttttttttgagatggagtctcactctgttgccgaggctagagtgcagtggcacagtctcggctcactgcaagctccgcttcccgggttcccgccattctcctgcctcagcctcctgaatagctgggactacaggcacctgccaccacacccagctaatttttttgtatttttagtagagacggggtttcaccttgttagccaggatggtctcgatcgcctgacctcgtgatccacccgccttggcctcccaaagtgctgggattacaggcgtgagccagcacgcccagccgtacaattcttaatatttcttttatgctcccttacagatttgttagtgccaaaatactttttttattttttagtgccaaaatacttaaaatatttcaggtaaaaggaaattcttagctcacctccatcaaaatatttacttgagtcaagagtaggaataggactgcaagagctctccttttatgtatccaagtcatccagttctcttagagattggagcagctctatgttagaccaagggtctaaaggaaaaacagtttgtttatttaaattgaacatgaagagtttctgtacttgtcagaagccctttgggagaacaagaagcaaaaatttctcctgaaaactcatatctgaaaacagattttaggaagcctatgatcagggtttctctcaaccatgtttgttttttaaacagggtcccctcttgtcacccaagctgggggtacggtggtggcacagtaatggcttgctgcagcctcgtcctctcaggctccagggatcctctcacctcagcctcccaagaagctagggctgcaggcacgtgacactgtgcctggctaatttttcctatttttgtagagaccgagtttcattgtgttacccagctggtctcgaactcctgggctcaagtgaccctcccacctcagccttccagattgctggggttatgtgcatgagcctccctacctagctgggatctgatttttttttttttttttttttttgagacggagtcttgctctgttaccccgtctggagtgcagtgtcccgatctcggctcactgcagcctccgcctcctgggttcacgccattctcctgcctcagcctcccaagtagctgggattacaggcgcccgccaccacgcccggctaattttttgtatttttagtagagacagggtttcaccatgttagccaggatggtctcaatcgcctgacctcatgatccgcctgcctcagcctcccagagtgctgggattacaggcgtgagccactgcgcccggccgggatctgattttatataacctataagattatttgtcctgtttatgcaagatttgttatatatttgtcacttgatgctttaaggcgctctaaatacttaggctcggaaatcaaatttcatctaccacttactagctatataacattaggcaagttatttgacctcttagtgccttactttctcatctgtaaaataagagtaataaaagtatcttacagtttgggctttagcatgtaattgctaggtgaggcagtggcctcttgccatatattttggaaaacttcacttagccctgtctgcatgattcaaggttagaatgataattggttttactgacatattaactcctttaagaaaggaagggaactaggtttccttgacaaactactctgcccagacactgtgctctcttgtatatctttgtattaaattgttatgacaaccgtatggtaagcttctctgataaattgccccaaaactctgaagtcacaagatgaaagttttctatgttggctaagagcctttaggggcaaaaacttaagaatctagttagaaagaaaaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgtggaacgctgcagggtcctctgcctaggaaaactagagacctttgttcacttgtttatctgctgaccgtccctccactattgtcctatgaccctgccaaatccccctctgcgagaaacacctaagaatgatcaataaaaaaataaaataaaataaaaaagaatctagttagatatgttgctaggtagaagagactatataagcttctaagttttaggtgaatattaaagcatttaaaattgtaactaatgtactttttattcaaatataagaaaatttcttggggcagtgcttaacattatgggcttttctgggcacagtggctcaagcctgtatcccagcagctcaggaggctgaagttgaagagttccttgaggctaggaatttgagaccaacctgggaaacatagcgagactctgtctctaaaaataaaaaaattacccaggcatggtggtacatgcctgtagtcccagctgtttgggaggctgaggcagaggattacttgagcctaggagttcaaagctgcagtgagctatgatcctggcactgcactccagtctaggcgataggagtgtctctaaaaaacactgtctcttaaaaaaaaaaaaaagcatagactttggcagtcagccagtcccacctctactatttgggtcatttttctggttagcaatagaggaatgatgatttctatttcagagttgttatgggagttaaataaaatgcatatataggtattaattatgtaagaacatgataactggtagggttttcagtaaatgatttttggaccattgattaatttggagaaggcacaaaaattattttattctactgattcaccaaaatctcacagaaactgattgttataataaatgaaacatcatgggaacatatgtgttattttagtattaagaacaccaaaaagggccaggcacagtggctcacgcctgtaatcccagcactttgggaggccaaggcgggcagatcacgaggtcaggagatcgagactgtcctggctaacacagtgaaaccctgtctctaccaaaaatacaaaaaattagctgggcatggtggcgggcgcctgtagtcccagctcctcaggaggctgaggcaggagaatggcgtgaacccaggaggtggagcttgcagcgagccgagatcgcaccactgcactccagcctggcgacagagtaagactctgtctcaaaaaaaaaaaaaaaaaaaaacaccaaaaagaaaaaaccatgaagaaagtattaataagaagataccattaaggggttggcccagtaggccatagaaggcaacttaaaaggcttctcattaggttaggatgggaaaggatttacaaaagaatttaataaatttaaatcaaatatatgaaaatctatgaattaaaaattatactcagaaaaactcatgtatcataattagaaattgctaggatatcagcttcttgctctgaaaattgataacaaagtaaaagaaaaataaagcacttacctgcctttcccgtacaaattatatttctgagttgtcaaaagagttgagagaaaattcttttttataaaagaattgtagctaatgcacaagtaatatacacattttcaacaaacattaaaaaaatgaagacaagccgggcacggtggctcatgtctgtaatcccagcactttgggaaactgtggcaggtagatcacttgagcccaggagtttgagaccagcctgggcaacatgatgaaaccccatctctacaaaaaattaaaaaattagctggacatggtggtatgcgcccgtagtcaggaggctgaggtgggaagatcacttgaacccaggagttggaggttgcagtgagctgagatcacaccactgcactccagcctgggtgacagagtgagactctgtctcaaaaaaaaaaagacaaatagatcagtatcttacctatataaagagagttttcaactccagtgacaaaaaagtgaagagaataatgggtaactgatctatttcttttaatgtttgtgtttaacacagtgccttttaacacatttaattaacacaatgtttggcaaaagttggcatcctaggaagtctgttcaacaattcatttgccattttttcccccgctcttcactagtattcttcatattccatacaagtttatagtttgtatagtaagttttagaaattgtactcaggaggctgaggcagggaggatcacttgataccaggagttcaagaccagcctgggcaacacagcaagaccccatttctaaaaatgaaaaaacaacccaggcatagcagtgcacacctgtaggatcagctgctcaggaggctgaggtaggaggatcagtgagcccagaaatttaaggatgcagtgatctgtggtcgtgccactgtactccagtctgggtgacaaagggagaccttgtctcttaaaaaaaagtaacatatacggccgggcgcgatggcccacgcctgtaatcccaacactttgggaggccgaggcaggcagatcatgaggtcaggagatcaagaccatcttagccaacatggtgaaaccctgtctcagctaaaatacaaaaaattagttgggcatggtagcatgtgcctgtaatcccagctacttgggaggctgaggcaggggaatcgcttgaacctggcaggcagaggttgcggtgagctgagatcatgccacggcactccagcctagtgacagagtgagactccatctcccaaaaaaaaaaaaaacaaagtaacatataaacatttcttaagaaatacacttgatgtttttaaacttgtattttcctcagtaaatttctgaaagctcagccctttaactttccaggtttcatttaacatactgttcttttgttggcatatcataatctataattggatatttcagatattgaaaaaaatagtgataccaattcacagaattttaatacccttttttttaaaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaaggtaaggtatcttttgattatcaatgtccttttgtttacatgtctttcagtatttcttaaaacatttttatgttaaatgctatttataaaagtttcagaaaacaaatacaggttgattatctaaatacaggttgattatctcttatccgaaatgctttgttcagaccagaaacacttcagatttcagattttggaatgtttgcattactctgggtaccatgcaggcctttctgaccttttcaaaaatatctttacaccacaaagaagagaatatgcaaaaatccacagtgagtaatacacataggtcttggctcctcatggggaatcgggggaacttgccattggcatgtctggcctgtacatgtgccattttatcatccttagtgggcgtgcttacttgggggagtctgggcgtatacagaaaagatttatctcagctgggaggatcttttttcccttggggacagggaataaacactgaataaactgtaatacacctgctttttgactgcaacccatcatgagaggtcaggtgtgaaatttccacttgtggcatcatgttggtgctcaaaaagtttctgattttagagcattttggattttagtattaggaatgcttaacctacatttctattttcacttagaaaatttaaggcatagtaagttttcactgaaaacctgcattcattatgaaaggttatattctaaatgacaaaatcagtaagtgaatattagaagattagaaatgtggtcttaaaacctaggaattttttcttctaaagatgaagatgtgtatggagagcgaaacacttgtctttctaggcaatcatattgatcctgctcctcaatttctagtgatgaaaattaatgtaaaaggtttagtttaatcaactacagttttaagttacagttgaagaaagtagtatcagaattctgttttttattctgtaaatattaatgcttaggatatagaaacagtttattcagggttttcctacactgcgtttatcatttaaaatattgaataagctgaacacattagtgtataggaggctgaggcgggaagatcacttcagcctgggattttgagtcaaccggcaactagaccccatctctaaaggaaaaaaaaagatatgataaaaatacgctgaattggccgggcacggtggcgtatgcctgtaatcctaccactttaggaggccgagaggggtggatcacctgaggtcaggagtttgagaccagcctggccaacatggtgaaaccccatctctactaaaaatgaaaaaattagctgggtgtggtggcgcatgcctgtaatcccagctacttggtaggctgaggcaggagaaccgcttgaaccccagagatggaggttgcagtgagccgaggtcacgccactgtactctagcctgggcgacaaaacgagagtctgtctcaaacaacaacaaaacataatatatatactgaataaactacatttaagagtcacaataagtaatactttgttgaacatgagattttaagaaactctaggaggcttattgaaaaatatggggaactattttgagtaattatttgctaacattagtttgttattattctaatatcaaattgttacagtttagatttagctatgtgaccacacattttaaaatactctctgcccgggtgcagtagctcatgcctgtaatctcagcactttgggaggccaaggtggcaggattgcttgagtccaggagttgggagaccagccttagcaacatagtgaggcccagtttctacagataatttaaaaattagctgagcatggtggtgcgcacatgtagtcccagctgctcgggaggttgaggtgggaggatcgcttgcttgaacccaggagttcaggattacagtgagccatgatcatgccactgcactccagccttgctgacacagggagaatgtgtttcaaaaataaacatgagtaaaatgttttctgaatttttaaataaaatttaagacctattgtactgtgtataataaagttgacataagttcttacccttgttctaagtaacttttgtatacaaaataaataggctgatagtcttgtagtatcatatatatatatatcatacatataatgttcttaaaaaataattaattgaaaagaatttcgtttaattgagacagggtcttgctgtgtcacccaggctggagtacagtggtgtgatcatagctcactgcagccctgccctcctggactcaagcgataaaatatataacttttaaaaacatattattatatgaaaatatgaagatgcttctcccccttaattatgcaagattttaaaaagagactttaggccaggcatgtggcttatacctgtaatcccagcactttggaaggctgaggcgggcatatcacttgagttctagaccagcctggccagttttttaggcttaaatcttaattccagaatcctatgtagaattgttattttattgcggtgtttggtcaagctcatagcttctgatgtcttcatacagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcagggtatttctatatgttttttttaacttgtatgttgtgttgcttgattttgatctacctttcaaaaatcaaagtatgtttgttgtgcttttaaagtcagaaatatccctgatagaatttcaaaacagcagctaaaacactcatctgggccaggcacagtggcttatgcctgtaatcctggcattttgggaggccaaggtgggcagatcacctgaggtcaggagttcgagaccagcctgaccaacatggagaaaccctgtctctactaaaaatacaaaatcagccaggtgtgatggtgcatgcctgtaatcccagctactcgggaggctgaggcaggacaatcgattgaactcgggaggcggaggttatggtgaaccgagatcacgccattgcactccagcctgggcaacaagagcaaaactctgtctcaaaaaaaaaaaaaaaaaaactcatctgcatatagaaacaaaatgtctttaggcttttctcttctgtttatcaagatactgaataagctgggcatgttagtgtgcatctatgcaggaggctaaagccttatgtagataagataatggcgtaataaagcatcctgttaagtcagttataatagcagttattgcgtttaaaagttagcttttataacttttcagcacattttgttaaactttaagtattggcattcatgatgtgttgaatggactgcttttgttcaatgcctagctactactatatcgtaatcaataagacccagatagtttgctcttaccatagtaactacaaagagctccatttgttatgtatcatcttaattagctggcttccagcattattataagatacaaattggccaggtgcagctgctcccacctgtcatcgcagtactttgggaggctgaggccagaggattgcatgagtccaggagttggagaccagcctgggcaacatgccgagacctcatctctattataaattaaaattacataataaaatttaaaaagatacaaattatttaatatattttaacttttagtttttaacttacactttttagccattttggagaaggtacatttataatttattttgttcccataaataattgtgggttttgccattacttttaaggctgcaattactttttcaccaacctaatttatttatgacagaaacaatacatgcagaatactagaaataatacatgtagaagactagaaaatcactttctactatttgtcattcaaataatgcttggacagagttatagccatgctcactgtggagaccttacattacgatcctgttgttttgactcttccattttaaccactcagctgtggatactcttagcaagatgtatgcaaagggattgaatgcatatagatttcacttagcaatatatagcagtcttggaatacctgagggtgactgctcatacttttactatagattataaaattccatggatttttttaggagaatatgtacagctatcaaataaatatgtataccagtagaagttatgagtgcaaagtaatatttgtatctataaaatttgacttggtagaaatagccacagagaaaactcagtagcttaaaatagtgtaatttgatgtagtcaataaaatatatcagtgaagccaatttttatgtaaaattttaccaaagataatttacatggaaaaaattagaaattttttttctacactctacaggaaaattttttatgagtgctataagaaaaagtaattggaataatcagtatcattctaaaaaattatggtaagatttatggacaagggtggagcaaggcaaaacttgatttttcccattgttctttcgtattctaaataaaagatactcttttgttttcttaggtttatgttctgctttggatttaaatgggaggaaggatgaaatgagacagatgtaggaacaggacccattgtgagggaaaaggaccagagtgctctttagaaagtaggggtagtttacctgtttattgttaatgttggtcctcaaagtttttgattgcttgaaatgttttggacagaagaatttggcaaattacaacttttttttcttcttaggattggcttttgtcattcccatctttgtcttcctaagtatcctcacagtcagcactataaagtttcttactctcctgaaaaggaccacttcatctttctcggagtcttacagccttgtgaagtcaaatgtttgacttttcagtgatttccctgcttagctcctagagtctggtaatttcatggttctcacattgaagttttctgatcatgggtttcaagaccttacatctgtaatcaaacaactcagtcctttcttacttgctgagctgaatagcattttgttcctctgttgcatttctatgtacactgtagtttgcagcatattttcacatacactgtttcctttgggcctcaccacataagctgaggttagaatttttaattttttttttctttgtgagatagggtctcactctcacccaggctggagcgcagtggcataatcacagctcactgcagcctcgacctcctgggctcaagggattctcctgcttcagtctttcatgttgctgagaccacaggcatgtgccaccacacccagctaatttaaaaaatttttgtgtagagatgggatctcactttgttgtccaggcttatcttatactcctggcctcaagtgatcctctcacttcggcctcccgaagtgctgggattacaagtgtaacccaccatacctggtagggttagaatttttattctcatttggtggatgaagaaagagatgtagagatgtttagtgtcttgttcaaagcaatcttggtagtagggagaaatagtctaataatgaaacttgaagtttgattttgaaaaatcaagggcagtagtaatatttaagatttttattggccgggtgtggtggctcacacctgtaatcctagcactttgggaggcctacgcaggcagatcacctgaggtcaggagttcgagaccagcctggccaacatgacgaaatcccgtgtttactaaaaatacaaaaattagccaggcgtagtggtgcatgcctataaccccagctactcaggaggctgaggcagaagaattgcttgaacccggggaggcggaggttgccgtgagccaagattgcatcactgccttccagcctaagtgacagagcgatactccatctttcaaaaaaaaagaaaaagatttttattaaacttcataatttttggtatgatttcatgtactttattttacttgattcttaaaatctccttagaagattttaagaatatggtagatcatattcccattttagaaattatatacatgcaacagaagtgaggtggttttggaaattgcatatacttatttctaaaattttattattttcacattagagtcagtctttctggtcgcccatgtttgcaactttagaggcagttactctccctaagcctcactcttctcattccataactgaattttaaccattccattgcttgaatttctcccttcctcttcatttccttcaccatattttaggccttttaaaattcctttcttgatttgttaccctaatatcttcgcttccagtctttcttttccatcttgtcctgtgtgctggtaccagcgttatatttgttaaaaatcaaattatgtcactctgcccagccttcagtagcttcccattgcccatatgttatgaaattaagtccggtctctataacttgaccttttagggccctccacattctgacccagctgctcatggtttctcacacatgccattagctttcttagcccttttctatagctcattcagtttttattttattcttccactgagacaatagcacttactggttcccagtgaactctaagtaaatagttactgaatgaatatgtaatctagggtcatactggtaattaggcgaagtgattaacaaaaagttggaagcagaatccagatctcctaactcaaatgatttttttctatttgtgtggagatgaggtttcactatgttgcccaggctggtctcaaactcctggccacaagcaatgatcttcccacctcgacctcccaaaagtgctgagattataggcctgagccactgtgcttgtgctcagcctccaaggattttgtttttgtttttgtttttttgagacagactggctctatagcccaggctggagtgcagtggcatgatcgcgactcactgcaacctctgcctcccagactcaagccatcctcccacctcagcctcctgagtagctgggactacaggcatgcaccaccactcccagctgatttttgtatttttttaaatacagacgaggtttcatcatgttgcccatgctaactcatgagctccaatgatccgcccacctcggcccccccaaagtgctgggattataagcgtgagccatcacacccggccatccagtgattttttaaaagctatatcggctgggcagggtggctcgcacctgtaatctcagcactttgggaggctgaggtgggtggatcacgaggtcaggagttcaagaccagactgaccaacgtggtgaaaccccgtctctactaaaaatacaaaaaaaaaaaaaaattagccgggtgtggtggcgggcacctgtaatcccagctactcaggaggctcaggcaggagaattgcttgaacccgggaggcggaggttgcagtgagccaagatggcaccactgcactgcagcctgggcgacagagcaagactgcatctcaaaaaaaaaaaaagctatatcacgcaggctgttataagatttcaatacagaaactgctagaaagataattgtagaagcaactaataacttctaaaacagattggtcaggtttagttcttgtcaatgctctttaaaaattcactcaatatgttgaacttttctaatttgaaaaatgtgtataattcaatttataaacctaaagatatacaggcattttggggaagctcactctttatataggaataaatctttgtcttttcagtctcaaagacttgtgaaatggactattgtttcttcagccaacattagctttctgattcagaatactagagttttattgagcatgtagaacagattatgaaacattttctctctttataagttaacatggtgtagtaatattttaaataacgagtccctttagtgtgtgttgtaaactatttccattttatgattaaaccagcagaaagttttcagagttaccaccactgttgtgtaaagcaaaaccattatatccagtgtttacacattacaagtattaatattttatttaaatgcaattttaaactattttgcaaaggattttttttttttttgagacagagtcttgctctgtctcccaggctggagtacagtggcacaatcttggctcactgcagcctctacccgctgggttccagctgttcttggcacctcagcctcccgagtagctgggattacaggcacacaccgccatgcccggctaattttttgtatttttagtagagacctggttttacctcattggcaggctggtcttgaactcctgacctcaagtgatctgcctgccctggcctcccagagtgctgggattacaggcctgagccaccacgcctagccttacaaaggacttttttgttgttgttttgcatcttacttgccccttcccccaaaactagtaatttttggtaattcccttagtttttcagacttcctttttactcaccttgggtaattctgaaaagatatgatatattttgttttttaagatgtggtcttgctctgtcacccaggctggagttcagtggcacaatcctggctcactgcaacctctacctcctgggctaaagggatccttctgcctcagtctgctaagtaactgggattataggtgcacaccaccatgtccagctaatttttttatttttagagatgaggtcttactgtgtttcccaggttggtctcaaaattcctaggttcaagcagctcttccacctcagcctcccgagttgctgggatacaggtgtgagccatcactcctggctaaatttttaattttttgttttgtgtgtcggtttttttttttttttttttgtagaaatgggtctcgttatgttgcccaggccggtcttgaactactggcttcaagcagtcctctcaccttggcctcccaaagtgctggaattacaggcacgagccactgcgctcagccaagaattgtcttaaataattgtattttaacttactgctgtagtaaacctttctcaaacattcttaaatatgtaaaaaattttcttctcacttacagaatttcaactattaattgcccttttgttttattacttggtacaatttataaataggtaaaccattcttggctaataatgaacaaaggcaggggttgttttttacatttttatgtaacttttctttgtttcaaacctcaagccttttagatagaagatacctttgaggggccaggtgcggtattttagatagcagatacctttgacaggccaggtgcggtggctcatgcctgtaatcctagcactttaggaggcccaggcgggcggatcacctgaggtcaggagtttgagacgagcctggccaacgtggtacaaccccgtctctactaaaaatacaaaaaaaattagcggggcctggtggcacacgcctgtagtcccagctactggggaggctgaggaaggacattcatttgaacctgggcagagagctgagatcacgccactgcactccagcctgggtgacagagcgagaccccatctcaaaaaaaaaaaaaaaaaaaagatacctttgagaatctgatgaaagctataatagtcattccccagaaaaatacatatggacacatctacctaccccacccagaggtagccactgttaactgtgtggcgtgtttccttctgtactttttaggtatacatatatatgtactctttaacataaattgggtcatctatttaatacatactgttttacagttttttccacttggatgtctgtgagattttttgtataccattacatctcagtttatctttccaattttaatgcccacatatattctatagcatggattattcttttctctagtgatagaaatttgggttgttgccagcatttaatttcattgttagatgtagagctgcaatggacatccttacacatgctttttttgtgcatgtatgcaagtattttgctggaacagagatttagaagtggtattattgcatgtacttactttcaaaattttggtagatggtagactaattcttctccagactaccccacccttggtagtgtgtacttggttttctgtatcctcactatacttgatactattggtcatttcagtaattacaaagtagaaaaaagtttcaacagtggtcagacattttaaagaactagatcagcaatataaactgaccacttactagtagtatgtccacaggcatacctgtaatttttaaaacattttttttttatttagtgccagtttgggtttttttgttttgttttgttttgagatggagtctcactctgttgcccaggctggagtgcagtggctcaatcttggctcactgcaacctccacttcccaggttcaagcaattcccctgcctcagcctcccgggtagctgggactgctcaccacacacggctcaatttttttttggtattttagtaaagatgaggtttaaccatgttgaccgggatggtctcgatctctcgacatcgtgatccacctgtctccacctcccaaagtgctgggattataggcacgagccaccacacccggcctgccagtttttttaaatagggaggtttcacacagaatgtgctctttgaaaaactgaaagagctggcagtgctcagcccacaattccatatgttttcactgcactgaattcaattcacagctgtgtcctttatctgggaataaatatgctcttcccagttggtaccagcaagcctgttgcactccttactctcctggctttgtaagcatttgaatttgttaaccccttagcctaaatgaaagaaacatttagcggacagaatttctccttaaactgaatttgttgtatgctatcattaatggagagaaggaaggaaaagaaacatattgttagaccaagacaggaagtaacataaccagataatatcatcgttgatatttgttgaggttctgcttgtctaaatattggcttgttagaaactatgggctacttatttattctaagccctgttagctgtaaattctagtgacttggattatttcaagattagctttttttgtgaatatattagctctcatttgatgtgttacgtttaaactttttcaaagaaatgataatttagaacttttcagtcataagataatttacctaaatccctgttcatactagctcaccatgccttctcctatgcctgagtacctgaatgtgcactacattggggagtctgcctccagactgctgttcttatcaatgcactgggcactttcgattccttctttccaggctctagggtgagtgttttgaaatcttgaatataaatgtgattttgtagtgcaaatgtacattaaacaaaactttttattttgggaagatttgcattaaaggaaaaaacagtataacattatagctttaagttgtgtcattcaaatgacaaatcatggcagctaactagtattttctctgtatttatgtggaagagtatccatattttgtagtttgactaagttaagaatttggatggaatatgatcagtagaattgataagactatggctagcatttgtaacaggcctcatctttcattggctcaaagatagagagactgtaagactgccctaggttcttgtttctctctcatcactactgtttcagtgttcatcccaggcatgttactaaagagctgaattttgcctacagtggttatgttaaaagtagagataattgttttccaatcatgtggttcaaaaaaaaaaaaagaaaatgtaaaacctcatagtaccactacaatgacttagagggttagtcttaccactcaagagtacatctgaggttgggcatggtaactaacgcctgtaatcccagcattttgggaggtcagggcaggaggatggcttgaggccaggagtttaagaccagcctgggcaacagagtgaaaccctgtctctacaaaaagaaaaaaaatgttttaattagctgggcatggtgatgcacactagtagttccagctactctagaggctaaggggggccaatcactttagcccagaagttcgaggctgaaataagccatgatcacattgcttactgcactccggcctgggacggagctagaccctgtctcttaaaaaagagtatatctacattctgttctgaagaaatcagatgagatagaaaatggcctactataagaaactcaagctttacctaaagtttgccaaatgtatttaaattgttttaaaataactggtgtgtctaaaggcaaagcaatggaaaaagttaagcccatagttagaaagtttttattcaaagttagaaagtttttattcaactcctaggaccctattcaccagtatgattttgtaaacaattcagtttcacatcctgtatacctgttcttccatttgccaaatgggaataataattgcccacctgttatcctcaaagactattttgaatataacaaagaaatatgtgaacatgattgtaaaaggcatacagagaattgaataaaggcatatttaacattataatttggtttattaatcagcattatactatgcattaaatcatgtgctcagatattatagttacatagactaaaagcctgatttaggatggttaacctttaaaatgattgttagtccttttttaacattcaattttcagcatttctctagttttctggggttttttttgtttaagagatgagttcttcctctgtcattgagactgatctggaactcctgggctcaagcaatcctcctatatggatgcctcccatacaggcatgcaccacctcgcccaacgtccagtgtgtgtgtttgtagaaaaaaataaaatgtaaatttgcatattggcaattgatttttttttagttagttgggttagagtcttttttctactttgtaattactgaaatgatcaatagtatcaaatatagtgaggatacagaaaaccaagtacacactactgaggggtggggtaatctggagaacaattagtctattatcgaccaaaatttttaaaataagtacttatactggattgcagtagcgtgatctcggctcactgcaatctccacctctcagtttcaagcaattcttatgcctcagcctcctgagtagctgggactacaggtgtgcaccaccaagcccagctaatttttgtatttttagtagagatgggatttcgccatgttggccaggcagttctcaaactgctggcctcaagtgatctgctcacttcagcctcccaaagtgctggtgttataggcgtgagcctctgtgcctagccagcaattgactaattttaaaatattaagtgtagttcactcatcttgtaactcacattcacatgtctaaaaagtaacgtggtgatatttttcatgataggctatcagttattataataaaacaacaaaagggaggaattttggggagtggtttgaactccttgaattatttacaccaccattgatcttaagtacttctattaaattgagtataattatcctatggaaataacgcagatgttgagaaaccaaaaataaggcctcaggaggtttctgtttataaaataagtcatttttatagtggtagccacattttcctgtgatctgtattgagaatcagtttcaatgtaacaaccacaagattctttgtaattagaataacttgatctagcagtcaaggccattatgtaaactcttattttttatccctatctagatgattcatagatcttatttatgtgtttacttaatcatacggataaggacaaagtgctcatgatggaaaaattctattatatggaaataaaagctattctaaaagtagaaactggcattaggttcctttttttttttttttttttttgagatggaggctcgctctgtcgcccagactggagtgcagtggcacgatctccgctcagtgcaagctccgcctcccgggttcaggccattctcctgcctcagcctcccaagtagctgggactacaggcacctgcaaccacacccggctaattttttgtatttttagtagagacagggtttcatcgtgttagccaggccgatctcgatctcctcacctcgtgatccgcctgcctgggcctcccaaagtgctgggattacaggcgtgagccaccgtgcccggccaagattgcatttttatctaaaaatataaaagttggtgacaaagtcctaattttacagagagaaacagataagcaacattaatcattttctgaaatcaagattgttttgatcactttaattgaagggaacagtaacttaaataattttactaaacagtgcatggttagtacctttgtattttacaaggcttctatattttacaaaggtgttgattgtcagtatacagttaatactactaatattttacaaggcttctgtattttacaaaggtattgattttctgttttaagatttatagtttcagtacttagagtaattcagttgttggttttaagttctccctgcaaaatttaggttaagtgactatatgaatagtggtagattccattgcggggtagtggagaatacttgtcatgatttgcctggagtaagtatggcagcagtcatctctacctagattcttaaaatataaccaaaagctccaagccaccaccgtttaccacaggagactttatttattgaataatgtaatcaatagccttccattaaatgccaagccagacagctgaatcttttaaattaccactgaagcataatgtaatgtttcctgtaactttgtagttttgaaacctgtaactttttaggttcattttgactatcactgatacttttccctgaggactggtgccttcagtattaccagatatgaggggctcaaaagttatattcctttatgaaaataaatagtataaacaattatataacctctaattgtgagtcctataatgaatgttaacaatataggccaggcctggtggctcatgcctgtaatctcagcactttgggaggccaaagcaggcggatcacttgaggccaggagttcaagaccagcctgggcaacatggcaaaaccctgtctctactaaaaattcaaaagttagccaggcatggtggcagctgcctgtaatcccagctacgcaggaggctgaggcaggagaatcacttgaatccaggagacggaggttgtagtgagctgagatcatgccactgtactccagcctgggtgacagagtgagactctccttcaaaaaaaaaaaaaaaagtaaacccacaatatagtgtagtagttagagaaaaatacctgtacctatttgtaaaagaaattaacatatttactaattttacaagttaatgcttttttaaaaactagagatggaggtctcactgttgtccaggctgatcttgaactccttgcctcaagcaattctcccagccgagcctcccaaagtactgggattacaggcatgagccatcatatccggcctttttttttttttttttttaatctcaacattcgtgttgctttttagatgccttagtgataaccttaactacagtctctactcagctctttttgcttcttaaagatgttttgaacataaactacaatagtcatttattttcctaacaggaaaaactggtagcaaacatgcccttaccatcccaaaatattaaccttaaatggaggagtctctactgagaaatttactgactttagcatttcacttgctaaattgtgtaatgaggtttaaaggagcataaaggttcaaattctgtttttatacatctgctggcttttgtgtctttggaccacgtaacttaaatgaggcccagtgtctgtaaattgggagcagaaacacttcattatgaactacatcacataggtgagataatgaatgtaaatgcatctaagccattgcctgctgcaaagtagataataaaaggtcattcttcgtcattctcttaaagaccatctttttagagtagccttgctgtttttctttcctaacataattgaacttttaaaaacatagctagctataccatcagggtttttggtttggggtttagataaatgtaaatagatacctttctgtagttggtttctacagtccttttcccttttcttttggaaacacaataatctggtaggttatttctcatctgccacttgtgtcttttttccttagtaataattttggtattcttatcctttgcacttatactcctttttttctgagcttctccagcaatgccaaggtactttcttactacaagatgcatagcacaagccagctctgatttttttccatttatttttcctttcctgtgtttactagcaaactactttggttagctgtttcctccttaaaacttcagaatcagaggttaaaagtgaaactgagtttactctaacttccttcatgttagcttttaattttttttaatgtttaaagtaatattgaagtataggattataaagtaaaacctcactcaccagaggtaactaaccccactgttaacagtttggtgtcctactagaatgtttctgtgagatacttattagacaattaaatacatacacatatttacacatcctattctttgccttgctttttacactcatagacttcttcctatgttagtacatgtaaatttaccccatttgtcctcatggcttctattatagtattccattttatgcacttattcattccttattagtagacatttgggttgttgccagttttctttgttattatatccagtgctacaatgtgcattttgtggcattgtgtatgtattttcgcccactttttttagtatggtcatgttagtataggcatgtgttgcccatttaatgatggctatgtaatctgagaaatgcatcattaggcagttttgtcattgtgaacatcatagagtgtacttacacaaacctactacacatcaaggctatatgctacagcctagtgctcctaggctacaaacctaggacaaacctgtatagcatgttactgtactgaataccataggcagttgtaacacaatagtaaatgtttgtgtatctaaacatagagaagtgtccataaaaatatggtattacaatcttaagggaccaccattgtatatgtggtacattgttgactaaaacattgtgctatgcatgactgtacttctataacatagtttcttagaggtgaaattgctgggtctaagaaagtgcacatttcaactttcgatgggtactaccaaactgttctctgaaaagatgttgatccagtttatgttcacgtcagcagtgtatgagaatgaatacttatttcctcacctcttcctcaattctggattttatccatctttaatgaaaatagtatcctttatttttatctcctttgattttgtttaagattgatatttttaagcattttctataggaatattataaaataccggttttctttgcatttaaactttactttcaaatgacaggcagtttcttgtggccagtgatccttcttggatactgaatggaaaagagatcagcctgaagttaaaatttcacattaataattctcagaaaaaaaaacttgctgtgactgagttgacagtattagcatttgttgcaagtatgttcgattatttaataaaatgtaatgtcataaggctgtgattcttaacgaatgatttctgttaaacatactgattatcctaattttaaagctttattaagaagaaaaatatataagtaccattcattaagttggacatatttcctatcaggacgttcttaccaacttatatctctccagagatttaaggaaagaaatcttatagtttcatcatcttatttataataaagtctgtaggtttggtttaaagattaattgtaaaagggcccacagctcttttcatcaaagttctcacatctgcctgttctgtactcgctaagatcagaaatcatttgcagaattctttctgtgtaccatgtactgcattggtctctgagatacagaaatgcgcaagggagtctctgccttcagtgaggatacgtgtgtgcgtgacactgaagggggaatgaatatgttgagagaggaataatgttccttctagaaagtgaactctgagctatattttaagggatcagtaggtattagccaggaaaacaaggctacgaaaggaccttccaagacaataggatagcatttagtaattcacttaacaatttttattgaatatctattgttttattgaatatgcttgttctcaccttagcacatttgcccttgttctccctgggatactattcccctagatctgatttttggtttttgtgtttgtttgttttaattctctgccatctttctccagtcaaatgtcaccacctcagaaatgccttctctaaccaccttatctgaaccttcccattttctaatatacatcctttatactaatgtagaatttttattacctaaaattatgtataatcatatatgtatatttatataaaatacttgaaattatatatttgttatttcccctttttttcatgaaggcaaacttaatctcttaattgctatttctccagtacctggcatatactttctcaattttttttttttttttgagacagggtcttcctgtgccaggttagaggctggagtgcagtgtctcttcacagatgcaatcatggtgtgctaccccttcaaactcctggcctcaagcagtcctcccacctcaaccctcctgagtagctgggactataggcatgtgccacagcacccagttaattctctctcttttttttgagacagggtctcactctgtcacccaagctggagtgcagtggtgtgatcacagctcaccgaagcctcaacttccccaggcttaggtgatcctcccacctcagcctgcgagtagctgagactataggtgtgcacctccacacccagctaatttttgtattttttgtagagatagggtttcgccatgttgcccaggctggtttgcaactcctgggctcaagtgatgcgtctgcctcagcctcccgaagtgctgggattacagacgtgagctactgcacccagccccagctaattcttacctttcacctcttaataactctgagcaagatataggacgtatagtgtctctgcattttgtatcattagacaacctgagacctgggaagtttgcctaatttcaaatggataaataggtttaagtagctgggacggcaggcacatgccactatgctcggctaatgttttcattttttgtagagatgggggtctttttttttttcctttttttttttgagacggagtctcgctgtgtcacccaggctggagtgcagtggtgcgacctctgctcactgcaagctctgcctcccaggttcacaccattctcctgcctcagcctccttgtgctgctgagatcagttacttagaaattcaggagagaacttttgacctttctaatctcttgttattcatagtaaaatcctgggtatcttatttatagggatactaatatctcctctgaaacatacaatgaaccatttttctcctaaaattggttgcttgcctactataaaataattctagaggctgggagcagtggctcacgcctgtaatcccaacactttgggaggccaaggcaggcggatcagctgaggtcaggagttcaagaccagcctggtcaagacggcaaaaccttgtctctactaaaaatacaaaaattagccacatgtggtggtgcatgcctgtaatcccagctactgaggaggctgaggcaggagaatagctttaacccaggaggtggaggttgcagtgagcagagatcacgccattgcactccagcctgggcaacagagcaagactctgtctcaaaacaataaaataatttgaattgctctttcttttaaaaggtatttacctatattcaaagcaaaagtttttttttaatatatgcttttgcttttaagaacaatctttattccatttctatgaaatgtgaagttaaagccccaacttttttagtttgaatattacttgcaattgttcttataaactggctgattgatgagctagctactatttaaatgcctaagcattcctcatttctcattttgttatcagctatacaaaacacagacttgctcaaatctttctagaataattttagtttagtaatatgctgtttttaagtatttggactagctgtaaggtttataaaacttattttaataatatctgatttgtgcttttattactgtttttaataggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaaggtaaaaagcaccttccttaccttttccaggttgtaggaggaggcatgagtttcattaaatgttatgactaaagttagatatctaataattattatattagtgttttaggtaccaatgctcttcttactttagataatttttacaattttataaatttactaatcctctaaaaatattttttaaatagagtgcaacaaaattgaaaacagtatacttaagtctggcaggctatttctgaccaggccttgtgaatttttgtgcaactatcaaagaatccagggtgagcttatgtagaggtggtcaaatattttaaaacatatactactcagcaatttttaaatgacctttctttattatagccctttgaatcctaagataggttgattttgtatcaattcatcagagtgtattctctcacctaaatagttctgaagagtcaggaacaatcctttttattctgtttttcctttcctagatgccaaggtaattgcagccctcattcatttcacaagacgagcaatcactgatttataaatgcttaactatagaatggcttatgactacccaaaacagtgccccatcaacaaatggggaaaattgccttttgagctcaggaataatttataaattggggactaccttttagttctttagcatattctatttcttattgttttatataatttttaaatcatttgcttcctccttatgtttaacagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgtaaaactttattctgcttcagtttttttcttcttaacagtgtttttactaaatatctgtttttattatagtagtcttggtagtgaaacatgtagatggttttgctcattttttcccaaccaatataagcttaaataaaatcctattaccaaaatttgagtcttatgtacttttagttgtctagtgtttcagatggttatctttacatcctatcttctcaaaggtatatcttgaaagcaaacatttcagccaggtggggtggttcacacctgtaattccagccctttgggaggctgaggtgagactgcttgagcctaggagttcgagactagcctggacaacattgtggtaccccacctctacagaaattttttaaaaattagctggccatggtagcgcatgcctatagtcatagtcccagctacttaggaatctgaggcagaggattacttgagcccaggaatttgaggttgcagtgagctatgatggcaccactacaccctagcttggacaacagagtgagaaccatttctttaaaaaaataaaaagggtggggaggggggtgttgggcgcggtagctcacgcctgtaatcccagcactttgagatgcctaggcgggtggatcatgaggtcaggagttcaagaccagcccggcaaacatggtgaaactccgtctctactaaaaatacaaaaaaattagccaggcgtggtggcaagcgcctgtaatcccagctactcaggaggctgaggcagagaattgcttgaacccaggaagcagaggttgcagtgagccgagatcgtgccactgcactccagcctgggcgacagagcgagactccatctcaaaaaaaaaaaaaaaaggaaccattacatttagagttttctttttttgtttgtttggtttgttgttttttttaacaagccaagtgccataaacatccaaatccattttttatatatagttttttccccaaaagcaattaccatgagaaaataattcattttttaaaagtacttttacaacatcaaaagaattaagatgaaatataaacctggctgggcacagtggctcacactttgggaggctgaggcaggcagatcacttgaggtcaggggttcaagaccagcctggccaacatggtgaaaccccatctctactaaaatacaaaatttagccattcatggtggcgcttacctgtagtcccaactactcaggaggctgaggtgggaggattgcttgaacccaggaggcagagttgcagtgagttgagatcgcaccactgcactccagccttgggcaacagagcgagaccctgtctcaagaaaaataaatataaacctttctacttacgatttttatacagattatactaacagcttgttcttgaatgaataatatcttaagattagttttagctataattgcagaaatacttaattttaaacatttctagattggttatactcaaagcttgaaattcatgagaggaaggccaggcacagtggctcacacctgtaatcccaagactttgggaggcacaggtgggctaatcacttgagcccaggagttcaagaacagcctgggcaacatagtgaaaccccatcctacaaaaaatacaaaaattagctgggcgcggtggcatgcgcctctagtcccagctacttgggaggctgaggcaggagaactgcttgagtccaggaggcagaggttgcagtgagccaagatcaccgcactgcactgcactgccacctgggcgacaggagtaaaaccctgtctcaaaaaaaatttaagaattaaaaaatttttcaaaattcctgagagggaaatatattggatgaaagtagttgttcattttagacaaacactagaagcatttgtttatttttaattaaagataaaatgtcaacagaaagaagaaaattattgatggagcacatcttcaaactacaggagttttgtaacagcatggttaaactctgcattgatggatacgaatatgcctacctgaaggcaatagtactcttcagtccaggtatataaacatttactttttattcaaaataaaatgtttcacgatgtggagaaatagaagccctcatatgttgcaagtggggatgtaaaatggtgcagttacctgggaaaagagttcagtagttcttcaaaaggttaaacatggagttatcatatgactcagcagcttcactcttgtcagcccaagagaaatgaaaaatatatatctatgcaagaatgtgtatataaatagtcatagcagcattatttataatagtcaaaaagtggagacaacccaaatgtcggtcaacagatgaagaaataaatttaatatatacatatgatggaatatcattcagccataaaaggaaggaaattctaacacatactgcaacacagatgaacctttaaaagttctgctaaatgaaagaagccagtcatattgtttgatttcatttatataaaatacgcaaaataggtaaacctgtatagacataaaataggtaagtggttgccagggtctaaggagaaggaagaaatgggaagtgactgctaatgggtagagtgttttttttggagtgacaaaaatgttccaaaattagattgtagtgatagttgtacaattatcagtatattcatactaaaaactattgaattgtatactttttttttttagactgagtctcactctgtcgcccaggctggagtgtagtggtgcaatctcagttcactgcaacctccgcctcctgtgttcaaacgattctcctgcctcagcctccccagtagctgggattacaggcatgtaccaccacacccagttcatttttgtatttttagtagagacaagtttcactatgttggccatgctggtgttgaactcctgacctaaggtgatctacccgcctcggcctcccaaagtgctgggattacaggagtgaaccacccgcctggcctgaattgtatactttaaattggtgaattttaaggatgttagacatttatatgggtatgaaaagggaggttgagaagtcagtgaaataatatgatagaccttggcagggcgcagtagctcatgcctgtaatcctcacattttgggaggctgagatgggaggactggtcaggagtttgagaccagcctgggcaacataatgagacctcttctctacaaaaatcaaaacagaaaaaattagctggatgtgctggtgtgcacctgtagtttcagctacttgggaggcttaggtgggaggatcacttcagcccgagaatttgaggctgcagtgagctctaatcatgctgctgcattctagcctgggtgacagagggagaccctgtctcaaaaataaatgaaaatgtaaaaaatgttatagacctttatttctgttgtcacgtcaacatttgaattcttaggtgtatttttttaggcattactaaatggcagaatgagagatgactattgctatgttgatgggctagatttccaaacatcttatatgagttaccaacaaatttaaaaaactggtttcttgttttcctgccagtttacagttttcacagatggtaaaatgacggtaagctctcagtgatcaatttctgaataagagaaattgactgttctcttaggttctgtatttttcattctgatatgtttctgttcttgtgcatcataataaaattatctgaggaaacctgcttctttctgtcagtaataccagtaagaacatgaaagcttgtactatttcttctaatgtttcttatgagttagtaacgtatgtctctattcttagcacaatttgtcacctttattttccttaggtgaaaattgaaggaacatagatttgaagtttaaattctaatgtaattttattttactaagtatttttaggtttttccatttagtactttttaaaattttcatccatgagaacagagctttccatattcaacatttcttaagctatgcataatttttatgaagttcttttaatatttctgtttttgtgtaatgttatagtgaccattgaaatgcttatatagattttttcatgtttctgttatttttctgatagagataatatttgtggtttcataatttcttatatacctttttacctaaaaatagaatttttgacttagaaaaatatggcatagaatataatctgcaaatatttcatggatttaaaatgccttttttttttttttggagacggagtctcactctgttgcccaggctggagtgcagtagcacaatctcggctcaccacaacctccgcctcctggtttcaagcgattctcctgcctcagcctcccaagtagctgggattacaggtgcctgccaccacacccagctaattttttgtatttttagtagagacggggtttcaccatgttggccaggctggtcttgaacccctgaccttgtgatcccccccacctcggcctcccaaagtgctgggactacaggcatgagccaccacacccagccttaagatgtctttttaagctgagtcatttaccttttgctcctattaaaggcaaagttatcaaatgcattcttactacttttggaatggagagaaagctgtttgttttggtaacacccgcttattttttattagttgttagcatatgtatacgagataaaaaataattttaaatatgtaaaatatagtgcttggtatatagtaggtggcctcaatcaatatttgtggaatgaatgagccacacttttttttttttttttttttttttaagacagagtttcactcttgttgcccaggctggagtgcaatggcgctgtctcggctcacagcaacctctgcctcccaggtttaagtgattctcctgcctcagtctcctgagtagcttggattacaggcatgcgccaccatgcctggctaattttgtatttttagtagagatggggcttctccatgttggtcaggctggtcttgaactcctgacctcagatgattcaccctcctcagcctcccaaagtgctaggattacaggcgtgagccaccatgcccggcctgagccacacattttatgatggggcttctattttgactattctttctgtctcttttcatatccactctgtcttaaatgaacattcagaactagggtaccaatgttttctttaatgtttcagatcatccaagcctagaaaacatggaacagatagagaaatttcaggaaaaggcttatgtggaattccaagattatataaccaaaacatatccagatgacacctacaggtatctagagttaaattctatataattaaaataattgaaaaaccttttgtggatctgttatctcattattactactctcacaataattaaatgttttaggcaaccttaactttgaaatactaatgctataaaaagcagtattgcattgttgcaagtacgttacataaaatatttcatccagttcttatattttttataagaggagacttcagcacagagaggttaactttgcttaaggtcacacagtaaatgatagcacctgactgtgacccaagtagtctgactctaaaatccaaactctttttctttggataaaataatgaattttgttagcaaaaggaggataaaaaataatcaagagaccagcctggacaacatggtgaaaccctgtttctacaaaaaaatacaaaaattagcccggcttggtggcgcatgcctgaagtcccagctactcagaaagctgaggtgagactgcaatgagctgtgatcatactcctacgctccaatctgggtgacagagtgagaccctgtctaaaaaatattaaaaaataaaaacaaataccattagattgttttataattaattttgaaacatggtttatgaaattcactccaagctatttctcaccaatattctttgagaaaaattctttttttataagagccactttctttaaagagggatattatagccgaggggttaatcacctggttatagagccagagtacctggatttgaattctgactcctgcacttgctagcttcataaccttgggcatgtttcctcacctataaatggagataatactaatacccactttttacaattattttaaggattaaatcagttaatatatgtacagtgcttaggactgtgcctgtcatacagtaagggctatataagtgtgtttgtttataataaataaaacattttattagtttggcatacttcaaactagtaagataacatttttacatataataatttttttacatatattaaataatgtagatttataagccagtctcatcttaaatatcagccttactttaactcgttttcctattctgctttctaccagttctgtaaaagctgagtaatttgatgtggatgctaagtaatttgaggagtagagcacacagctccaggaagataatcctgggggctgctggtctaatttggtctgaggtgttagagtgcaaggcgttaggacagaaggataaacccaccacagtctttttgaaaaggtggttttgttgtggttgtttttcagcatctttaagttttaaaagttactctatgcctcattatacaaataaatacagtatttaaatttttttcctttgtgactgcagctttctcagttttttacattgttggttacttaaaaataatacattatccttggatagtagttttcaacttataaggcactttgacacaagatagggtcttaccctaagaaacctcactacctggcacagaaattggcagggatcatttcattcatcctcacaacagcactgtgagagacagtaagtggcaagcacacatttatataagtagtgggcagttcaatcaagatttgaacccagcggtcttgattccacattctgtgcttttcccagtaatagcaactattgcctacttccagtagttttttgcagagcaaaaccaagaaaatgtcttatgtcctgataacacaaaacattgccatttttaaaacctgaaatgagttgctaagccattctttttctttttcttgagatagaatattggtctgtcacccaggctggagtgcagtggcatgatctcggctcactgcaacctctgcctcctaggttcaagcaattctcatgattctcttgcctcagcctcccaagtggctggggttataggcacatgccaccatgcctggctaattattttttgtatttttagtagagacaaggtttcaccatgttggccaggctggtcatgcccggctgattttattttattttattattattttttttagtagagatgaggtttcaccatgttggccaggctggtctcgaactcctgacctcaagtgatctgcccacctcagcctcctagaggtgagccactggcacccagccgccattcttaaatgtataacttggcccggcacaatggctcacgcttataatctcagtactttgggaagccaaggcaggaggattgcttgagcccaagagtgtgagaccagcctgggtaatatagtgagaccctgtctctacaaaaaaaaaaaaacaaacacaattagccaggtatagtggcacactcctgtagccacagctacttgggaggctgaggcgggaaggatcacttgagtccaaggaattgaggctgcagtgagctcacaccactgcactccagtttgtgcagcagagcgaggccctctctcaaaaaaaaaaaaaaaattgtataacttgatgcatggtttaacaactcagttccacagtccttacagccaagtggaggcagtacagtgtagcattaagagcagggctttcccctgtggagtctgtcagactgcattaatagccaggtaattgccatatgttctaaggcttgagaatactaaagttttgattttaacttttgaaaatgctatctttattaaattaggccacatgcagaaattactcatatttttctactaaatttctttctggtttacaaccttgttcctctcccttttttctttctttttttaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaattgtgttctagtcatatttaacttcattatgaactagtaaaaatacttaatggtcagaaatccctaaggagttagttccttgcattttactctgccataataatttttgtttaattaccatatcaaaataagattattttatgcttactggtataatgacagtattagaactataggaaataattgaatacatattttttgtcttctctaaatatcatggtgtcccttagcatatactactctcattgctggcagtgagacaggccattcatgatcttaagagttgccatttttaatgtatattattagttacaagcactttatatagcagaaaattgtttttgagaataagctagtgttgatattttaatatttttagcttactgctcgtgtttttgtttttgttttcgtttatagaggtgggtttcactgttgcccaggctggtctcaaactcctgggctcaagtgatcctgcctcagcctcccaaagtactgggattacaggcgcgtgccacggtgcctggccaaatgctgtctttgtggttacctacagcagtcnnnnnnnnnnnnnnnnnnnnggattacaggcgcgtgccaccgtgcctggcctactgctgtctttgaaaataatagagactagccaggtgtagtggctcatgcctataatcccagcactttgggaggctgaggcaggcagattgcttgagctcaggagttcgagaccagcctgggcaatatagcaagacctcgtctctgtaaaaagaaagaaagtaataaagactaattgagcccaaaatgtttcactatttcaaaaaagatatttaaattgttgctctttcattccataaaaaggatctgatctctctcccacttttctgacctgagttagagcttcccaaacctgtcatgtatgggttttagccaatttcttttagatcactaaaaaaactcacccaatatgtcaaataatggatttatcatagccagtacatgttctcaaggcaagtttaaacattattttgaagctattgataattttttaaaataaagaaatattcactgatttttttcactgtaaagcacgggagggctgctttaacaacagtataagaatcagcctgaagccttgttactgctacaacaaattcattttagactcctcggatgtcttccacagtaatttattcttttagcaaacctgatactgataactgtttctttgctttgatttcttgatgaattattttggtatgtttgttgatttttaaagcaaacacggataatgcactcagagtacattttttgtaaagatttttgcaatagaagaaaagtgaagtttttgtggggatgtggattttattgcttactactttatagtaatcaaaagtttgaaaatatcaacttacagtctttaccagtttactaagggaaacttttttccctatttaaaacatgatcttagtcaacaattttatttataattatcagctaaattacatttagtataatactcaaatggaaaaatcagtagtttatacctttataaatacagtttagtaagccaaggaatcagggaaataatcctttaaaataatgtactaatagttaagatgtttcaggtgttttttctgattaaatttgctactatatttggaagactttaaaactatattaaaatgtgacttgcattacaaatttctgtgtcttaccagtatatttgtaaatatattattcattttccttttcagtgattgcttatccttcgtttgttccattgtgctttcatctatagcaagtatagatctgctatattaagaaagctctaataagaatcgccactgatataataggtgactcttaggtggggtgattttaattaaatcatgattttctctctccaggaagagaaaaacatggaaacatttctatgtcctatattttagggttatttacaattcaatttgaagactcccagctaaatactgcagattagcttttgttttcgttcccgaaatctcagtaaaatgtccataaaatataataactacacgaggacaaatggaacag

SEQ ID NO: 17539 - DNA, 218940 bp, Human
tgactttgtggaactcatggtctaagatgtgttctagagtgaggtccaaaaactcttgggagaatcccatactaggggccaaagtcctgctagggtgtgttatggaataacagcaacaaaataatgtcaacagccaatgagcacaggataactacaacacaccatgatgtcataacttggacaaaggcttgtgaccccctgactttggcgcaacatgaaatgagcagaaagtaaggtatattatggaataagccccaaaacttgagagaatcccatgctaagggcttaagccctgaccaagacaagccagacaggaccatgaatgtgtggccatgttatactgagctcatcagcacctgctgagctcctgtgtcacctctaaagccatgcgcacaagttttgcattgagataattgctctactggtttctagatatagttgaattctccacccccactcccactgccctatgacctccagcaaaacaaaagcaggtaggtagtaattgtgttgtgagttaacgatatctatatctttggataataaaatctatatcatttcagtggtagcattggaatatcagttgcccttccccatgaagaaagcacattgttatcgtttaaatcattatcataatcaaaaatatcaaagacccagtcattcatcagtctttccagtgaagtcaactgcctttgttttttgtttgtttatttttgagacagggtctctctctctgtcacccaggttagagtgcagtggcgcgatctggctcactgcaacctccacctcccaggctcaagcgattctcccacctctgcctcctgagtagctgggaatacaggtgctcaccaacatgcccggctaatttttgtgtttttagtacaaacaaggtttcgccttgttggccaggctggtctcgaactcctggcctcaagcgagccccctgcctcagcctcccaaagtgctgggattacaggcgtgggccactacgcccggcctgaaaccaattgcctttgaattcatcctggggaatctgctgaagtggacagtttatgtaaacacaaaaacatcctaatgaatggctgcctcagtaggagtggcagacaaaacacatggtgcacttttcatcaaaaacacacaaggaaaaaatttttcatcatatcttttgtagttgctaataaacttaattcacgcacttgtgtttttttgtgggtttttttttttttgtacacttcttagtaccacaaagaggaagtgctttttctccttcctttaagaaaaagttccagttcaaaccatcagcctctgtaggttgtcttaattgctactttgcactgcactggactatgactgatttttggcacatgctatcatacacaaagttcctgaaataaaatgctccaggatatcctaggaactcttagaaggctttaaaaagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagagagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctaggtaagtggagtgcaggaggccgggggaactgggtgtgtgtcgagaagtttccttgtgctttattgtagcaaaacttgtcataacacaggtatagggctgtttgcctgcgttcataggtggtgtatctttagtttctatcaaatatgcaaatgataaagaaggcttttttaaggagcctaaataaataaatacacccaagtaccaaatgtatagtccagaaggcaaagtgggtgtaagtggcttcgagtggctggctgattctgttgcattgggtggaaaatttttatgtggtacatttagcaaaatgagtgtttgtgaattcatagtcacatagtttcatttatattttgaggaaagactttacattgtgatgaaaaccatgctggagtgtctttccatttgacttttattaatgtttgcttgaacgaatcatgaaatttaattcacaaaacacaaatcagtcctttaaagtgtgcttttaatgatattcttcaattcctttcttatccagtgactctggtgagatgcaatttgatttacaaattaatatgaaggaaaacagaggttttcccccaagatttgaaagatattgtgattcagttattttaatgactgttggtgagaatgatgtacccagagagtatataggatgatagaagtgtattcccatgaaaaagaatcaaatatcttggaaaggagtgagggattttctaaaattctaggctttctgaacccttgactattaccgttttaatttttctcatacaacccataatacttcattaacttgaacgttacataggaacgaggagattctaggtgcagtttgaaatgtagcaaacctgcaggaggccatgtttattttggcaggggtaaaccagtaattaaactttaaaagagttagggttgtgtggttgaaaactgctaaaatgagcaaaccatctttccatgctttctgtggctgaagatttaggaaattagatgggtttattgctttctgataaagcgaaatctcctactcctgcaactgaatctgtggctcttgaaaactcttgtaagatttctcagcacttagggtttaaacaagggtcctctgctgaaattccaaacaagaggaaaaattctatgggcatgccaaaagactacaggctacgtgcaacgtgactgcaaggttaggttttgcaaatgctcccaaacttaaaaatcccaataattattgtttatgtaaaaatatgtactctttttaacgatattaccactgcacgaaacttttacaaaactctacttttatgattacctcctgaggccgtggcatatcggttgaaagattctccgcggcagcaaatctttgttctttcagagaaaattattctcaggaaatagtgccgatgtttttagagcaaagtaaaattcatcaagccagacgctactattatggataaggaggcctgcataaaatatgaaagagaactttccagcgtgcccaataacctggctctcaccttgactctctaagaggagctcaaatgatgttagagaataagggcaaactgaggctgtggcctctacaactttgcttctcaaaatggggtctgtggaccagcagcattagcatcactggggagcttgagctccaccccagacccgctgattcacaatctgcattttcacaagacccccaggggactgtttgcaaatgcaggtttgagaagcattgcttcaggtgaccatatctatttggatgtatacattcagggacacttctttttgtcaaatatttctgcactattttagaatcacccccttaccccctctccccgtccctctcctcaactctgccacccacctccactctgcacccaggcaaagtgcttgtctgaaaagctccagggacctgcctggcaatgctcttcatgacaatattctagttagggtcgtcgtctcttcaaggggcttcctgcttgactttgtggtatatttctctgcctgtccacattcacttacatgcctgcaatttctagcatcccttcgtacctcatctttgtatctgaggctctgggataatctctcctcgcaaccttagtgcttctacagtaagagtgattgccagtggtcttgcagtggcttccgagaagctacagagcaccagaatggaaaacctttcttcttctccttcccctctctttcctccccacaatctgtttctcagatgcactggctggcaaactttttctgccaagagccagatagatagtgaatatatttggctctgtgggccatacggcctcttgcaactactcaattctgctgttgttgcacaaaagcatccatagacaatatgtacacaaatgggcatggctgtgtgccaagaaaatctgatttctagacactgaaattggaatgttatatacttttcatatgtcatgaaatattattttcctttttatttttcctgaccatgaaaaaaatgtaaaagccattcatagctcatgggctgtacagaaacaggcaatggatttgacctacaggccatagtttgctgacccctgctttctggccattcttatgctcttgatctgtggatgactccactgcatcctaagggcatttcctctggttatagagaaatctacaatgagaaaccaaactgctatttacatgtattttttaaagctcctaaccattcaaaagtaacatcttaatttttatattaaaaatattttctttattgtctctatttcattcacttacaccttcacattatctgggcttattgatcctcatttatttggagaattttaaaataaccccatccatggagataatgctcttccttgaggggttgggtctgtcagtgtcccaattaattaattatacacacacacacacacacacacacacacacacgtacatatatatatatatatatatttttttttttttttttttttttgagacggagtctcactctgtcacccaggctggagtgcagtggtgcgatcttggctcgctacaacctccgcctcctgggttcaagcaattatcctgcctcagcctcctgagtagctgggattacaggcgtgcaccaccacgcccagctaagatttgtatttttagtagagatggggtttcaccatgttggccaggctggtctcgaactcctgacctcaggtgatccgcccacctcggccacccaaagtgctgggattgcaggcctgagccaccgtgcctggcctaattagttatatttaaaaccttccttctgctcatcgttagataaagatacctgattttacttcttcctttgaggttttgggtcaagaattatctctcatgaaaggaataagtctttaacgattttattagctattttgttttttaaaataaggctaggatcaagaaggtattgtccagaattataaaaatattatttacaataaagcttatttttgcattatataaaagaacacatgctcactaaagaacattaggtcaacatataaaaattgactgatggggaaaattccccctgaggttctgccacccaggcatattggaatattgcacactaatctttatgctgcccatatatatttttttacataactttttttttttttttgctttatacagaaatcaaaacacacctttttgctaagaaacttattttcttaaaaacaggactgagatgggccaggcgcagtggctcacacctgtaatcccagcactttgggaggtcgaggcgggcggatcatgaggttaggagatcgagaccatcctggctaacacggtgaaaccccatctccactaaaaaatacaaaaaaattagccgggcgtggtggcgggtgcctgtagtcccagctactcgggaggctgaggcaggagaatggcgtgaacccgggaggcagagcttgcagtgagccaagatcaccccactgcactccagcctgggtgacagagtgagactcttgtctcgaaaaaaaaaaaaaaaataggactgagatgtttcatcggcagttttcttgaatctctaatgtaacacaatgcaatgcaaagaggctgtttggaggatggcagcagagaaaaagaacaaaggaaaagcaggctccatttagagagtgggttaataaataataaaaactcgccacactgggtagtaatctacaggtcttccatctctagcagaaatataggtactgccgagctttctgccacagagggccttggtccccattcacctcccaccatccctctccccatggccacatctccaaatgattcattgtttctgctcacagagcacagcaagaatgaattccccagaatttcctcagctactacaaatacttttgaaatcttaaactaacatctgctaatgcccaggtgctacctggggttgacaaattgggcacccttctgtacttctgcagacacctatttagataatgttgccaggcagatggagatattaagccattggtgaaaagctatttcaattttagacttttttttttttggagtgggggaagggaggaaatagctggaagcttggtccacaaagttgcaaatgtctggtagctaagctgggcctggtgggcggagagtttgtggggttcagggcaggcggacaatgactgttgctatcaataggtgattgagatatgttcagtatattctttacccctaccccttttttggtccgtatctgtatggatggtttagataagatccagaactctaaaagccaaacatgctagctttctatttccactctgattggctccaaatgacatagtttaaaagtttcaattttcccatcttgaacatgggcatggagttataaaccaatagagtgaaagtatgagacttaaaccactgataattggaggctgaagcgactttagagagtgtctcgcccagtggtgctcatatttgagcatgtatcggaatcacctggggggcttgttaaaccgcagatggctgggccccacccccagggtttctgagtcaagatcttggagtggctttctaacaagcttccaggtgcagcagcagcagctgctgctgctctagagaccacactcttaggagctctggtctagttatactcacttatcttacgtacgagagaactgagtttcaaagcaaccaagagtcttaccaaggttatttagctagcagctagagtctggtttcgtgacattgaaccaactgggttttggaataccgtgtcaacactgagaaggatgaactgatatcaaatatcttgcgtatgtttccgagggtggtttaccggatggtggtctgctacaactcagccatttattgtggtctgttttttcagtgagtcaaggtctcttaagtctccaagctaaacaggagtactgcctgaagccagaatgcatcgaagcgggtaagtcacagttttccatcctgtgtcaagttataattatggtaccttgggaagtggaagagaagacaggtggtatttttagtattctgtttgcttgaggtttaccaagtacgaaatgcaattttgaagaaattttaagtttattttcaagttttggtgtgaaacagtggagcttaggtttcctgttttctttttccttgcaaaaactgtggtattctaagcgttgttacaaggaaatcaggaaggggcttggaaggctgaatggcctctcttaagacccacaggcagagaacattggtcttcctatggctccgctggctatgaattcctctttaccttaagcagttgcctatcttctggtctgtgagtctgacttgcctgcctctaagcaaggctcctttgcaaataaatccacacttccattgtcagtgggagtcccttttctcttttttaaaaattgagacggagtcttgctctgtcgcccaggctgtcacgatctcagctcactgcatcctccacctcctgggctcaagtgattctcctgcctcagcctccctagtagctgggattacaagtgcccaccaccacgcccggctgatttttgtatttctagtagagacggagtttcaccttgttggccacactgatctcgaactcctgacctcaagtgatccacccgccttggcctcccaaagtgctgggattacaggcaagagccactgtgcccggctgggaatctcttttttctgtcacacgttgcaagtcaaacttctcttgaggtgaccaggctgtgtatcagtggatatcccagggtgaagatgagtgtttaaagtggccgcagttttgccacagtgtcttatcccatcaaactcatggctggagttgccccaaaagcagcaacagggaaattcccatgagggaatatcccatcccgagatggggccagttgggattccaaagaaagaagcactaaataaatgccagggcggccggtcagtccaaagcatttattagtgcaacttatgttgaaagtgctgcagtgtatcctcaagacagtgagagaaaaggggtgttctacttagggcattagggtgtggagactatatgcgggtttaaggaatttggctcagagccggtactagtttctttcagtgttttgtgcatcaacctagatacctttatcagtgcctgggaatgttcaagggtccagtctggacctaagcctgctgggaaaaaccagcagctggaattagccgggcatggtggctcatgcctgtaatctcagttactcgggaggctgaggcatgagaattgcttgagcccaggaggcggaggctgcagtgagctgagattgcaccattgcactccagcctcggtgacagagggaacttctgtctcaaaaaaaacaaaacaaaacaaacctgcaggtggctgggtcacagagtggtcaggggattgtgtaatttttggttaggacaccgaaagcggcggtggggaggtgaggggaaacctgggggtcccacacacagctattagatttccctcctaaatcagtgttagggcctagatttcagggagccagattctagccctcaccctcattctttaagtgggcagggacacttttttcctttttccaaaaggaaagtcatcaaacaagcatgtggccctttcactttcctcttggccttaaaaggttaatgaacaaattcaccaaatatttgttgcacatgaggtactgagttaggttttggaaatagagcagtgaaccaggtatgggaagaaagacaataaggcaattaatacaatgagaaaattatgaaactgggtgtggtgacacgtgcctttagttccagccacatgggaggctgaggcttgagccctggagttggaggccagcctgggcaaattagtgagaccccatctctgaaagaaagaaagaggaatatcagtcagtggaaaatgttatagagaaaattaaaaaaaagatagaacaatgtgatagcaagtgacaggatggctagattgaaaagccggaggacatgaccttggaggtgacctttgaatgatgaggagggaactgctgtgtgaagactgaggcaagggctttccaggtggggggaacagatggggcaaagggtgcatagaagcatgaacttggtggacttgaggaacgggaggagcttgctaggtgaggtgcaagtgatgaggagtcaatgggggacccaagtgccagtgagtttgggctttccttaagtgtgctcgaaagcctctggaggcttttatgaaagagaatacatcttaggagcatttcaaaagatgtctcggtggagggctcagttagagggagtctttcttgatggagaagagaccatagggagcaagaatagaagaaggtgactcaggtaggtttatttctgtacgccaggtgacagacgatgctgtcttgaattcaagagatggagagggagaatgggggaaggtttaggaggtagagggcctattgaaggattcgatgcaggctgtgaacaaaagcagacaattgtgggtgacgcttagatttttggtgatggttgggcagtggtgtttattgagatgggaaacacttaggtgaaagagcttgtaaattcggagaccttatacaaaggtagtggcttagataattatgttagtagagttctttttttgttccattcttaagtgatctctctctctctctctctctctctatatatatatatatatatatatatatatatatatattttaaccaggctgtgtgttgagtgccttacaggcaccatctcataaaaccttcataagacccctatgaagtcagtgctatcaccagcctcactgacagatgaggaaatggaggcttctggaggctaaataactgcccagggtctcatcctgagttagtagcagagctggacttcgtgtccatgtctggctcctttccgtcttttccttggtgatatggggccatgccaggcaactctttttggccctggaactatctgagaactcccaggccctttcctgctccaggcttgagtagttgacctgaggttttctccagtggtgagagattgtcatggagtggggtgagagagcaggcggaactatcaggacaggttttagagtttatgtcacctggtgctttggctgtggtggggttcttgcagatgtgtgaaatgggaatttttgagctcataaattttcaacttgagtttagaacacttttttgtatggaaggccacttatttcatgagttttagttctgtattatgaatcataataatgcaagactaaaacttacagactgacattcaaagatgttgccttctgccagctagtgtgttctgccttgctgtcctgtttttaattttcacattggcgaatggctttctaatgttgaaaaaaaatattgattttgctgtttctggagtgaaaggctcaccaaagacccagttctctttagtgtaacgtgagcctcagtgtgcccaggggtctgcagaacagctgtgagtacacatggcaggagaattacggccaagccagggccttaaacaagaggctgtgcgtgcgtgggcgtgcatgctgaaagttcagaagactagagtgtttgatcgccttctggaccatttctgagcaggtgccaaccacttctgagatgcttcctctccataactctcctcttctctgtgtcctcttattttaatccctctttcaaaataagagctgtgcaaagaatgcaaagaaacaaggaaagggcatgcatgctcatgatcacagataagggcagacaggctgactgggtttgaagcatgatttagctatttacaagccacatgatcctgggctaaatatatagccacgctaagcctcagtctcaccaagtgtgaaatgggaataacaggttttacttatactagtcgtgagaataaaagaaaataataatggactgggcacggtggctctcgcctgccaccccagcactttgggacgctgaggcggacagatcacttcaggccaggagttcaagaccagtctggccaacatggtgaaactccatgtctactaaaaatacaaaaattagccaggcgtggtggcgcaagtctgtaatcccagctacctgggaggccgaggcaggacaatcacttgaacctgggaggtggaggttgcagtgagccgagattgcaggttgaatctgcacttcaaccccaagggggaggttgcagttcagcctgggcaacatagtgagactccgcctcaaaaaaaaaaaattagaaaaagaaaataataatggtagtagcagtaatttaggttcacaatgctgattcttaaccccaaacccagaaaacgatgtaactctcagttggcaagatgggggcctgatctcaattcctttgatggcaaaattggatcttaactcatgtgaggctgcttcagatttcatttatcctacttacaagaatatgcatatgtttccctatagaaacattaatgcacttgcttcaggcctgccactccagccattgctgaagtattacatgatctgtggttatatgcaatgtatttattttctaaaatctgaaaaatctatgagctctgaaacatatctaacctcaagagtttcagataagtgattgtggaattacagttcccagatttagctaactacatacatacgtacatacaggatgcttagtgaaatttgattgcagatatacaatgactactttttctggtgtatgtctcatggactatttggtacctacttattctaaaaggtggttgtttatcagaaattcagacttcactgggcatcatgcatttatatggtaatgtgcccaacactattctaagcactttacatatatttaatttgcataatgattccatggggtgctattattatccccattttcaggtgaggaaactaagacacaggttaaatcacctgcctaaggtgtcttagctgctgcatggtgtttctctcattcaaacacaagtggtctgactagagtttgtgacgataccatattgctaaaaaagggcttagcgtaggtcctggcaaaaaggaaatactcaatattggtgattttattattgttaattattattattactactctctcccttcatccttgattaaatctaaaaacagaggctggtatttagggaggatgcctccacctctaccacacaaacagcaactggtgactgtgtgacaattaaccttatatatagtgacttggaagagtacacagcctgagctttcacagatttccttcatcatcatatttcttttattaaaacaagactctgggttttctccatggagctgagtagggggaaaggcgttttggtgtcttgacaactatggtcccttgcaatttgaagtcacagttcccctgcagaaagtgcagccctgtgccccgctgtgaattgtgaatgatgaattgggaggctgcaactagagttttctcactcagcaggcttctttccaaattcaatgtgagtgatgtatttcccaacttttgtatcagggccaaggtcagagctgaccttgcagtttttctaggtacctgcaagaatactggcgagatggagaggatacatttgagggttgggggcagggaaagtttgagaaggaggctggaaaacagtgtactcatgtgggtaaaaatgcgtgtgagggctcccctgtgtgactgtaaatgttgtgtgggactgagacgtgtgatccatgtctctgaggtgtcacatagcagattcattctgtggctgcatacagtaactataaataccaaccaaaagaaagattttgttatgtcctagcacatttgcacattaaatattaatgataaaatagtagcagtaagtggccgggcacggtggctcacgcctgtaatcccagcactttgggaggccaaggtgggtggatcatgagatcaggagatcgagaccatcctggctaatgtggtgaaacctgtctctactaaaaatacaaaaaaaaattagccgggcgtggtggcgggtgcctgtagtcccagctacttgggaggcagaggcagcagaatggcgtgaacctgggaggcagaatttgcagtgagctgagatcacgccactgcactccagcctgggcgacagagcaagactctgtctcaaaaaataaataaataaataaataaataataaaaaataaaaaataaaaaagtagcagtaattaaaaatgtaattagagacaactgatgctagttctgaagcacgaaaatgttaagccaatttgaaatttatcaaacttctaagtctttatttttatttatttttttatttttttaagagacggggttttgccatgttgcccaggctggtctcgaactcctaggctcaagtgatctgcccacctcagactcccaaaatgctgggattacaggcatgagccacagtgtttggcttctaaaccaattttttgctagtgttttttttttgtgtgtgtgtgtgtgttgttgggggaggtttgaaaatggtggggattttgaggccctatagaaattagaatgtttttatattattcacttcattgaagacaaaaggctgtttgaaatttttgtagaaagtctaggctggagaaatatctagccttatttttaaacctggaggaaccacacatgtaaccaaactgtaagatatgtatctaaattgacacagattgtacttttttggggcagttcattcatatttagctgaaatctctttgggttttcattacttcaaacaaaaatatattctggcattatttaaagtatgaaaattgcccagaatgtcatcttttcaatgtcattaaaatattgtctggttttttaaaaaaatcaattggtacataactttgtgctagaatggtagccagcaattgcatggcagctggaagagcattggagttcaatattgggaattctcattttgtaatgaagggttttcttttaaagttcatggttacatatttatgcacacatctcctacctgtgggttatcttctatatgtaattgtgtatgggcttatgaaagaggaaaaaaatggtagatcagtctattgtgtctttctgttaacttatacacatactcagttctactgctagacctgggtccctcatttagaacaccctactttggccctcctctggccatgcctctccttcagccaaggcgtctgtggagccaagtaggcagccctctccttctacaccccagaattccctgcctgatggccccaagctcccttccaggatctctgtgagtctcttctggggcttcatttctctgagagttacactgaatatcaaggagctcaagaatttgaaagtattttgtaaatataacttttaaatatttagatagatgacatatgaacttctgtttccattagccttcactgtgaggcaaaccacccaaaccatagaggcctggaacaaaaatgattggatatttctcatgattttgtggatttggtggatggtttctctgccgatttttgcctaggctcatttgtgccactgcattcagctagatgggcgcctggactggaaggcgaatgatggcctcagtcaatgcctggcagttgtgctggcttggttcttctctatgtgtcctcttgtcctccaggaggctgcttcaaagggcagctaaagggctccattcaaagggagttaatatggaaggtgcaaggcctcttaaggcttagctttgaaactcacagaaagttacttctgccaattctgttggtcaaagcaagtgacaaggtcagtccaaattccaggcaggggaaatagactctaccacttgatgggaagagcagcaaggtcactttgcagaaggacaagcaggatagaagaaatagtcacagttatctttgcaaacaattgaccacacgctctatttgtattcttgtcccataccccacagatgttagggatggccctgcaaaaaccagtgatgataataccaccaaacttttatccattcccttttttttttttttttttttgagagacaggttcactctgtcaccccaggctggactgcagtggtgcgatctcagctcactgcaacctctgcctcctaggtttaagtaattctcctgcctcagcctctgagtagctgggattacaggcatgcatcaccatatctggctaatttttgtatttttagtagagatgggttttcaccatgttggccagactggtctcaaactcctgacctgaggtggtccacctgcctcggcctcctaaagtgctgggattacaggcatgagcccttgcacccggcctatccattcactttgaatgtagtcatttcatatagtgaggtagattcagagagtttatttaaggggaaatataaatgccaaggcttggaaactggttgatatggaattgttgtttaatttggaaaagaacagtatacaacattcagtgcttgtcattaatcctatgattttctttctaaatagctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaagggtaagtttctactggggtttggtgatacactttatagagagcaatatttgacaggaaaaacatagtttgggatttgaagcatgacttctcactttttaactaccatgctaaattcatttccaagaatttttaaaatgaaagattgaaaggaaagtttgcagaattctggactcccagatctcaacataagactaatgtaggttgttatgttcatgtttggtaatagtaaattctactgccaaaggataaagagcatttgattgagattggaagcaaaggaatagttaatgaaaattatatcaatatactcatttgttgtattcagagtaaacttcatttcttgctcattgtgtcctggattttcatggcttacaaaatgtacttaacacctcatcatcttttgacatcacttttgagaactctggatgaccttgtggttgtcatattgttcttgttaacttctaagttggctctagggagattcacttttctcccatggccactctagcaatgacaagctcacacacacatactcacacgtggatgcatagaaacatacatatgttctcaaatacattcccctgccccccgccaaagttggaaatgtctgttattggaggatattctgttagcattggatctaatttttatgctaagctattggagaaggccacctcaggagggaagtaggaagatttcaaagccagataaggtaattattttgagaaggcaaaaatagtatggtttttttttttggctctttttgacaactgtgagttacaccatgtaacttgcattcagtaacacctacaaagaactcctgagaaattataaaaatcattttcccttcccatttacattttcccaagattttaaatacatgaaaattaaatatgtatcattttacaataagtaaaactcttggcaaaataaataattagatacctattgtcaattgtaaggaaaaatgtacttaaatttcacaactagatataaatcacatggacttatattttctattaggagacccaaatttagtcttggaaaattataaatgggaatttacaaggatgtcagggttttctcctaacccaaaaggaaaattctcatactataaaatcataaataagaccttgaggagtgagtttactaatacttttttccctgtagaacattaattcatgttggtctttgatttaccattcttgtccatttcctatttcccttctctggcttttcttaatagacagatgtgtacacacacatgtgcacacacacacacacgcgcgcacagtcatgcatacagaaacattactgaaagataagaaaactacaagatttccaggcatatgctccttttgcatttgttataacccaaagatttctatattcaggacatgaagtggttaacgataacttaaataactttccaggggtgtctggaattttaacataaaagttaaaatcagtgtcaatatgctttgtttgaggagggtactgtctacaggctccttcaaaatcaatagaaatgcaagtaaattgttaagcacagggtttttgtatttgctagcttccttttaaaaatcaaaaattttatttctcagctccattgaagaaataaaaaaagagcaaaaattagaagaaaggtcgctcataaatccgtcacaagaaataactgctaataaagcaactggggatatttctttccaggttttgttgcatgtgtgggtccatatgcataacttcatatgcacacctatatattgtaaaaattagctgatattatacatactactctaacttaatttttaaaattagttggtattatacatactactctgtaacttaaaactatgcattcctcatagacatagattatgtcagtagataacttttcttttctttccttttctcttttcttttctttcctcttgtcacccaggctggagtgcaatggcacgatctcggctcactgcaacctccgcctcctgggttcaaacgagcgattctcctgcctcagcctcccgagtagctgggattacaggcacttgccaccacgcctggctaatttttgtattttttagtagagatggggtttcaccatgttggtcaggctagtctcgaactcctgacctcaagtgattggcctgcctcagcctcccaaagtgctggggttacaggcatgagccaccgcgcctggccaacttttcttattataaataacactgtaataaacatccttgtgtacacatctttatgtccttatctaaatgtatccttaggataaatttccagaaatggaattattgggttgaaagagtactctaaatttcatttttgatgcatatagccaaattgccttttagaaagtttatttcagctgggtacggtggctcatgcctgtaattccagcactttgggaggccgaggcaggtggattatctgaggtcacgagttcaagaccagcctaacatagcgaaaccccggctctactaaaaataaaaaaattagccaggcatggtggcacctgtaatcccagctactcagaaggctgaggcaggtgaatcacttgaaccaggagggagagattgcagtgagccaagatcatgccattgcactccagccggggcaacaagaatgaaactctgtctcaaaaaaaaaaaaagtttgtttctaggtctttatatttttttgatgttttaaaggataactttttcccatcaactgctttctgtggtataaagtagaagtcatcaaaccattgccagtaggcaaaatccagtccactgcctggaagttttattggaacacagccacatccattcgcttatgcattattaatggctgcttttgcactccaatggtacagtcgaatagttgcaatggaaactggatggcccaaaaagcctaaaatatttactctttgacctttatagacagtttgccaatccctgatgcctagtataaagtaaagctttgaatgtatgtattggattcaattagaactgtcttattagttgatagctccttggtagcttctttgaatttcttagatagttaataaagttaagaaataccagaacaggctgagcgtggtggctaacacctgtaatcccagcactttggaagaacaaggcgggtggatcaccttcaggtcagaatttgagaccagcctggccaacatggtgaaacctcgtctctaccaaaaatacaaaaaaaattagccacgcatggtggaaatcccagctcctcaggaggctgaggcaggagaactgcttgaacccaggaggcggaggttgcagtgagctgagattgcaccactgcactccagtctgggcgacagagtgagacttcatctcaggaaaaaaaaaaaaaaaaaaaacagaacggtgttgaaataatagcaatgataatgggtgtaattttcttatgccttgcttgggtggtaatgcctccagtatttcccctgaaaacgtacactttttttgtttgtttgttttagatagttattcttttttgtgttctgttgttcctagtttgcaaaaagctgctgctcaagaaaaatgcctctttgccatttatcaagagactcagatggagtatctcttttaacttatcttgatttacccatgctgaactaaacttataattttgaaataaatcctgcctattaatggtttgtattttttaagacattaccagaattgaagaagctagcattttgtttcacacatttgtctctatatttatgattcatattggtttgtgattgttttgtgtgctaggtttgtcgaattctgttattaagattgtgctggccttgtcaaacaaagtgggaggcttcctatatgtgtttctatgctctgggaaagacataattcaataaatcccaagttactctatgacaagcactgtaaaggccaaattcacaaactgacattagggttcttgcttcatatgtcaagaaggagagcaaatggtggaaaaggatctcttaaaattagtattttttaacaaaaataggtaaaatataaaatagctggacgcagtggctcttgcctgtaatcccaccactttgggaggctgaggcaggtggattgcttgaggtcaggagttcaagaccagcctggccaatgtggcgaaaccctgtttttcctaaaaatacaaaaatcagctgggtgtggtggcaggtgcctgtaatcccagctacttaggaggctgaggcaggagaatcgcttgaacccaagaggcggaggttgcattgagccaagatggtgccagtgcactccagtctgagtgacagagtaaaattctatctcaaaaaaaacaaaaaacaaccgcataaaatatctattagatttaaaaactttttattttgagataattcaaactttgataagttgaacaaatagcacaaggaacttctatgtaccctttacccagattccctgattattaccatttactacatttgttctattatatatatactttcattttccatctgtaaatatatatatagtgtatcatcctctacatatatacttatatacttttatacacatgggcagatagtatatgataaaataatatatctataaatgtagagataaatatcgatataaatacagatacatagatttttttctgaactctgcaagtatgttacagatgattagatattcttaaagtgtatagaggttttcaaatgtcaaatgtgctaaaaatcttatttcttttcctgaaacactgaatctttaaattctatctatatcttttaatatattctatatctatctatttatgtgtctgtcagtctagctacctagtcatccaactatctattcatttatcattctatccaggtaatacaggctcatcgtagaccaaccacaaataaacagcaaaagaagcatacttcaccacccagcaataacaactttttaaatgcaaatataggtataaaattatacatatcttctaagggatcatataatacattctatttaattaatttatttacttatttatttatgacagagccttgccctgttgcccaggctggaagtgcagtagcacgatttcagctcactgcaacctctgccttttgggttcaagtgtttctcatgcctcagcctcccaagtagctgggattacacgcatgcgccaccatggccagatcatttttatatttttaatagagacagggtttcgccatgtttgccaggctagtctcaaattcctggtcacaggtgatccgcctgcctcagcctccccaagtgctgggattacaggtgtgagctaccgtactcagccggatatactataatttacttaatcaatgcctgtgttatttaggttattttttatgttttcttcattgtaagccacttggaacatgagtttagaaacatcaagagctggatttgaatcctgattccctttcatttaccctctatatcactttgggccaattactgatctcacctagttcagttttcttatctttaaaatggagataagaatatacatatcagagtatgcaaaggcatacagagtggtgtaatagaccttggactcaaaggggggagggtgggagaagggtgaggaataaaagaactacaggttgtgtacaaaatacactacttggtgacaggtacactaaaatctcagacctcaccattatccagttaacctacataaccaaaaactacttgtaccctaaaagctattgaaataaaaaatatatatattttgaaaaaaggggaaaaaaaggaatacccatatcatagggattttgtgaagattaaaggagatgatttatataaattacccagtccagttcctggcacatagcaggccttccgtaaatatttgtcctttgttcctcgctttgtttcaaagatagttctaagattcatgaagtaatgtctatcaaatgctttaagttttattctggtattatcctttgtgtaaatatcatgtgctttcaaaaatattgaatactgtcaagatatttttgctcactcttgataaaaagagagaacatcccaaaataaaacccaatactaccaatcgaaagaataccattttcttaaggctgatagaaaacacacagatacggctgtccaatttgtgaaataaaatggacttgacagacctggctgatgaaaaattgccctctactgaagtgagcaacctggctttgtgaatttttttctttaaatggcatataagactcagattccgacttgggaaataaaattacttcctattctctccaagaagtgagattttttaaaaagccgaatataatcatatgtttgtcttaagatccacattctataaaccccccaaatttgtcttcatgtgaccatgaagaagacacagcatgcattgcttatgaatgagcagatggaaatttagcaaatgagcacttatgaaacatgaggcaatgaatgagatagaacacttatgtcacacagaagacagatgactcaaggtacggccagatcatctctattacggaatagctatctttgccaatattttgtgaagaaatgcaatatattattttcaagcccagcttcagcagaacaataagatgaagtagggactctgcattaatgaacagaaagagatgattgtgattcatagaccatttatttgtaaataccttctggctgagattcaaatagttctcgtaattaaacaccaccccctccccaaataatctttttttctgtaaatgatcctagccaaatcatcttttgcagacaatggaaatctgaaaacttcagttcctataaagtcatttagtgattaggaagttcagattattgaaaacagtgaattgtcattttcctcatgttgtatgtatagtagagctttgacttcataaagttcttaattttttaaaattattttattattattttttgagatggagtttcactcttgttgcccaggctggagtacagtggcaccatctcacctcactgcaacctccacttcccaggttcaggtgattctcctgccttggcctccctagtagctgggattacaggcgcctgccaccatgcccagctaatttttgtatttttagtagagacagagtttcctcatgtcggccaggctggtcttgaactcttgacctcaggtgatccgcccacctcagcctcccaaagtgctgggattacaggtgtgagccaccgcacccggccacttcatgaagttctttgaaacaagtaatatcagactagcaaatgtggggatgcagtggggaagtgctaaggaccaagcatccattgtggtgggctttttattactagtgaaaactcagcttctgtaattttgtgtgagtctcctatgtaaactgggtgcaccccttcagagaagattcccatttttctcagatcatgctggctctttttcacgtggccacatagaaagcaacaaattgccaagttacaaatatatcaccacagtcctatatgtgcaaaggggtgctgcatgaagatttgggcctgtattgaagacttttggaatgtgagattaaataattttacttgaaaagtttgttgttattcatagttttcctgctctgatataccgtttgagtattggtaggtgtgcgtgctgcatggagtgtggggagaaggtaagaagttgtcagattagggctgggcgtggtgactcacacctgtagtcccagcactttgggaagccgaggcggttgggtcacttgagatcaggagttcaagaccagcctggccaacatggtgaaaccccatctctactaaaaacagaaaaaattagctgtgcatggtggcgggcgcctgtaatcccagctacctcagaggctgaggcaggagaattgcatgaacctgggaggcagaggttgcagtgagccaagatagcaccactgcactccagtccgggcaacagagagagactccagctcaaaaaaaaaacaaaacaaaacaaaaaaaacagacctagtgctagatatgaaatattcccaacacaaaaataatgataaatgtttgaagcaatggatatcccaattacccagatttgatcattacacattgtattcttgtatcagataatcacatgtaccacataaatatgtaaactataatgtatccataatcattgaaaattggaaaactggacaaatatagaaatttttttttctgaaggctctgtggaagatgtgaatgtatctctaggatatgttctctttctaaatagctaaatgaactaaagaggccatcagagtgactactgtgtgtaaaagcttgtgttttggtagttctgacagtcagcctgtcaggttttctttttttttttgaggcggagtctcgctctgtcacccaggctagagtgcactggcacgatctcggctcaccgcaacctctgcctcccgggttcaagcaattctcctgcctcagcttcctgagtagctgggattataggcatgtgccacatgcccagctaatttttgtatttttagtagagacggtgttttgccgtgttggccaggctggtcttaaactccgatctcagttgatccacctgcctctgcctcccaaagtgctgggattacaggtgtgagccaccgctcccagacaggttttcttcttatgtgtgcttttccaccctcagtgcatgtccttgtcttactttttgactcttgtctgctctaagccttccattttaagatctgatctcttcccctattgctttaatgtagctcctctgtcattagcggtttctactacaaataagttgggtatgcttggtaagaaccagctctgttcattccattcattctaagttgtatgatattcagctggcgggaagttcaccacttcaaatagattgaaatgcacaacattttgattgtactactctgtgaaaatagtcttatttaccaagcatttacttttattcctggcactaattgctttcaatcgtaagtaacagacagcccaactcaaactggcttaaacaataaaatatgctgattcatgtaaccaaaaagcctagtaattatgtagacttcaggtaagggctgatccagcaactgaaccatgtcattaaggatcacattttttttttctttctctctctactctgacatccaccatgtcgtatttccttctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaatcccagctactgggaggttgcagtgagccgaaatcgctccactgcactccagcctgcgtgacagagcgagactctgtctcaaaataataataataataataataataataataataataataataatgtcccctagactatcctcatggaaattacaatctgcatcttatgagtgttcccataggtattgtaatcaatactctagaactgtcctgctcagcatggtagccgctagccactgtggcttttgggtacctgaaaatatggctaggtggaattgaggtgtgatgtaagtgtaaaatatacaccaaattttaaatacttcattttaaaaaatgaaagcactctcattaattgatagtttcatttataatcagtaattgcatgtagaaataatattttgagttatattaaggcaaataggatataccattaaacatctcacctgtttctttttacttatttaaatttagctacaagaaaattaaaaattacgtatgtggtttgggtaatatttctaccagacagcattgctctagagccctgaacaggctattagcaaggtgaaatatctgggaataactcaaatggatttcagtgctagagaaagctcagagaacacctttatttaaaatagtcctctggctgggtgccgtggctcacggctgtaatcctagcactttgagaggtcaaggtgggcagatcacttgaagccaggagtttgagaccagcctggccaacagaataaaaaacaacaacaaaaattagccagacctggtggcatgtatctgtagtcccagctactcaggagctgaggtgggaggatcacttgagctggggaggccaaggttgcagtgagccaagactgcacaactgcacttcatccagggcaacagagcgagactcgatctcaaagaaaaaaaaaagaaagtcccctacccaatctccaatccctttgtatttgtgtcctttgtggtccttataaccatctgaaatgatgtcatttgtgtacatgcttgctgttcttctcacttacacccatccccgctcctgtagatgttaaactccatgagaaccagccccttgtccattttgggtgtcactgtgaccgcagcaccaagcatagtgcctgccataggaggtgctcagtaaatacttcctaaagaaaggaagaaaagaatgtgccctctgtggttggctgagtgcagttgtgggggcagctgactgggtagggaggagtggctttttcttctccgtttcactccatctcctcctgtgcccacagtcccagaagactcttgagatgcaactggggcttgcccctgaaaggaggggaagcaaaatcatcagtcattttccatttgtgttctgggcctcaggaaggcaggacagggacgtgggcaatgagacaggcctgggcccttctaagactccctgttggtgggatctgatgcaagttacagacaagaaaaataacttgcaggtggttcaagtttgggttctgagaaaagaaaaaaaaaaagggattctgccacttatcagctgtgtggccatgggcaaactacttctttctgagcctccgtttcttatctggtgatactgttggacaaatccaatgagatgcgtagaaagtcttctacacatggttcaataaatggaatccgttgctactgttaatttcacaaggattaatgttttaaaagcacttggcacatagtagatgcttaagaaatgttctgcagccaaataaaaataacttagaagaagaccttgacatcactattaaaataaaatattgtgatctagttttttttctcaaactccccacatgcctgtaaataaggaagctggttctgaaagaggcaaggctggagataaaaaacagcagatgaggacatttgtacgtattcccaacttgcattgccagaccttggtcatgaccctaaaccctggacggttttgataatctaattgtcagataacacattcattggaggccatgtgatttttaaatcactcccacaggaagagaaagaagaggaaaagggaattggtaaaaataagaataactatcctcttacgccgctctagagcttctctggatgccacttaaaaaaattctaccaatttcccttcttttttcggacatggagtctcactctgtcgccgaggctggagtgcagcagcacgatctcggctcactgcaacctctgcctccccgattcaaatgattctcctgcctcagcctcccgagtagctgggattacaggcgcctgccaccacgcctggctaatttttatatttttagtagagacagggtttcaacatgttggccaggctggtcttgaacacctgacctcaggttttccacctgcctcggcttcccaaagtgttgggattacaggtgtgagccagcgtgcacagccctcatttccctttgttctctcttctttcttatccctaggggatccttaacttgagtccacagtcttcccacaagagggctgtcaatacaattcaggtacttggatgggaaaaaattgcacctttgttttcactaacctctcacagaattttagcattttctttaattatgaatgtaggcaacaaaccctggtactattagcagtgcctgtgactttgttaccaacagcaatcatgattatttttctaccttattgcagatgttgcaggtatcttgaaatgttatgtacacgtatcactacttcaaaattatagtagttgtcagactcaaagttagggcttggtatttaatgaattaatcaaatagcacatatatatatttcacacagtaaaaaaagttgtgctgtgttttgaaatacctgtttttctttgtaagcctatgtttcttattttatgtacttataaacattattctcagaatggtccataggtttcaacagactgctcaagagatgtaggcagaaaaaaccattaagaaccccagtgtatgtaaggattgctagagcaagattcaagaaggcagttttatttagctccagcctcttgatccatcttaattcaggtgcttggagtggcattgactattacgtggcctcatgggtccactcatgcccaaatctttgagtacttcactgtctagactcccggggtaatgagcatgttactgacagttaatatgtgtttatgaggatattagatgaaactggagtttgtaccagtaccaacccttgaactgattaaatgcagtctttatgattgtctatgccttggaacctgtatattttcaggtgaaattactaaggcttgccatgtgcttatcatgaaagcagggcattaaaggtcaattctgggcctggcagtgtacatctgtagtcccagctactcaggaagttggagagggaagaatgcttgagcccaggaattcaaggctgtagtaagctaagattgtgccactgcactccagcctgggtgagagagcaaagccctgtctcaaaaaaaaaaaaaaaaaaagtcaattcttattcgaagtgatatagcttttatgaacagtgcaaatgattggaaatagtaatacaccaagtagagtgtttatccataagcagatactacatggtgtacaacagagctagcttgttattcaatgttgaagacaggggctgttgattgaacttagaagggtggggagtaagggagtaggggaactgcaaacctggaggtgctgggagctaagtcctaagggtcagatccaatatatatagcttggctttgttggaaggaaggaatgaacagggcctttggtgagagatgacaggagataagagatgttgaaatccattggtgagatttttgacttgcagcagggaatgctaaggtttctgagaagtggagcaatagcctgcaaaatgctatgcatgggaatattggctgaaaaaaatgaatgggaaagcagacaagggggcatttttgtagcataaatattgccacacattatgaaaagtttcctgtgagttagcttgaatgttgtaggaggaaagaaacatttcactttagaagattgtgggctaaatttaggttcctttgactaaatataagttcctcagcatgactaataacacaggatatgtgcatcctgagaaagacgtatacacccacaatgacacttttccacctgcccacacccaggtcctgttttacaaggttggtatgtttaagtgtattttactttgcagttgttcagaaggattgcatatttttgaaaaactacttcctgaaagaggatgactgtttggaaaggaaagaaaaatcctagctggctttggtggtaacagttgggaggcatacccacgtgagctttggtggtaacaattcctgaagcttctccaagggtccacgtgttcctgctgttggttgccagaagccagaataataatggagctgagaatatgggatttttgtgagaaattccaggggcattcagatttcacagcagaagcagatgactcagatgtcctgcgccttagagagatgcgtgaatcccttacctttaccatactctgaattggtcaacggcagaatggaagccctacaaaaattgaaaagttggttgcatgctaacattcatagtggaactgagttgaaaattttatccttgtatttccagactctctgattagattgttttagctatgctctcacccccaattctgagaacttttcaactgtgactgaggtgtggatgggtcaagcatctttacaatgtgacaaaatccccatttctcctctgatttactactaatggggagataattcattactgtgaagtgagcctttaatagattaaaaaagttgtaagaatatgtcacatagggcaggacctaacagggctgggcactttattgaggtgaccttatttaataatatcattagttatcatttattggactctgaactgagctcccaacacggaagatgtaagatttatctgcattttacagatgagaagacagaggcaccaagcagtataactagcccaaggtcacacggctgatatgcaatggagccaggattagatttgggccatttgacctttactgcctggtaaaagccctgaaaactaggaaggtgatattattcctgttttacgattgggcaaactgtggcttagagaggtgtattagtctgttttcacactgctataaagaaatacctgtgactgggtaacttgtaaaggaaagaggtttaattgactcacagttctgcatggctagggaggcctcaggaaactgaaaatcatggcggaaggggaaggaggcatgtcttacatggcagcaggtgagagagagtgagcaagagcagggcaaactgccttataaaaccatcaaatctcttgagaactcattcactatcacgagaacagcatgggggaagaatgcccccatgatctaatcacctcccatgacgttcttccctcaacacgtggggattatggggattacaatttgagaattctgccactgaaccacccatgcggggattagaatttgagatgagatttgggtggagacagagccaaaccataacaacaggttaagtaatttacccatattcacacaattagagacctataaagataccttccagagtagtattgtccgatagaaatataatgtgagtcacaaatgcaagtcacatgtgattttatgttttctaggagccacactttaaaaagtaaacgtgtcagcagttgggatgatatattttatctaccccaatatatccaaaatactgttatttctacatgtaatcaatgtagaaaacttacccatgaggcattttctcttttttctttcttactaagtctttcaaatgtggtgcatatcttaaacttgcaacccttctccatttggaccagccacattgcaatacccagtagcctcgtgggactactgaaaagtacaattctagagtggtggttctcaacccttgctgtgcagtggaattactagggagcttataaaacacagatgcctgaggcccattctcagagattctcatggaattgatctggggtgctgcttgggtgttaggatttttgtttgtttgtttgcttgttttttgagacagagtcttgctctgttgcccaggctgtagtgcagtggtgtgatctcggctcactgcaacctctgcctcccaggttcaagcgattctcgtccctcaacctcccgagtagctgggattacaggtgtgtgccaccatgcctggctaatttttgtatttttagtaaagacggggtttcaccatgttggacaggctggtctcgaacccctgacctcaagtgatccgcctaccttggcctcctaaagtgctgggattacaggcgtgagccactgcacctggctagatgtgaggatttttaacgacctccctcccgaccaggcagtgcccaaactaactgagtagaaaactgtagcctttgtacattagagaagtttctgtgagttttctgagatgagaaccattcagaatgactgctctggcagtatgctttgctagttgacattaatgaatgccaagcaatgcccaactaatttattaatttctctccatttacatttcccaacatgttgaccaagtctccagaataatataagaaaagagattttctttctcttgctgatttacacattggtctggatacataccagtgaaagtaaattcagacataaaattctactcttttaattgaggtcaaaggtgttggtgtcagcctggaatctctgagctgtggagaagaggaagttggggtttgaaagctgcaggtggctgccagaatgagacaagtctagtggggaatgcgtgggaggtgctgggtgaagaaaggaggcaattgtgtttcgcctgaggtctgaaggctgcatagcccgctgtgtctcaggacgttcacaaagctgccctcaccagaagcgtcgcgtccaccttcccactggaccaaatttttgattctgcccctgaaccctggatatgaaacccaatactgaagaattaaaatgtctcatctcacccggaggttcagttgtccttaaaatgcttttggattcatttggaataatttctatattggcttctttcatttaaatccaaatatagcttcagtatttctgacatatttattactttccagaatggaaatactagttcttctgaagtggtagctatttagttatagtcaattttgttagttatgtttatttgacttcaaattaagccagagaatatgcaaacactgcagtgtcttccacagccttaccaaaatgaataccatatttcatcaaatcaaaaatattgtcaactgtaagatgcaccattgtttcacatgagctaagaaagagtaagctattacatgacgcttttttatcacttggaattttattttgtgttcattgaagttcttttagcctgacttagacataactgtttaaaaatattttaacttttattataggtttaggggtacatatgcaggtttgttacgtaggtaaacttgtgacttgggggtttggtgtacagattatttagtcactagacactaagcatagtacctgatgtttgttttttttctgaacctctcccctcttcccaccctccaccctcaagtaggccccagtatctgttgttcccctctttctgtccatgtgttctctcattatttagctcgcatttataagtgagagcatgcagtatttggttttctgttcctgcattagtttgttgagaataatggcctccagctccatctatgttcctgcaaaggatgatctcattcttttttatggctgcatagtattccgtggtatgtgtaccacgttttctttatgtagttccagaaagttctcaggcgatgcccatgctgctggtttggggaccacacattcaatagctaggctttagtgtgtctaaggacatagtatgtcactgaagaaattcagtacctctccagggtacatggatgttttaatttttcttccatttgtattattattttgatgaaaatgtatatattgcaaatttgtttgccttgcattgggtaaatgcaaaggaagaaagcaggaattttgtatgtctgatcttatggtacagggagagagatttttttccccttaatttgtttcatgaaagatttgttcatttccttttcctttgctttctttatccaacttgggaaacttgaatttattaggaaatctgcatgtaattgcagattaataacctacccattaataccacattagttcatcatgattaatagcatctatgtgaatacttaatgaatttgtaatgatggactatttgctttaaagcgtcaagagaacattccatgtaaaaaggcactacccgtaacaggaaaattaattatatgctggttggataatagcttgtcacaaagaagatatgtttgtttggaaagcctcattggtattgatatttgcagtgagaggtactttttttaaaacattcatgaaccttttaatttgtaaaatgagaaggaaattttattttcatgaacagttaaaataggtgtagggactgatatttatgaaagagagcagcacaaacacaaatatgtgctaatatactcataagtttacctatgtcactaggcagaaagacttcctatagtggccatttagattaagttccgaattgaactgcttctactacccactggtctatcctaaattcacaagttcacttctttaaggctcaagcattttttttttcttttgagacagagtcttgctctttcaccaggctggagtgctgtggcatgatctcggctcactgcaagctccgactccctggttcaagcgattctcctgcctcagcctcccaagtagctgggattacaggcatgtgccaccacgcccagataatttttgtatttttagtagagatggggtttcactatgttggccaggatggtcttgaactcctgacctcgtgatccgcctgcctcggcctcccaaattgctgggattacagacgtgagccaccgcgcccggccggcccaagcatttcttgatactcattttatttcttcagagaatcatttgttttctctactgtcttcactctaattctgtgatgtcagcagtcatcattgtttatttctgtctttgccctatatctgaggaagtgaaggtcaagaagattatgtgacttgcccaaaccaatccagccatataatttgttcgccacagattatgggtctctcatttcaaatgtctccagttttaaccccggcggaaagagttgcaagcgcagagactctgtccagctggtgcctttgaggaaacccaagaagcccagtgtgattggagctctgagttggaagggaagaggcataaatgataaaactgaggagaaaggcgggggccagagcatacaggctttgtaggccgtgtaaagattttagactctatcctagggcaatgggaaggcgtttgtaaatgtcatgttgagggatgtaatgagcgatatgttttgccagagcttgctgctgtctgtggagagtggcttggaggaggtagctgacaaatggcgaccaattcatgctttacaggccccatcatgttgatctattttctagtctggtatccaaacgaaggtggagtttgacttccttgttacagaaaataccaaggcatgattgtttatccttttctctattttctccttaggtcaacatgaaagatcattgcttcttctttgttgcccttgatttctttgaacttaggaaggtattttgtcaagcacccccactcatggggcaaaatctgccagggaagtcatggcagctactggtgggcatggtagttagtactcgttctaccagcacttttgcccctttgggttcactgcttgtgccaaaggtgctgttgcttccccccttttgggggagaggattctggatagagaaggaaagaaagccttacccctaatcactcactgtcggaaacccagttctggaggagcagtctccctcgaccacacattgtggtttgaacagccaggaatagaacccctccttctctcacctcctcatagaaggtgggagtgaaaacaggggttagttgggaagtggctttttaaacctatgtttacagtgttttgatgtcactttcatagacgagggaggaattgtctgaagctcagattttttaggatttcagggatgtgatgtttatctctctcttcctctcttgaggatgtggtataaactggaattgaaaatagatacccggctgggcgtggtggctcatgcatgtaatcccaacacgttgggaggttgaggtgggtggattgcttgagcccaggagttcaagaccagcctgggcagtatggcgaaacctcatctctactaaaaataaaaattaaccaggcactgaggcacatgcctgtggtcccagctactcagaaggctaaggcaggagaattgcttgagcccaagaggcggaagttgcagtgagccaagatcgcgccactgcactccagcccaggcaacagagtgaggccctgtctcgaaaaaaaaaaaaagaaagaaataccctgtatggtattctttctttcactttgagagtctttctggcatagtgctaatatttttttccactcttgaatctgtgaatcaaccctcacatcaaacccctattgcattttatgtttaagaagggaactttttaaagctgaggttggcagaactgagaaacttagacctaaatgggcctatgcaaggagggtgtttccaaaacaaaacaaagtgtttagtgtcctccttgaagaatgttgacactgagttaaaatggagctgcagagtgaggaaatcagtaaagacaggacaaaagttccttttttgatttgaggtagggtaggaaaggcagaggtgggattctgggctggtgatgtttccagggattgcaggcatcaagaaagaccggtgagtgctgttggtttaaagtagttgttctcaaagtgtattcccccgatctgcagcatcaacattacctggcagtttgttagtaatgcaaaatcctgggtcccaccccagacctactgaattagacactcaagttaaaacacagccatttgtgttttaacaagctcccattttttttttttttttaaatttttgagacggagtttcactcttgttgcctaggctggagtgcaatggcacggtcttggctcactgcaacctcaaccttccaggttcaagtgattctcctgactcagcctcccgagtagctaggattacaggcatccaccaccatgcccagctaattttttttttgtaattttagtagagatggggttttaccatgttggccaggctggtctcgaactcctgacctcaggtgatccgcctgcctctacctcccacagtgccgagattacaggcgtgagccaccgcgcctggcctaacaagctctctttattattccaatgttcactcaagtttagaaaccactggcttagactagagcaaaatgtgaggtcaagccttgaggaccagccaactttgttctgttctaacctcaccaggcctcctacctctggttaggtgccccaggagtctgtgtccctggtcaaaaatagggtgacagggcaaagggagtagatggctcatcacaaagacattgcaccactgcaaaaagaagttatgatgtaaccagggaaggtctttccttcagttatggtggagagatctgtcagggaattccatgagggcatagctgcctctcatttagccactgggggcccattctctcacaggaaagcaacttgcagaatttttctgggtatctgatgtttgaattaacaggagtcagagacctgagtccaaatcctagctctaacctttactaactgagtctccttggacaagttcttatagttttcttgcctgcacaatggagttatgatatatgtttcttaggattgctgggcaggttaattgaggttatgtattaatacaatacatctggcacagagcaggtgcttaaaaaatgaacactgtcgttactggtccttggatgtcttaggattgttcaggaacgaccattgcagggagtatataaacatacacggctttttccttgtaacgttaagatggataaaataggaggcagaggccaggtgtgctggctcacatctgtaaccccagcactttgggaggccgaggcaggcagatcacttgaggtcaggagtttgagaccagcctggccaatgtggtgaaaccccgactctactaaaaacatacaaaaaaattagctgggcgtggtagcacgtgcctgtaatcccagctattcatgagggtgaggcaaagaatcgcttgaacccgggaggcagaggttgcagtgagctgagatcatgccactgcactccagcctgggtgacagagtgagactgtctcaaataggagggagaaaaaatataaataattagagttagtagtaaaaatgctatacgaaaaaactgaggatagatttattttaaacctcaagtttggcacagaccttacatggaattatctgctaagatacaaaatatctaaataggaaagctatttatattgagttaaaacataagattggcagattcattgtaatgctatgctatcaaagaataatgctaaaattgaaattattttgaagtataaccttgataataagtataattcttataaattcacttataagtgaacataataaaagagttatcttctgttagagttttgtagtatctggcaattttatataattaatttcattatggacaaggaggtcttttgtgttaacagggacatttttgtgttatttggtaacccatgatttagaatgatttagaggattttaatccccttaaaatcatctctgcacctttttcttaagctgatgctaaccaacaattatcatttataagatcataaaaaatgaacagagaaaataattctgacagcttctatccctatatttaggtgggagttttctagaggaatgagaaagatcagctcctattggcttttcagtatgtcatacagattcagttaatcccatgcttgactggccgtgaggctgaggaactgccaagctgagtgtcacacaattcgtgtgaaaatatatgagagttacgggatccacggaccatgacttagttaacttgaattttattttttaatgagaataacaataagctttgcaagcttatttagagtctgcagctttaagtgcataagggtttaatacctttaatacccatgcagtgtgagttagaaaaatgaaaattttcagtatagtaaataaactgaggagcctggaaaccaaattgaaatctgtagcctagaaaatcaacaagagctaaaaatagtaggattagaggcagcattcaaccatagaccatccaaaggtagtttttaagtaccaccaaaggagaaagcaggccattctataataagttttaaaaaaaatctaggtctagagaacattctgttcattatgtagatgtggaagcttaaagtatagatttggttttccagagttttaatttttcatgttctttttttcaccagaatcagagggcactccctctgatttccaaaagagaaatgttaccacaatctgcatgaaattgagaatttaccttgctgacactgacgtgaagattttagaatgcagttgctggccaggtgtagtggctcatgcctgtaatcccagcactatgggaggctgagttaggaggatcacttgagactaggaattgaagaccagcctgggcaatatagcgagaccccatctctacaaaaataaaaataaaacaattagccacggtgtggtggtgtgcacctgtagtcctagctacttgggaggctgaggtgagaggatggcttgggcccaggaggttgaggattcagtgagctgtgattatgcctctgttctccagtctgggtgacagcacaagaccctgtctctaaaagtacccattaagcaaatcaagcaagtggctccaggattcactggtctcttagcaaagagccagaggccccctttcagaataggcacatggaaatattgcagggtcaggagaaagaacccaaaggagggtgtttttaagtgttcctgtgctcctgagccacttcattcaaatgtcagctcaatcaaggttcttggtaggtttttgctcataggcctaaaactttgcatgtgtggagtttttgaaaaatgttttaggtggatatgtcttagatattgtagaaactttaaatgattggcctgagctgcagatggctgttatgaactcttgactaagcatggtactgtaaaatcctcaagggcctcatccttcctttggaatttcctttttgtattctagagcactcaataaatgtcctgtctgagcagcagaattgaattgagtgaggattgatagtcctctctcagcttccgagcagaactaagtattttttttctccccagtgtagaagagcagggcattgggaatggatgataaagctgagacaattgatgaaaataaaacttaggtacccttaaaactggcgttcatgaaaacagatgaatgaagtcttggatttcattgtatgatatagggactgagatgtgaaaaaaagagatggtgttgttagtatgatcagggcattgctgattgtaaaaagaaataataaaagtagtcagtccagcttctcatagttctttttcaattggatgaaagtctctctcagactttccttgtcaggaattcaactcagcgaacattcactaagcaccagccatgccaagctctgggtcctgggtgttcaaagatgaatgtgacccagcccctgcccaaaagagtattcaatctaatggagcatagccattgttaatgccaatgttttataccaaaagtatttcttggtgatattatttgaggcccaatgaccaaaaatatctttattattaaaattctcacgtttcatcccctttgaggctaggcttgggttacaaaggcatggttgtccacaccatggtcaaaaacaaattttagatggactgtagatctaaatgtgaaacaataaagattttagaagaaaatgtaaactgtcaccgggcgcggtggctcatgcctgtaatcccagcactttgggaggccgaggcgggtggatcacctgaggtcaggagttcgagatcagcctgaccaacatggtgaaaccccgtctctactaaaaatacaggctgggcgcggtggctcatgcctgtaatcccagcactttgggaggctgaggcgggtggatcacctgaagtcaggagttcgagaccagcctggctaacatggtgaaaccccacctctactaataatacaaaaagttagctgggcatggtggcgcatgcctgtagtctcagctacttgtgaggatgagtcaggagaatcgcttgaacctgggaggcggaggttgcagtgagctgagatcctgccactgcactccagcctggcgacagagcgagactccatctcaaaacaaacaaacacacaaaaacaaaaaacaaaaaatagctgggcatggtgacatgtgtctgtaatcccagctacttgagaggctgaggtaggagaatcgcgtgaacctgggaggtggagattgccgtgagccgagatcaagccactgcactccagcctgggcggtagagcaagactccatctcaaaaaaaaagaaaaataaaataaaatgtagactatcttcatgagtttgggataggcagagatttcttgaacgggacactaaatatggtaaccatggaggagaaaaatggagaagctgaactaaaataatttcagtttattacaagataccattaaaaatgaagtctatgtaatgggatattttataatatattcaaaaaggactcgtacgtagaatatagaaagcacttctacaaatcaataacaaaaaggtagattgctctataaatatgtgatatagacttgaataagtattttaccatagaggatgttaattttcttgcttggggttagtgattggaagggagcacaaggggcttttggggttccagtaataatgctggttacttgagcgtgttaactttgtgaacattcttcacattatgatctgtgtacttttctgtatgttgtattatttgtgtacttttctgtactttcattggaaaaatttacataaaaaaagaaaatgctttgctgtccaggatgaagaatgtgagcagaatatttttggaggttaacactgattgcaaaatatgtcttcccatttagaattgcctctactatagaagcagaggaaatgttgagagcatggggctttgcaaggtggctatagcaggtgcagtttgtgaaatagtcctacacacagcctggcagtgtcttaggttagcataagtcctttggccaacaatatcctgagaagcaagcaggagaacaaacacagttatggaggaagcactagaaacaagcttgattacttgacagttttgtatagggcgaattctgcctgtaatcctgtttaagtcaccacttactgatccccgttatcatgtgcccaggcaccaagatgggggctttctgtgtattaaaaattttaaatcctcagcacaatcctgggaagcatgtactattattatttgactttacagataaagaaactggggcttagagggattaaataactcgctcgaattccagctagcaagttgcagcaagctgcaactggaacccatgtctgtgtgattccaaagcacccccttcccacatgtctattatgttgcctttaaaaaaaagttatttgatggagcatagtgagaagaaaaatacttaatatgtacttaatgttcaaatttgatgatcagaagaacttctcaaaccacttttaaagtctgaggtttgctgtgctatagtttttttttttttttttttttttttttggaaacacactttgtcgcccacgctggagtgtagtggcgagatcttggctcactgcaacctctgcctcctgggttcaagcgattctcctgcctcagcctcccgagtagctgggactacaggtgtgcgccaccatacccggctaatttttgtattattagtagaggtggggtttcaccacattggccaggctggtctcaaactcctgaccttgtgatctgcccgcctcggcctcccaaagtgctgggattgcaggcatgagccaccgcgcctggcctgcagttttatgaactgctattgtcctttgcagttgtaaggtggtaagaaatacctgggtggggtggaggtggggattgagaaatcctccaagaaacaacacaggctatgattggaatgcccctgtatgggtgacccatgagcctttctcaatgctttggggacattttaataacctgagtaattacctgtggtacgcaggctttgttttctactcattaataactctccaggctacattttattcttcttactgctaattcacatgcagagatacataaaatggatgctgtcaactgattgccacatcactgtctgcatatcaatgctctcctgtctgcttgggctcagagagaaggaaagaagagaaggaaaagggtatggcaaggaacttgtgatagccgaatctgttttaaaagccaaattctggtacagaaaccagaattttgacatatacaaattattgatatttgtgcatggttagtgttttgggattgccctatttagcatctgctgatcctctttttccctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatatatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgagctgagatcctgccactgcactccagcttgggtgacagagtgatactctgtctcaaaaaaaaaaaaaaatccttggggctagttatcttgattttattattatgatgatacacaagaaagaaaacaccaaacaagctgaaataattgaaaatactcacatccaacccaatttaatttatttcactggaatctatctagttatatggacttgttttaggtacaggtacttatttttaaaaaactagacaggagctctgggttgcttttttttttttttttttttttgaactgtagaacttctggtttagaagtaagattcctcttcaggagatatacaattatttattaacttaattagtgccgtacattttgtcttgaagctattcagagtattataggaacatctgttgtactgtgattatgatggctgctaggctgtttccccaaatgccttgacaaggcagtttgacatagttcggtgaaggcagtgccctggtgctgcagtcaccatagggatttttcatcttggcttcatgttggtagattgatactctcaagtacgttcaaggttctctttttcgggagagggttgttttcattgagtcctggctttcctctttccttatttaatgaaatagtgacaactatcattttctaccttcaaacattattattagtgattttataaatagaaaattattttccaggtgggcctatgtctgtgctggcaaccattgtgtacacacggactctcttagatgtttaggactttgcatgtgtaaacgggcaagttttcaggcaattcgggtaggttttccaatcttgtctttccatttcctgtctaaagaacttcttccatgtccacagcatgtttattcaacaatggataaaacttctaatgggaaatttcttccgggtgacctccttgagaggctgggctgtggagaaatcttaagaaacacaaccctgatgaaattggctccgttgagaatattacttggtccaggaacaagggacagaattcagttatttttggttcttgaataaatgaattctgtttccttttgtgtaggtggcagaagaaattaacccctgtagaacatccattctcagttggaaattaaatttttggtttcttttgagttaggagtaccctggataagagaatgtaaaactgtttttatttgaacctcatgcaacttggaatctgttctgttgtctgcatatctttgatagatttgtcttttccagggttgtctgtctttgtatttaattttctggaggttggaattgtgattatcaaatgacttccaacttggcaccatatgtgggtggatactaatgaatcctttcttaaccttcccagaacttttggagaaatcaatcagtagaaggcgggacaccgaagccatacagaaagccaaaatcctttattcatcctgcatgaatgagagtgagtgatgaagaaaactaaataaaatatttaccatccctatcctttagagttctattaatgttttaatatattgtttgaggaagaagagaactactaagaattctattaatgtttaaaggtgttaaaggaatgattgtgaaagactggattttgactagtcccatcttagttaatgttgttactggcttggtggagaaaatcttatttatatgagttggattctttgggtatcatttactccctgagaaacttagacaaagtcagcagggcaaactccactgtatctggtagagaatccagaagccaggccaagtctggcttgagacagagactgggagggagtgcacctactggagcctagagaaatccagattcccaggcatgccaggttcctgtgtcagcctaacaggcatctttgttgggtccttagccctgtctcaatatcttgggtctgattggaatcagaacagatactggccacttgacctggtctgccttctcaagcccaccacaggaagaagccagtgcctgtgggaagtgtgtcaactggtctaggatttggggtatcatgtggtgagctagaaaagagcaataaaagacaggaatctgaagcatcacttcttcttcattgggtagtgattggctttattgaggcattcctttagttagggttgtaacttagtcccaccaagtattattcattggctgggttccatgtagagaatccatgtttattgtagtgaatatccagcagtttccctggtcagctctcctggcaagaacactaggtatagacagtcacattgaagcgtggatcgtaggtagttctgtctctgtgattatgctcatcccaccccacctcttttacctactccctaacagctgaaattttaagttggagcattatgggaattttgtcttgagaagatgcacttaaattctagtgtgctgatccagtttgcaattctaactttctcttcatatctgctccctttcagaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaaggtataatgaggacccattcatcttctttgctcagtcctagattagccttttggggtgccatcctggggaaagagactcatgctgccttagtgaaataataacataaaacacttttattgaatagtagaatccagaatattcccttctcccggctttgcagaatgtagaccattaccatacaagttttgtaagccttttggaaaactagtgaattagtttcaagtgatctgtgatctggccctcatatgcctactcagagcaagcctagggttcctaaattccagtgggaaggggactgcaggtctcctgttgttagcagagattttctgagccctgctcttgtccttgcctcctcactcccttgatagaggagaaaacacgtgccatgattttttgttcctctttcactaacattttcttgtgcacacacctaaattttagttatcaacttcactctgaatctctcctccctcctttccaaagatacagcaaaacttgttctgttccaagtgcttggttgcgttttctgttggaagactaaccatgtctcccataaagcaatgggccacatggacataccctgaggcatttcacactggtaaaatcaggaggctgtcagaaaactaccaacagctaaagactcaccaatgaaagagctatgcaagaattcaaataacattcgtcaaatagttttgtgctttgatcctgctgggttttgttttgttttgcttccacagttactttgactaataatgaaaatgttattgcatgactgattttctccccaattctgtccttagtcaaatcagaaaatattaatgaaatattgatattcaaattgtagacatgtattgccctcacctcatgcattttaaccttctaaaatccaaatcttaaagttcatcgtttgattgaagctggtcatcgtttgatcagagattggcacattttttgggtaaagggccagataatacatattttagggtttgcaggccgtctggtctctgttgcaactacttaattctgccattgtgtctgggaaagcaactgcagacaacaaaggtatggctgtatggcgggctggcccagtggctgtagttttctcacctctaggttagacaatggaattctcagtaaaaatctttggtcattgaaaggactcccctctactcaggaggaaattctgagttccagagacaactgtgtttctatgtttggtgatgaaatgagccatcttctaatgctatcaggataagatgtgctatgtaagacacaatgatgatgacgacccaactgatctctgtactgtgttgatatatcactcattttttgaaactaggttttaagactatcattatcagttccagaactattatgatgttctttcaaacaccttaagttggtgttttgaagtaagctgaaggctgttttccaaacttaagtttaagtttatacattctattgagtgatagaagatcttgattcacacacagatgaataattgcaaacggtagccattttattatctttctcacctatttctggatctattcaattgaatttattgctttaaactttttattattaaaatgtggtacaaaattaaagaatagaaaaataaactcccatgtatccatcaacccagcttcaacaactctcaaccttctgatgttatgtttctttctgcagttatgttttaatctagagccctccttttttgggaggtggctagaacattttatagcaaattaaaaatatatcattgcatagtaaatacttcagtgcttagctagtggaaaggactattatcacaaccaaaaagataatcataattccataattaacatctaataactagttaattttcaatttttctgattgtcttaaacatgtccttaaaaaaaaaaacagttggtctttgattcaatctccaaataaaaatcacaggtgaacttagttgatatgtctgttttactccacaagggatccccctatttttgttttttaaaccacatttatttgttgaagaaactggagtatttgtcctgtaaactgtcttacattctgaatttgactgttttcagggtaatctaatagctgatgaaagttcttgtttataggagaatcacagcttaaaaatgcagaagaaataataggaagctatctatttaaaaaaaaatccctaaggaaaggattgatctaggcaattatcatcaatggctgctaaaaccattaggtaaatggttgattgggaaattcatgatatcagaccgatatcacctgaaccctaatatcaatgatagcattgctaaaagtggggcaaccagatattgtgtgcctcctggtatcagtaggaagtgcacactatcaccagtgatgttgtcgtgcccccacaattgagcctctagttttaagaggagcttacagaaaacatggggaatagagaaacatggtaaccaatttttaatagcttgccttgtatacttaatattcaattaaactgatcctagaaacactaaaatgtcaatgatagaatactttccaaatgtaaggaggcacccatgtacttattattgctctcttttgtcaagatggcagcttgttccaaactggtgtttgaacattgtttggcatttgagtgcggcaaacgtttgcttaagttctgttcctgtttgtacctttttccatgactgaatattcacacatctgaactaattgccttccctcagatataatataattatagtcttcctgatgacacatttacaagagttcgagcatgtatctggaggtggtaggagaagttttattctgagagctgcatgaaacccattgaacctgataacaaaaattagcgtactggtggctgccaaagttgtagaatttgcaagtgttgcttttttattcatttaaaaatagttaaaactataaaagacaaaatctaattggatgaacatttgaagccccccccacttataggttttgtggaacatagtttgaaaactactggtatagttaaaaaacaaaaaaaaaaataataggctttggtatttaaaagattgaggtttgcagtttagctttgtgatgtactcaccgaatatcctcgtgcaaattacttcacctcgctgatttcacttttcccatgtgtacggaagggtgaattagaatttacttttaatcgtcattgacgttcaaatgaattgacttttgtgacagttttcactgtagatactggtccacagtagcacacgacacaaggttccgaacctactcttcaagcatgacccagcaactggtcaggaccatttggagaatgtttttctttgacatgtggtacccgatatgcctctcagagctcaaactcagtagtgcaaggaataggaattttgtttactcaacctaatatttgacttttagctcccacccaaccttttggtgggaaactgaaccttagtctaggcatttacctcccctcttggtggccccatttctcggtcttttcctagggtattgggaaactgcaataaccagttatctggtttctgagaagaaacccactatggaaccatgtagcctcttcaagtgtgcccctctgatgctgaggtcctgcgactcccattccttctcagatcctgccatgttttggggtgatcagttcctctgctcatgagaattcttgacttcttttgctgcttgaaagatcctctttctgctctgggagaaatccctcttacctgaaactctcttccctcaatgtcgttaggcttccttttccatcgaattcaattttcttcggtgtgcttagcttttctaatcccacaaacccacaggaataagagaagggccttttgggcaggcacagcactgtgggcatccttttgggtgagcagatggtgcctttgggtgaagagacaggcaccctttctaagggttagatatatccccatgccaaagacatgcagtttggccagcaggggtcgctctaatctacacagcgtacttctgcaaagctcccctgtggcaaaatgatacagggtttgctacaggcttaaatgaggtaaaggaattccaaaaataaagaaaacaacagaagttagtgaccaaaaacattatcttgctgcacacgtttggatttattctatgtcaggagatagtatgaggatttaagggacaataaaagacgtgagtatatgtgatcctgaaagagtatttggaaggccaaggatgtcccagtatgtattactagttaatgaagacaacaacttaaagtcatcatctcacaacagcctgcatttttctggctctcagcaaaactcgtaaaaaatggcaaggagaaactccaagaaaatttgaaaagtttcattctctttccttttcctttttttctcaggaactgacagaacatagaattttattttattattgttattttttattgatacgtaactacacattttcatggtacatgtgataatctgatacattcatataatcaaatcatggtaactgggatatatccaataatgggattgctgggtcaaatggtagttctgttttaagttttttcagaaatcaccaaactgctttccacagtggctggactaatttacattcccaccagcagtgtataagagtttctttttccttatatccatgccaacatctattatttattgactttttgataataaccattctgactggtgtgagatggtatctcattgtggctttgattcacatttctctaccgattagtgatggtgagctttttttcatatgcttgttggtcacacgtatgtcttcttttgaaaagtgtctgtttatgtcctttgtctactttttaatggggttgtttggtttttgcttataaatttgtttatgttccttgtaaattctggatattagacctttgtcggatgcacagtttccaaatactttctgccattctgtgggttgtctgtttattctgttgatagcttcttttgctgtgcagaagctctttggtttaattaagtcccgtttgtcattttttgtttttgttgcaattgttttgggcatcttcatcatggaatcttgcccaaagtaatttacagattcaatgctatttctatcaaactaccaatgacattgttcacagaattagaaaaaggctattctaaaattcatatggaatcaaaacagagcccgaatagccaaagcaatcctaagcaaaaagaacaaagctggaggcatcacattacccgatttcaaactatagtataaggctgtagtaacaaaaacagtgtggccggtacaactacggatacatagatcaatggaagcagcccagaaataaagctgcacaccaacaaccatctgatctttgataaagtctacaaaaacaagcaatgggtaaaggactgtggtgctgggataactggctagccatatgcagaagattgaaactggacccatcccttttatcatatacaaaaatcaactcaagatggattaaagatgtaaatgtaaaacctaaaactgtgaaaacccttgaagaaaacctaggaaataccattccagacataggccctgtactatattttgaagtcaggtaatgtgattctccagctttgttatttttgcccaggatcgctttggctatttggggtctttcgtggttccatataaaatttaggatttgttttttctattttgtgaggaatgtcaatggtattttgatagaggttgtgttgaatctgtaaattgctttcagtggtattgtcattttaacaatattctactaattcataagcatggagtatccttccatttttttgtgtccttttcaacttctttcatcaacattttatagttttctttacatgaatcttttatttcatgggttaaattgattcctaggtgttttatattgtaaatgatattgtttattgatttctttttcagattatttgcttttggtgtatacaatgctgttgattttgtatactcgaactttactacatttgttgatcagttctaatagttttttggtagagcctttaggtttatccaaatataagatcatgttatctctgtacaaggctaatttgacttcttcctttccagtttggatgccctttatttatttctcttgcctaattgctctggccaggacttctagtattgcgctgaataaaagaggacaaaacaggcatccttgtcttgttctacatcttaaaagaaaggcttttaatttttcaccattcggtatgatgttggttatgtgtttgtcagatatggcttttactttttgaggtgtgttccttctgtacccagtttgttgagggtttttgtcataaagggatgttgaattttattgaatgcttttacagaatgtattagaatgattatgtgatttttgttcctggttctgttaatgtgatgtgtttatatttatgtacttgaatttggattttccatttaatttattttttttgagatgggatctcactatgctgcccaggctggacttgggttcaagtgatcatctagcctcagcctcctgagtagctggtactacaggtgcatgccactgcacccagcatatcatgtctattgatttgtgtatgttgaactatcctggcatccctggattaatcccactcaatcatagtgaatgatctttttcatgtattgttgaattaggttagctagtattttgttgataatttttgcatctatgttcctaagtcatattggctggtagttttcttttctccttgtgtccttgtgcagttttggtatcggggtaatgctggactcatagaatgagtttggaagtattcccttctcttcagtttttttttttttttttttggaagagtttgaatataatttgtattgcttctttaaatgttttgtagaatttggtagtgaagacatcaagtcctgggcttttctttgatgggagaccttttattatggcttcaatcttgctactaggtattagtttgttgaggttttctacttcttcatggttcaatgttggtaggttgcatatgtccaggaatttattcatttcttctagatgttccactttgttggcatatagctgttcataatagtctttataattctttgtatttctgtggtctcagttgtgtcttctttttcatttctgattttatttatttgtgtcttctctcttttattgttagtctagctaaagatttgttgattttcaaaaaaaaagccaacttttttcattaattttttttggtgtttttatagtctacatttcatttatttctattttaatctttattatctctgtctactaatttggggtttggtttgttcttatttttctagttccttgagttgtatcattagattgtttatgaattgttatttgaagtctttcaacctttttgatgtaggcttttattgctataaaattccttttcagtactcctttggctgtgtttcatagattttaatatgttgtaatttcattttcatttgtttaaagaaatttttaaatttcatttttatttttttcattgacccattggtcattcaggagcatattgtttaatttccacgtgtttggccaggcatggtggctcatgcctgtaatcccagcactatgggaggtcgaggcaggtggatcacctgaggtcaggggtttgagaccagcctgaccaacatggtgaaactctgtctctactaaaaatacaaaaattagccaggcatggtgtcgggtacctgtaatcccacctactcgggaggctgaggtgggagaattgcttgaacctgggaggtggaggttgcagtgagctgagatcatgccactgcactccagcctgggcaacaaagcgagactccatctcaaaaaaaaaaaaaaaaagattccatgtgtttgtgtattttccaagtttcctcttattattgatttttagttccattgtggtcagaaaagataactgatatgatttctgcttctttgaatttgtggagacttactttgtggcttaaaatatgatctatcctggagaatgttccacatggtgataaaaagaatatgtattctgcagcaattgggtgaaatgttctgtaaatgtcagttaggcctatttggcttagtgtctagtttaacgctgatgtttctttgttgattgtctagatgatctatccattagagtggagtgttgaagttccctatcattactgtattgcagtctccctctccctttagatctgttaatatttgctttatatacttaggtgctccagtgttgggtgcataggtatttataattgagataggcagtatattgctatatctccactaggtccttgcctttttttctggcactaaatggcaccttaagcctacgtttgctttgactctagcccaagatcagagcactcccagtccagatataggggaggtcctaaagaggatatcctggcagtgtggaaaagctggctggcggctagtgtacaggtgacctttggaatgaacctcctatagcataatgctgctgaacagccactctgatttggtgtctcctttggccgagttacggagcagagtttccagggctgggtatggtagtcccacctcccctctttgtctcttgctgtcttcagaaatatatctcccttcaggcactcatgatgccttctgtgggttaaggtatgggcaggtcttctgtcaaagaacccaagatggtcaggaagctggttgtccaccttgatctcactttttccagtgtagaaactatgagtcagggaaaatttctgcaggcttgttgctggacagattggttggaagggcatcatagagaaattttattatcctttgtctgcttggagttttttcacttctctgtggcctcagcaactgattcatccttatatttgagttctgggatattgctggtgagaatcttagtgctgtatatttgtttttagtttcctgtgtatatgttggggtggggagggaagccagcttctgtctccaccaccattttgaaacctgaagtccagactccatttcctacctcaaaatttgtaagctctttcttcttgtattactactttgtcttctaacttgaggtttattatcattggaatgccagttgtaattggagaaaacatttatattttcagttaaatgtgttggatttcctaaaaaacatactttattttctgcttacagtatttagatcagttgtaaatgcaaggatttaaaaaatctcaacgcagtgtcctgattgcttcatgagaaagtcttttgcctcaagagtttgtatgtttctaatgagatttatttgactgaccttattcaatttgttggttggtgtgtttaaaatgttccctagaaaccataacaatctgaaagtttataaaaggtctggtaacctcacttgaattatctaaacttttacaataagtggatttaactttatttcatgagagggaaactttggctttcttgataatatctacacagtttcctttcctatgagactcaagctcaaaagattcttcaagtggtccaaatttaattgaaagccaaagtgtcttaatcataatattgtgtttcatgatcgtggcttgcttaatttttggaagaaatagtggcagattgggaattgcagtaggacgaagccaggaaggcttgtgactttgttgtttcaggccaatgagagagggttgaacaaaataatttgaggattttagcagtatacacagacaagatgggtgttttgaaagtgccttttttcccctgaaacaagagttatgtttttcctggaatttttcataatatcactaattcttaacgtggcctttgtaaaatttgttgtatattaagggcagtttcatggaaaactgtaatcttatacaaatttatgtatttaagattatagtaagacgaaaaagaagctggaggagatgggtcaaaacagtttaaagtcatataaactaatggtatgggcatgtaggattcagtttttattcagatattactaatttttaatttgttgtttagattttgtttcttattattttggcttaatgtttaatgtgtgaattagagatttaatttggaaaaatctactcttcttgagattcattttatttatctttagtcagttgctgatattcaagaaagaacaaaccacagatttagagaaggtgctggaaatttttttaaagtatcttaaaatttacataaattcattttttgtgatgtacatgtctaagttttgacaaatgcatagagtcatgtaaccaccactgtaatcaagaaatagaatagtcccatcatccacccccaaatacctcatgttatccctttgctaagtcaagccctctcctcatgcccaaaccctgttagccatcactttgttccctgttcctgtaaagtttggctttttcaggatgtaagtaaaattcacccatgttgtatcagttcattctcttttattgttgagtagtattccattgtataccacagtttatgctttcatgaattggaggacatttgggttgtttccagttttgggtgatattgaataaaattacatacaggtttttgtgtgactttaaatttttttcctgggtaaatacctagaagtaggattgctggctcttgtgtaaatgtatgttgaactttataagaaactgtaaaattggtttccttccaaagtggctgtgccattttgcattcttaccagtaatacatgagtgatccaacttttccacgtccccaccagcagttgtcagatttttttttccattttaacagatctatggtagtgttttattgtgggtttaatttacattttcctaatgactaatgatgttgggcatattttcgtgttcttattttctatcttcatatgttctttgatgaagtgtctgttagaatcgtttgctcaattttaaattgagttgtttcttttcttatggttgagttttgaggaatctttatgtattctagatacacgtcctttgtcatatatgtgattttcagatattttccccattctgtggcttgtctttttattctgttaagtttctttcaagagcaaatttgttcaatgtcgataaagtctaatttattttttcttttaaggattgtgattttattgtcatgtctaaaaactctttgtctaacccctagtaacaaaaatttttcccaatattttttccagaagttttatagttttaggttttacatttagggctatgattcattttcagttaatttttgactaaggtgtgaggtatgtgtaaaggtttattttctttttgcttatggatgcccagtttttcttttctttgagatggagtcacactctgtcacccaggctggagtgcagtggcgccatcccagcttgctgcaacctccgcctcctgggttcaagtgattctcctgcctcagcttcccaagtagctagaattacaggtgcgtgccgccacacctggctcatttttgtatttttagtagagactgggttttaccgtgttggccaggctggccttgaattcctgacctcaagtgatctgcctgccttggcctcccaaagtgctgggattacaggcatgagccaccacacaaggcctggatgtccagtttttctaacatgctctttgaaaagactgtcttctttcttttgtttacctttaaggtgctgaaagttttttttgtttttttttgttttttttgtttttttttcctgagacagagttttgctctgttgcccaggctggagtgtagtggcgtgatctctgctcactgcagcctccatctcccaggttcaagcaattctcctgcctcagcctcctgagtagctgggattacagccacacgctaccatacctggctaatttttatattcttagtagagacggggtttcaccacgttggccagcctggtctcaaactcctgacctcaagtgacccacccaccttggcctcccaaagtgctgggattacaggtgtgagccaccacaccagcctaaggtgctgaaagttttaattcaagaatttatactatacttttctatcactgtaattctacttatttagttgtctggttattatttgtgtttttatcacttatcctaaaccttccagagagggttctaacatttgcgaaggtttctcaaaacaaaattattatttgattccattcaaataaaaaaaaatcaatgccatatgttattttagagataaggagttggaaacgtctgattaatcaactctatacagattggcattttgcaaaacactgcaatgagaaaaatactggaactggtgataggagacaacgattttagtctgagctctgcccaatcatgttaccttgggaaagtcacaacaattatctggcttttgtttctcctcccattgaataagggagaatagctaataatctctaagatctattccaactgaaatagccttgttgttattcagtgttgataggacctcaaaaggtttagaaaacataaattagaaaagcaggggcaggtctctgatagtttattatatctgtcattgccaaagtgcctatttgcatgtaattctgagtgtactgaattgtttttgtaatggtgacatgagctcaaaatatggctgggatgcagacgatttcatcactcttgttaacatggtacgtaagaatttacagtgctagcagaatgctttctgtttttgtttttacagctggaccaagcaacactctccctggccgtgagggaagactaccttgataacagtacagaagccaagtctgtaagttttactcatattcaactatgtgccttaccaggctgctgtcaggcccattagttctaaggccgctgcttctttattggaaatgagcagtgtggctattcaatgaccatattcccaatgcaggaagacttttattcaggcagataaattccactccctgtctttctagaagtctgctcatcaaggctgtacaagtctcagtactcaatgcccttatctagcttgggagacagcactcccaaatgaagtaacaaagaaatgagcttgcagtcattcattcctcagaagtgcagagagctcactatcaattgcagaaataaagcgtcagaagagatacccaggagacagatggttcccaaattgtactgctttagaatcacttgggaggctttcattaaatgttgcttcttgggtcacagccctggagagtctgacttagacttgaggtagggtctgagaatctatatttttaacaggtgttccaggttaatggaggtttaataagaatcagaaaggatcaatcaagttagacttcttggattggcttagaaatctagcagtctcctggatattggaaagagctggttcatttctgacactttcaatttattttggaaactttattgaacttccaaaggagcctcagacctaggtcccctgggtctatgccgatactaacttctatacatagaaggctctggagggaagctaactaagatgctgggcagctttcttgctgaggacactcaccaaagagggttggcaagttttccttcctaaaagtggacagaatgaacatttgccaatgtggggggagggtgtacccctggtattgatggagtctcagcaaccaggctcaaaatcgtctccccctataacctatctgtcaagtcctaatgattctaccttcaaaatatctcttccatccacttggtccctcttttctatcctgactgctataggtcagattcttgttaactcttgccttgactacagcaagtagccttttaactgttactgcttctccttcatcacattgcctccttagcaccagttgacaagttctgttctcaaagcactgctcctagcatgccttcgctcccaagacagggtctaaattctttagagggctttcaaggctgcctcatgactttatcccaagtcatctttcctatctcatctggatttgttcttcccccaacaaaagcagcttgcccactgtattagtccattctttttctcctaataaagacatacctgagacttggtgatttataaaggaaagaggtttaatggactcacagttccatgtggctggggaggcctcacaatcgtggcagaaggtgaatgaggagcaaagtcacgtcttacatggtgtcaggcaagagagcttgtgcaggggaactcccatttataaagccatcagatctcatgagacttactcactaccatgagaatatgtgggggaaaccacccccatgattcaattatatccacctggccctacccttgacatgtggggattattacaattcaaggtgagatttgggtggggacacagccaaaccatatcacccacctcacaggacccttcactgcgttggaaccagtctccctcaaatgctatgtccccagtttctccgggctagatttttctctcagatcttcagtttccaagcgtgtagcagctttattaaggaagttattttgatgtctttaatgttacagttcataattacatgtttatctccctcactgtttgggaaccagacacagcattattattttttttctgtaccaccctctcctaacatatgcacagagggcctaccaagccaccttgtacatttgagtaggtactcaataaatatgttttttggtttttctttttagatagagtctcactgtgttgcccctgctgaagtgcggtggcacaatctcgactcattgcaacctctgcctcctggattcaagtgattctcccacctcagcctcccgagtagctgggattatgggcatgcaccaccatgccgggctaatttttgtatttttagtagagacagggtttcaccatgttggccaggctggtcccaaactcctggcctcaagtgatctgcccacctcggcctcccaaaatgttggaattacaagtgtgagccaccacctccggccaataaatatgttttgaattgaattaggaatagcaaaatattatttctatttaagacttcttttcttttctttctttcttttttttttttttttttgagatggaatttccctctgttgcccaggctggaatgcagtggcataatctcggctcactgcaacctccgcctcctgggttcaagcgattctgctacctcagcctcccgaatagctgagactacaggcgtgcgccaccacgcccagctagtttttttgtatttttagtagagacggggtttcaccatgttggccaggctggtcttgaactcctgacctcgtgatccacctgcctcagcctcccaaagtgctgtgatttcaggcgtgagccaccacgcccagcctatttaagactcttttcaaagcttgcttactgattcaacaaagatttattaaaggcctcctgtatgctaagtactgtataggtcctaaggtcatacatatagtaagaatagcttacagagtcaaggtataagttagtaaatcttattcccaatgcatgagaaggaggtcatttaatacctgatgcgttgagatctcacaaatatatctgaaatgagaggtgggcctaaggcagttctttaattcccattaagtaaggtcacccctgccccacccaatgacatatgattatccccaaaatgggtttatgagtatgtaagaaggaaattctatatttgctatttgttaggtttcctatcatcgttcctctcttttctcctttttttcctgagctagggagcaggactttgtgaaaactgtaaaaacctgaaaagacacagggctgctgtcactggtcttttatttcttagtgtgaaggtgggtaaattgagttgcaagagaataaatcacacctcccaccattctttatggatcaggcctcctgcttttagaaacagttctttcccattgttttattaaagcctcacttgtctggaaagaggaagtctgacctttaactttctattcttgtctcatttggagttatttcatgtatccataatatcgacggttgccagaaaactagttctcttgttgcttgatggctggacatctctgtctgtcatggaaacagtactcaagtagccgtcactctttttttctcccaaagtgttatatgggtgcctggtattgcataatgcctgcaccatactttgagtacagagtgaaaataaaagacatttatttctacctgctattttctgctcttccatgtctctcaaacatatttcctaagaagctattgtcatggtcactttgttctttatttcttacagtatcgggatgccctttacaagttcatggtggatactgccgtgcttttaggagctaacagttccagagcagagcatgacatgaagtcagtgctcagattggaaattaagatagctgaggtaagtcttcactgaaaatctctttctttcctttactttcttttcttttcctttactttcttttcctttccttttattaaaggcagtatatcctgaatgaaaatataaattgcaaacaaataatagcgttttgtgtcattgcccattgggcccaaggtagaactaatagcatcccctctaggaagtaacaaggactgtgacagaaaagctcctcattccttccacctccctggtttaagcccattcagtgtccatacgttgctcagctgtggccaaagaatagcagcagagagaccctctgaccgtttttcctggagaaactcatgtttggcttaaatagaagatagatgtttaataaatccttagtaatctggcttgaatggaaggttgcttttaatccagcccatgttttatgctatccccactcagagtcattctggcttaagttctgggctcagggaaatctgtccaccaatactggatataaaagttggtatagaaataggtaggacatgctggtaagcatttttaaacgacctttctggtattactttgtacctgcccctgtttttcattattttcttgccctactttaatgaatatcattgtgtcatatacatgacacagaactacatgtctatgtaaattaccttaacttcttgttggctcattgtagagacaaaaagatgtaaaaacaaacttgtgggcaaaataatgagaactcctaaatggttagctttgtttatggaataacttttttctagaagaaagaaagtgtaaaaatctctctatatgttcctaggccaagagggaataaatgtggtaaaatctgcttctggggaaaccctgtagtgaaaaaaatgatactttttaccaagaaagttttgcgtatgtgttgggaatcttttacaagagaagttggtaaaaatctcgagatgaataagagtccaaatgttgattggttttgtttggcgaggtggtggtggtgtgttgaggtatggagtagggatgaaggataagggtaaggaggaattggtctctctctctttgccgtggtgatgttcgtgtatagctctctccaaactcctacttgcagtgcaaaaagttcattcctgcatgtcacctttgaagactgtgaagactgctgcagatgtttcgaagtccaggactgtgcctctgagccatgtctagagtctgtctgaattctctttccaggcacataggaggcccagggctctcatttggactaaaactctgaaacagcagggaaggccttgccctgagccagggatttggaccaaaaagggaactaaaaacagctgggctgaggcaagactgggaattgtcaaaaggctaaatgaagtgacaaatctattgtgtggaggggagtggctggcagagagctgaaaacagctctgaggccaaagggctccaacttggggctgtgagactccgagggcggaggagggattggtggaagaggagtgtggatatcctctgaggcaatgattcacaccgagccaggaggctgtttgtaagttacatgtggtctctcctgtggagggtgaagaaagggaagctaaggacactgaagcatttagcaaagaggggccagacgtctgccagtcagccctctgtaatttttaccttgaaaaatcactgctagtaatgctcacttccatatcttacactacacatcactaggtacttttaaaattagtgggatacatagtcctatggaaacttctgaagctgggaagacaagacagtccagcccagccaaatacgtccttgtaattacaaccagggaagcatatacttaaccaatccagctagagagatgtgtgcacaaggagaggttttattgatggagtagcccttgtgattggaaccaagtggagtgtaattggaaaggcttgctagatgcagtgagtcttgggcagtcctgagtcatagttcaaaccatggaggtggtgatggtggataggagatgcaagagtcggagagtcatgtgtgcagtgggaaggtggcaagtttaatgcaagggaattagatgatggaaggcccgaaggcaaagtcatgacgtgattgaggggtggatatgtgagctactgctggtcaatggaagtgattaagatgatccttgaggaagataatcattgctgctgttcttaggttaaacatagtggaggctagaagctcagatttggtgttggccaaatggccaagagcatgagtattaggaattgaaagagtatagagccagggctagagagaggcaagttttgaaatgtgtgtccaggcggtgactaaatccatacccccagcaatggggctagggaaatctcaaggccaaagagacaagaggggaaatgagggaatgagctgttgacaaaatgatcacggggaacagtggcatccagatagtcttgtgttcatcagtgaaaatttgcccctagaggtgaagggatggtctgtggttcatgaaatattgaaatcattatctggagaccacaggtgacaatgggatgtttacctcaatgtccaacttaagtttgattgtcaaaattgagccagcaatagattttgcccatccacattatagattgggagggagatttggggtagttctttttgtactggggacaatatttcacacagaggaggatatgaaagtttattttcttaatcctgcctaaagtgatgtctttttttctcttccccgagttggggaccacaccaaagccttgaaaaactttataatactatgcagatgttttggcacatgtaggaagtaatcatacagtaagaaatggttcacttgaaaaaaaataacaaaaatctcttttcaacagataatgattccacatgaaaaccagaaccagcgaggccatgtacaacacaatgaacatttatgaactgagtgctatgattccccaggttggtgagaactatccagaaaactttctctcaactcatcattttagaagggattggatttcatctctgtgtaaatttgtgtcttgtaaaacctgctctcagtcttggttatcatcatctttgtcaacaatcacataaaatatcccttgtctgtgtattgggatgccttctgttacagggaacaaaacatctttccaacagtggcttagaaacttaaagcctatattctcacatgacaaaagtctagacataggtaattgttggcattggctcagctgtttaacagtgttgtcaaaggcccaagttctttctatctttccatcctactgtgtttagtgtgttggctttttgacttcatgtttgatgactcatggttccaaggtatccatcacagctccatatatcacatctgctgtcagagcaggaagaaggtgaaagggccagtgatgtgtctaactcttttactaggaaaaacaaacaagcctttccagaacatctccagatgtcttccctttatttcttattgagtaggattgggtcacatggccactcctaaccacaggggaggttgggcaagtgagtaactggttttccgtttcaacagtggacacaggcaaggaagaaaaggttgggaaaagacttttagagtagccaatctaaaaaacaccatatggtgttttaggtaggatagggatgctctgaagaatggaggcatgttactttctgtgtttttatttgtttttttttgagacacagtcttgctgtgtcatccaggctggggtgcagtggtgtgatcttggctcattgcaacctctgcctcccgggttcaagtgattctcctgccttagcctctcgagtagctgggattacaggtgccggccaccacacctagctaatttttgtatttttgatagagatgggattggccaggctggtctcaaactcctgacctcaaatgatccacctgcctcggcctcccaaagtgctgggattacaggtgtgagctaccatgcctggctgcatttactttctgttgctgcttatttcctcttgtgtttttttttttttttttttaaaaactgtgtcacagagacaaattatgtactggggcatctgtttctgtgtgtatgtgagagtgagggagagtacaggacagagaaagggagggagggagagagaaaatgtaccgtatagaggaagaatttagaaggaggaagagaaatgcaggagagaaggagggaagagtatgggaggaagaaagagtatagaatagaggaagagtactggacagggagagagcagaatggggagagaaagacagaggggagagttcaggaaggaggaagagtactggagggggccaagggagtgagggtgcatattactgtgttagtgtgtgtgtgggtgtcgtccagatgtagatggtacagaacacatgctccatttgtgattaagacaataggtcaggccgagcatggtggctcatacctgtaatcccagcacattgggaggccaaggtgggtggatcacttgaagtcaggagttcgagaccagcctggccaacatggtgaaattccacctctactaaaaatacaaaaaaaaaaaaaaaattagccaagtgtggtggcaggtgcctgtaatcccagctactcaggaggctgaggcaggaaaattgcttgaacccaggaggcagaggtaacagtgagccaagatcatgccactgcactccagcctgggtgatagagcgagaatgtctcaaaaaaaaaaaaaaaaaaaaaaaaaaaaaaaagacaataggtctggatggcaatgatcaggagtttattttctagacttgagtagttgcatcttgaattattaggtgtgaaatcaaaagaaatgaatgatgctcaatctactctatctgcctttcttacttgctacctaaccgagattctctcattctgttttgttctctctcccctcagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagtaagaactttcacatgaattttactgtgacttttgtgttttctttaaattataagggcttcccttctcacatcctttgaaaactgtttttaaagaatgttacatcaaaagagtcatagggaaaatcccggtgtcctttgtgatgaactggccaaaagcactgtctggtgtaatttacttgctgcaatgataacaaatgtttttgccctttatttctggtctttctccatgctgttctctttgagatcctaaattgtttatgagcttggggagctagtcatataatgatgttattttctaaaatgtctgtgtgaacatctttttttttccccagttcattctcaatcttttgctgcttttttttttttttcctggttcctttttaaccattaagtcactttctggcaataaactaaagtaactgtattgagaagacacaagaccaccttgagagtggtagaaaaattgcacggataaaacaactttaggaactgccaggtttttcttattttaaagaatgttttagaatttgttgctttgctagtttattgctacaaagaaaaatcttccaatattccaggaaggagaattttacaggttccttaaggcattcagctttgactacagaaaatgaatcacagagcttacaaaatgaatcaacgagtttacaaaacactttactgagttaattgctgggccatgattaaaatcacattttcttatttggactcagacaaggctatgttgccagaagttacgttttttaaaaaaggcacaacagtccttggaagaaaatgtagcatttatcccctacggaaacacttagacacctgagaggagctgctgctctttttaagatactttctgatgataaaagtaatctgtgttcactgaggaaaacatacagaaaaaggagagaagaaacaattaatttacttaaaattctatcatttagagataagccaggattctttgaaaatgttctaaatggaaattgaatctagaggtacgtaattatattgcagggtagagccttgctccatggaccaggaatgtcagcagcatcacctcgggtgcttgttaaaaatgcagattccaaggccctcctccattgagtctgatccagtagagctggaggggaggccaagtaatctttattttaaacaagtacctcagaagaatcttatgattaacttttcttaggggaggggaaggggatcactgtattagaaaatttctttgtaagtacttcctagctctcaaatactataaaatatgacccaaacgattttctactcatatgccattgagttacggagcacattttaaattttggtggtaatttccattgaaaggtggagtttggcctgctttagattcatccttcacctcgtgagtcagtttcttctagtatctgtgttaaaagagtaggtacttctgaacactgattgattttacttccaaaaaagcctaatttacaatcaggggatagattgggatttggtttactgtattagaaaaagcatctctatcgtgatgattttacttggtaattgcaggacctttcataacaatggaaaagagcatgattggagggagattttactctgattcttgtcaaaatgataacttggacaaatataaacgtagagaacaacagtagaaaaaacatagatggaaaagtcaccttagatgttatgtacacatacaacttcatttaaaaataaggacaaaaattggccaggcgcggtggctcacacctgtaatcccagcactttgggaggctgaggtgggcagatcacttgaggccaggagttcaagaccaacctggccaacatggtgaaaccccgtctctacttaaaaaaaatacaaaatttagctgggcgtggtggctggcacctgtaatcccagcgacttgggaagctgaggcaggagaatcgcttgaacccaggaggtggaggttgcagtgagccaaggtcgcaccactgcactccagcctgggtgacatagcgagactctgtcttaaaaaataaataaataaaaataaagccaaatcccaaatctctttcacacagtttatccctcaaccaccagtttataaaaagcaacttgtgttctgcgtattcttgtgagatttcaatacaacgtacacatcatgagaagtctgacagcattttatttgcagactatggtgatgttttttcattgatgatcgtgtttaatcaccactcgtgtagcattacagggctacttgaggaaaagtcttcttgggttcccataattgccatattggtcaggatatgccagttgctataaccagcacctctaaacactcattggctaaattgtaccctctgctcatggaacagtctgaacatgggtgtccctgtaagagagctttcttctaaatagtgacttaggaagccagactcctttcatcttatggctctgccctcccttggatgtttggcatcctctctattcagctggaggatggagaaacagagagggtggaggattgtataggttttggtgggaaggcctagaagtggggtatgtcacttctacccataatccataagccagaactcagtcttgtgactcatctagctgtaggggagactgggaaatatagtttagctatatacccagaaggaaaaggagttggagtttccctagacatgcctttatcaaagagcctatctcattttcttgaaatgaccacttttctctcaatggcaaatacttccctgctccctacctctatgacactgtgagcacctcatggcaggcactcttttttaatttttaatttttgtgggcacaggacatattttgatacaggaatgtaatgcataataatcacatcaaggtaaatggggtatctatcccctcaagcatttgtcctttgtgttacaagcaatccaattatactgttttatttatttaaaaatgtacaattacactatttttgactatagttacctgttgtgctagcaactactaggttttattcattctttctatttttttgtacccattaaccatccctccttccctccttcccctctgctatccttcccaacctccagtaaccacccttctattctctatctctatgaattcaattattttaattgttagctcccacagataagtgagaacatgtgaagtttgtctttctgtgccaggttatttcacttaacattatgatctccagttccactcatgtttctggaaatgacaggatctcattcttttttatggctgaatggtcctccgttgtgtatatgtaccacatttttaaaaatccatttatctgttgatggacacttaggttgcttctggcaggctgtcttgtgattgcttttttaagtgttgtgacctagcacagtgcttctcatgtagtagacactttaaaaattctagaagttaaccagataccccatcaccaccacaaggaggtgacatatgaatggaaccccaaaggataaagaggaattttctaggtagggaagaatagagaaaaggggatggtaagcatcttcagtggtggaaccaatgtgaacttgggtgttgcctgcaaggcagggggctagagagctgagaggccagcttgggctcaggatatgtagaggaaaagcatcagatgaatgttctgaggatccccccacctcctacctttcccttggaggcaccattgaagaaaaagccagccaagccttctcacattgggcatctctgctgtgcctctgtttcgagaatctgcctataaaaatcatatacaggtaatggtgatgttaaccaccactatggttaacatctttgatctttacaacaattctatgcgttgttcccactttacagatgaggaagctgaggttaagtgacttggccaagatcacacctctaagaggaaacagagctgagattctaaatggggtcaccctcatttctatgtcttgtctctttttttccataaatgtcttggtgtgaaaagagatacttttcagatgcttcactgctcattttggagatgctagcgtattgtaccctcagctagttagatattgctagctttggcaattttcctgcaatgttcagcagttcaaagccatcctgtgttggtgtcagctgttcatttcttattttttatttttatttttatttcaataattttgggggaacaggtggtgtttggttgcatggaaaaattctttagtggtgatttctgagattttggtgtacccatcacctgagcagtgtacattgtacccaatatgtagtcttttattgcttaccccctcccactctccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacatgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcatttttcatatgtttgttggccctttgtatatcttcttttgagaattgtctattcatgtcttttgcccactttttgatgggattgtttgtttttttctttcagctgctcatttctcaattgctgcttctcccttcttatattactcccactgccagtctaggggattaggcctctttctctgactgagtggctgtggggacagtggcactgactctttggtaggtggtgcatggtacagaattagagcaatgagatcctccagtggtggtggtgccaaaccacaccagcccttgcagtccaagggggtaggtggccagggagggacccttggaggaatgagctggaggctgcctgtggggaacaagagctggtgtttgaggtggaaaggggggtggggtaaggaggtagtgatgatccctcatgttatgtgcatctcttcctaactacatgttcggtgatctcatgttgatagtttcaattcaactatgggggattttgacaccatggaaattggcaaatgtaacaaatcatttttctttttcttgacaaggcagttggcaacctttactagcacatcactgggtgaggggcactatagacttctctccctttctgtccccctcaattctcctcctcactcctgactcgaggctgcctcagacacttcccatctacttttatctgaggagtaagagtgggaggaggagaggccaaggaaggttggcatcaggaggagctgacgtgatttcctcttgcaggccagggctggatccatggagatcatctgcgccaggactgttttcttttgttgttgttgttgttttgttttttagcagactggcctagagcaaacccttggagttttgtcaaggaccctgtaagtattcctgtctttagttttattttcatataaagcaagtacaatgtacattaaagtaagatgattcttgttgcatgttcccaaaggatgacctggaaaatgtgctgttatgtggacctctcctgggggccagctcttctgagagtgatctagggtcttgctagccaaagaatggcctacagatgagcagcagagacattactggggagtttgtcagaaatgcagactctcgggctctgccccagacctactgaatcagaggctgaaattgaataagatccccaggggactcatatatacattcaagtttaagaagcactgatgtgggatttaggaagtcctagttgagctgtgtgtgcagaacgatgcggagatggagttttcctagaccagctgttttcaaacctgacacgcctcagaatcccctggagggtttgctaaaatacagtctgctggccccccaccccacagattctgattcagcaggtctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataataataataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtttgatttattgccacttggggaaattaccatatggctgaaaatgtgtttttttgggaaaaaaggatattatgtgttattttcaaggactgttgctgactgtgatttttgctttttgatatatctgagcattaggtgacagtgattcagtcattatggttatatctgttcctggcgtggtaatattagcactccaaaactgtgctccatagcattctgtcagtgtatttataacacactgaagaaactcatcagtgccattgtctcgctgtgtgaacttctcagcattacagcttccagcttgcagaggtctggttgttatgctatcacctttgtaatgccttgtccaggaagtcctcgtaattctttttgtgcccacagatttctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcatgtggacttttaacaacttccccaggtgactctactagtttgagactcactgaatatgtgatcgtgagtttacttaatggttctaagcctgaagtctcctcatatgtaaaatgggtataataacatctctcttacagcagcactgtgaggatcataattaatgtgagatgcctaaatgggatgatctcaggggagctggaagggcccctgcttctcaaaccccagtatactttgccatactacatcttccaccaccaccattgggccccctaacaacttccctagttattctggctcatcaccacccctttgagggaatatcttttgaactgatgaaaggacatctgctggctgttgacctccttctcgtctccacctatggatccagcatggttcacatgcctggtaagaggtattttagagacaaagaacataaagtccttgcactaggaccaagatcggcccattaatgtgctagacaccatgacctggtcgctgtctgcatctccccagtgtggctggcctttctgcccacttccttgagtgatgatcctgttcaccatcctctccaacatatcagccgattccaccattatttagcctgtccagagttcacgttcctgtttgcaacaccaaagccttttaacctttcggcatgcttctctcatgaagcctactcttaaccctcagtttgagatgtactatccttacagtgaagtgtctggcacatacttttgggtgctagtgtctaccaaatcattatttatgcacttgcctcatctcccctgctcagctaaaagcttcaggaaatcagggactatccatctccccagcacagagaactgttagtatatatgtgggtgctcaggatgtgttgattgagtgaatgaaagaaagacccttatgtactgacagtgtgtcccttcaattaaacaacccaattacatgaacaagctgaaatctgaagtcctgtgttcccagctggactttgagttctctaactgtaggtgctgggttcttacttctttacgttcctcatggcatctggcacaatacttggccaacaataagtgctcagtgagcacttcttgtcctattaaggagtggagatgtgaatgcaaaagagccaaaggaatgaccccaaaccacttagtggcctcaacagagatgggcaagggctggactttgctgattagtgcagtggtgtcttaggggaatgcgcatatcctaacaagatccattgggtctgagaagaacattttagaacttctatatctttatttaaatttaaaaataattaggctttatacagagtggtataatggactttggagactcagaagcagggagggtaggaaggggatgaggcataaaaaaactatagattggatccagtgtacattacttgggtgatgggtgcactaacatctcagacttcaccactatacaatttatccatataaccaaaaaccatttacatccccaaaagctattgaaataaaaaaactttataaagaaaaataattacactttattgagttctatattgatggctatggacccttcatttgatctgtatggaacatgtgagaggggcactgtcaccctcactggcttgttttcattcaatatattaaaaataatctcagctgatacggtggctcacgcctgtaatcccagcactttgggaggctgaggcgggaggatcacctgaggtcaggagattgagaccagcctgaccaacatggtgaaaccccatcagtactaaaaatatagaaattagccagtcgtggtggcgggcatgtgtaatcccagctacttgggaggctgaggcaggagaattgcttgaacctaggaggcagaggttgcagtgagtggagatcgcgccattgcactccagcttgggcgacagagcaagactccatcttcaaaaaaaaaaaaaaaaatcttgagcggtttacatatagctgtggatttatgaattttattatctagtttatctagtttactacttacaaagtagacaagtggcttaaaaattcttgcaggaaacaggaattgaaatgattattgatgatgtaagcacaagagaacagctagaaattggcagaagtgacccttctcccaggctggtatgccatgttggttagccagatgacaaaagaaatacaatggtggtctaacaagaacaaggacaatggcaatctgacaaagacatgtcatacatttttgaaatagtcaagaagactctaagaaatgtggatttatattcattgtcattgttgtattaaccaaatcctatatggacactgtgtcttgaagaattaacccaatggtgtttgaagaattaatgacttttgaagattttaaatttcattttacctcatcttttgaaatttctgtttttgtatttgttaaaaatattcctaatatattagtctattagtatatctctatagaaattaaacatccatgtattgggtgtgtatgctgaaaaatattttactagtaggagcgcatgtccactgtgtcagaatgtcatacaaatgagagtgtagtttgttcttgatgggcttttagcatcatcatgtcatattgctctcatgtgattggctcaccagaaagccatttcaggaatgtgtgttattagtcaccatggtaatggcacagctgggaggggaatggatcattaaagatccatcatcactattgagttagaaattaactgagatcacacattcttctgaggtcaggtcatcttttgcttatagaaaaaggcaacccttaaaatttaacagatttttaaagatatgtattataggcattacatgagcttatgaggttgttcatacatttggaagtgaaagacaaaaccctagaaattgactatttgtcaagcattttgttatttatttgaaccctgcaacaactctgtaaggtagggatcatcctcattgtatgaaaaataaagataaaatcacagaccttaagtgacttgtcgaaactcacatatttagtaagtatagaatgagggtgcaaaattagatgattggtattagccaatattttgctgttagtttccaaaggcaaagaatacataggcattgtatcaagtcacctaatccagtaagtcctcacttaacatcatcgatagcttcttggaaactgtgactttaagcaaaatgacagataatgaaatcaattttaccataggctaattgatgtaaacaagagttaagttcccatggcatattcctgctcacaaaaacatcaccaaacttctaaataaagaccaaaacacttctaatattgaacattgaatacatgtgagctatgcgtacatttaagaaagacaaataaaagcaagtaagataattttttttgatctttggaacccattcaatgtttttgtagacatattcttttttttatccttgttttcattttttaaattatactttaagttctagggtacatgtgtacaacgtgcaggtttgttacatatgtatacatgtgccatgttggtgtgctgcacccattaactcaactcgtcatttacattaggtatatctcctaatgctatccctcccccctccctctatgcagccataaaaaatgatgagttcatgtcctttgtagggacatggatgaagctggaaaccatcattctcagcaaactatcacaaggacaaaaaaccaaacaccgcatgttctcactcgtaggtgggaattgaacaatgagaacacttggacacaggaaggggaaagtaagataattattaacccagttattctagttcagggttgcaggtgctggagcctatctaggcagctcagggcaccaggcaggatccagccctggctaggatgccatcctgtcacagggtgcagtagctcaccatgctcactcacactgggaatgtgtagacacgccgattaacctagcaggcacatctttgggatgtgggaggaaaccacagcacccagagaaaacctgtgcagacttgaggagaatgtgcaaactctacacagacagtgaccctggcccagaattggttttttccttatcaactgtataacaaaaggatgttgaatgaaatgatgttattcgaggatctgctgtaatttgaaggtactcacaatttccagacacgaaaggctgtgtaacagtggactttataccctgagagtgaaagtaaaatgttcactctgagggctggagctggaatctttccttcatctatctctgttaggtggtgaaaagcaagccaattttggttgtgcttattgacattgtatcatcttatgtcatttctcaagtgaaagttctgcatttttgtatgagtaagaggtccctcgatggagctttgccaactgtttctctcaagatgttctgcagagcatcagatattgacctaaaatacaataaatgggcatctctctctgttaacaggaccattgccaactatttggtgtggagaatggtttattccagaattccaaaccttagcaggcgctttcagtatagatggctggaattctcaagggtaagtttaagaagattgcagtgttacatcgctggataactttacatgctggaatagtccatatattaactgatccagtaaaaatcatctttagggattagacagggggagtttgtagcccaagctctattgtttttgtgtgtgtgtgtgtgccttatttatttttatttaggtataaattacatatggtaaggtacactcaagttttactttgatgggttatataaagatatttagagaaatacttgaggccacacattgttttcaaacttccccgtcttattagtgtattcccattttcccccagagtttttaactgggtcactgtaattatagttttaacatttctttgtgatatatttgtaactatcttttattctcagtattctgaatatttaaaatgtgcatgatagagatattggatggtagaacttcattttcaatttggaaatggaattttgtcttaaactttgcctataccttccatctttgaatctatcctctgctaggtccaagaggctccaatttagttttcttgctcaactgtctgagatggttttcctccacctgctcacctggctctttatttatttatttttattagagatggggtcttgccatgttgcccaggcttgtcttgaactccagagctcaagtgatcctctcacctcagcttcccaaagtgctgggattaaaggcacgagccactgtgccgggcctcacctggctctttaacctttgcttctctcccacccttgctcgtctcccagtttgtacccatgttactctcacctttgtttttgaggcttatgtctgactaattctcctaccactagaggccgtaaggattttgtatctttgaaacagtttttatttttctatcaatttaaagttaagtgaatggtgaatcttataagctatgatttcattcaagaggcattttagttattagaggaactaataagtatagaaattcttagtgggccattactctggaagagtagtgcaattattttggatatgctttgaccctataaagtcactagcatataaagttactttagggctgggtgcagtggctcacacctgtaatcccagcactttgggaggccaaggcaggcaaattgaggtcaggagtttgagaccagcctggccaacgtggtgaaacctcgtctctacaaaaaatacaaaaattagccgggcatggtgtcacgcacctgtggtcccagctactcggggggctgaggcaggagaattgcttgaatccgggaggcggaggctacagtgaactgagatgatggcaccaatgcactccagcctgggcaacagagcaagactccgtctcaaaaaaaagaaaaaaagtcttttttacagagaacagcataaaacaactatatatatatttaggtcatattgatgggttaagatacaaaacaagtaggttttgtgtgtgtgtgtgtgtgtgtgtgtgtgtgtgtgtgtgtgtgtgtgtgtttgtgtgtatttttaactgctacgaatcacataaaagatgatgcccagctgctttccacccctactgtgaagagaatgagagaggtgtaagaagcactgtgtgaacatttaaggttaggtatgaggggatgtttcttgagcacgaagtgctaaatataatattgaattgccgaagaaggttgtaggatctctttctctagaggttttaaaaatagattcatcgcttacctctgagagaggttaccagaaatcagaggaagaatagatgaaattaagccttaatcccattcctcaaaacaacctgggtctaacattgtgcaaaggacacttctgaccaccattctcagggcctcccttcctccctgcctgcacccccagcttccaagggcaacttacactatatttatttctctgcttttattcccaagagtaaacctctgacccaggtcctgcttgggaaacttcttacttgtttgtaaatgttttcttgcaatggtataattgggacagatgggcaaagcatttacatctgtattttgcttgtttatcagtgtgttttttgctgtgacacaatgtaaatatgctccctgtgttgttcatggtgggccatgttcttctggtctgccttgttgagtgtgctactcggagcaaggaaaccctcactgggcaggaactttgatcacccactgattctagaccttcttagtggaactttagttctcaggagatattaaatattatctagacacttggatagcatcctctcatgtccctgctaactgcagaaaagtgataccattgtccagattctttgtttaatggggaaaattgggaagaaaggatacatatattattttaactgttaaatcactttcttttcttcttcttctttttttttttttttttttttttccagacagagtctcactctattgcccaggctggagtgcagtggcccaatctcagctcactgcaaccaccgcttcctgggttcacacaattctcccacctcagcctcccaagtagctgggattacaggcatgcaccaccgtgcccggctaatttttgtgtttttagtaagcacggggtttcaccatgttggccaggctggtctcgagctcctgacctcaggtgatctgctcacctgggcttcttaaagtgctgggattacagatgtgagccactttgaccggcctaaaacattttcatttagtttgaaatataatggggacaagcagaatttttttcttcaactattttacctttgcctctactatctgatgcatatatatgggttagggtgtgcagtgttttgtagactgttttcttcaggttgtttgaattgttttcagccatgggttttatccaaatgaagtttaatctggatcaattatctcccacaggtaatccaggggaccacaactttgctgcctcaatgggacaaatgtgtaaactttattgaaagtgccctcccttatgttgttggaaagatgtttgtagatgtgtacttccaggaagataagaaggaaatggtaagtggtactccccagctagcaaaaaataatggcaatttagccagatctgacaagggtatattcaacaggctaatgtcagccttccaggtggtagtggcctgtgggtattgtcttcagattctttcaacttctaagtgaaataggaagaaaggtcatcaaacgagagtgaggatgagttagcaggtattgaaggttagaggagagagaaggtgtgtagttttccaggggagtgggagagtgaataaactgagggaatgtagtatagctgcttgagggcaggcatgtccagatgtaggtgaggtttgaggtattgaatttaaagagggactcatcactgtggcaacgtgttcttctccatctgtttcaactgcattggagaaaagggtgtatttttttttctttcagctttattgagatgcatttgactaataacaattgtatatattcgaagtatacggccgggcgcagtggctcacacctgtaatcctagtactttgagaggctaagccgggcagatcacttgaggtcaggagtttgaggccagcctggccaacatggtaaaaccccatctctactaaaaaaaatacaaaatttatctgggcgtggtggcaggcacctgtaatcccagctatttgggaggctgaggcaggagaattgcttgaaccccggaggcggaggttgcagtgagccgagatcgcgccactgcccttcagccaaggcgacagagcgagactctgtctcaaaacaaacacaaagtatacaagatgatgatttgacatacattgtgaaatggttgccacaatcaaatgaacacatctgttgtcacacttatttaccattgtgtgtgtggtggtgggggatgaggacacttaagatttactgtcttagcaaattcaagtatacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctggctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctattttccataatggctgtaccagtttacattcttaccaacagtatatgagcgtttcctttttttccaggaatattttgccaacacttacctcttaaatttttgatcatagccatcctaacaggtagtgaagtgctatttcattatggtttgatttgcatttccctgatgattagtgatgaaaaccttttcataaacctgctgtttatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcaaatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgagccactgcccatatacaaagcctggaatgtaacaaagagcccaccaagagttttgcctaggcttttcctggatcttgaagcatgacaagataatgaatgaattcttaacaggacccttttaggattaaacaagttttattgggggtctgaagaaactccacaggcctccacaaacaagtttactggggtctaaaggaactccccaaacctttatgatttagcaggagacaagataagggtaattacctcagtacctagacccatttagattaagtaaacttactgaggctccagaagaaggtcttcaagactcacacctagttatagattaaaagaagttaatcatttatgtctttcgacgattgcacactttcacgtagacatatagcttagaaggtatatgagctctagaaaactttgtaactttgagttggtctggtgataatttccaggctttctccctgtaaccagtggcagaaaataaaactctgttcttccccagttcatttgcatctcgttattgggccgtgagaaatagcagcctgaccctcagtttggtctgggaacaaattgacctatgttaacttgtttttactgtctaactatgagactttatgtttgaacctgaaagttcccttgcaaataattccactgaggaattaatggcttatttcaaaatactcagtattctcattgcgtgttttcttttgctctttggtcagagtaaatagattgagatcttatcagataatcacagtagtaatattataatctctgggaaggctataaaaacaattaaaggataatgaaagatttaaaaaaattatagcaggttttttggcagtagaagaattttaactaatatgaaaagtatgtggattaaacttgtttttctcagttttggtgtgaaagtcccttttccttgtgtcagggtatgacattctaaaataaagttaattttggcatcttcccccttattttgatgtacgtgggggtagtttggtagttaggcagatactcatctctttaacgtaaaattgtttgcctcccttgtgctgaagctgtttgcctcagggaatacttaggttggaaacttataagagaaatatctggccttttatagcctttttttttacagggctcccatccaagaaccacctggaaccactgatttacttgaaaaacattcagtattattagctacagtctaaagaaaaagaaaaacagaaagatccccaaaggggcaaattccagagaccctaactcagatggaaggctgccattgtttatttaccaaaaaagtttgttaagcaaatgaatacagtcagaagcttaaacttcaggtatgtctcaaatttacatgtgtacataaatcacgtgagcatctgcttgttaaaaatgcagattctcattgcattttaacaaggttttttttttttaagttgtgtttggggtaggacccaagaatttgcctaacaaggttccaggtgcgactgctgctgctggtcgtggaccacactttgcgcagcaaggtcttctcatgattcatttgtttgtaaacagccccaaaaaaaaaaaaaaaaaaaaaaaaaagcctcggtgactcacaagagcaggccaggccagttgacatgaatagcagtactttatttaccaaaaccggttacattagtgcaagtaactgctttaattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttctaaagagtgagtgggagagagcagttcacattgaggtttcctacctatcagtgttctcctccttttcactggggaaaacacataattctatattactgtttcactaagacttcctacatccaactgtgcatttggacacaccgatacaccaacgttctcatactcattcacacacacaaccatgggaatttagcaaattgaattagaaatgagaagaatagcatgtagaaaaggagagtccttcaacagaaagccaccaaaagaggtcatatagtacaatcccttgcctcccagttagcaggacagagccttaactcgtgagattggctgcaagtgttgctttgtctttgcagtccaaagtagcactacccaattgaactggaatatgagccacatattttttttgagacagggtctcactctgttgcccaggctggagtgcagtggcgtgatctcggctcactgccacctccgcctccctgtgttgggattacaggcatgagccactacccctggcctccattgacttttatattaacattttctccctccttacctccctttcttcccccattccccagaactaaaaatcataactttgtctatcagaggacttctttaattttttatcttatttagatgaagattatttataattttaaaacattccattagctaagcatttaatattacttttgtggaaagttacatgaaagtgggactcccctagagaattgatgatatatcatcactgtaaatagagatgatgctctcgttccactgtgccaagccctgatccatatgctcatgacctaaatggcaggagagaggattagttgtgttcaggaaggatgtctagagttatcacttgctaattttcccctttatttatttttattttttaatactcttgtctttttctttttcttttttttttttttgagacagagtcttgctccatcacccaggctgaagtgcactggcatgatcttggctcattgcaacctctgcctcctgggttcaagccattcttgtgcctcagcctcatgagtagctgggattacaggtgtgcaccaccaggcccagctaatttttgtattttttttgggtagagatgtggtttcctcatgttggccaagctggtcttgaactcctgactttaagtgatctccctgcctcagcctcccaaggtgctgggattatagacgtgagccaccacgcctggccttgtttgattattattattattgcttatatctgtaatgtataagtaagtgccccaggtagatactcatgtccatggagggcaggtgaaggttccaacgaaggccagggaatgaagggattgtcaccatgggcctagttgtgactgtgatggtcaggacatattggttttaaaatgtggtgatgataataacagtagcagttagctttcactgaggtttaactagctgtctggtattcttttaagtgctttcagtgtgtgaactcacttatcctcacaatgaccctgttactgctgttagtgccctcattttccagatgaggaaacaggctcagagagttgaagtaaattctctggagtcatatagcttgaaaatggcttaggtagggttcaagcccagacaatctacatggaaaccagtgttccattcccttgcttatctctgaaggcacttgaatctttgccagttttacgaatatgaggagaccagaaccttcttagtggcttatcttataattacccttgttagcaaattattctaatattaagatcctaaaagggcatacatttcatattttttaacatttcagaggtaggaaacagttggaataggtttggcttccagtatttcaaaattttaaatataaatatagtggaaacctaattcatatccaaccagttgacatcacatttttgtattcatataattctcaggagaaagacggaaatgataagaagcaagctactattgatttaatctaagaataaccttgcaggtatatctttggctcagtctacacactgagctcaatttctcgtattttgtacatacgtcattctaaggagtgatccctgatgtttgcagtggtaacccaaaggctctgtaagatttattatcaaagtttaaaaaaaaatgtttaccattctctactaaggcggaaatgtgaatatatacatcaaagaaattttttttctattgtgttgatgggaaaaaaggccttgttgctgtaactctagtttctagaaaattcagtaaagctgaagttcccatgtgaacattttggctgggctaagttcttctgtataaaccatgtcttggtttgtttcattgtagacactatgtccccaaactgcttatctttattcatatatctcatctctgccagtaggtattttttgctgctccctcaaattttctgcatttttcttatagagtaaaccctgctaaagcaaataattattttgacacttgttaaaatagtaatgaagactattcaggactattgcaagaggtgtcaagtctattgcaacaggggagaaagattaggcccaactctaaatacagcaaagatagctggagatttatagccagtgaggagaatgagggggtcagtggatggaaaattatgaagaggagacatcacgagcagggaaattcttgttaaaccaacttgacaggattcttgtggaaggcaggccaaggtgatcaggatggggattctttctaaagtgacttagcaggattcttgctacaactggactagacaggcttgtcgaggacaggatgggggtgggaggctgggaggagggtaagggcaagacgtacttgagaagagggctcagaggagcctgactaaactttggtcaaggagagagtctttgtcagctctcagatcaaagctaaagtcactgatctcctgtcatatattaaaacattctatatgcagaaggttaatctagttaaagcagagcaaatctattacacttcagattcagattttattaagtgaagaactaaaacttgactccctatgtagaacaattcactaatttctcctgcactctagcagctattctatttctctttaaagacattgttcatgtccccaagtaatgccatggatgccctaaaatatcttccattttttctgagctgctctctgcctgagcaattccagtagtaattcttatcctaagaaaagaattctcctcccaccccatactgctacatctggtgttgaagacttaaatacccacgtgggtccaattgcagtggcggagtttgaacttgcaacctcaatacactagaagttcacctcattagtgagctaagataattgaattgatgtactgccattaatattctttaagttctccaattccctcgctcactgtttctctcagtggttgagtaaatgagatgtaactataacgttgatggcagaagtcacatgaaactcagtgtcatgcattatagcattgcccttatactgaggagtttttcgttccttgcaaattcagctgctcacaaaggttgttctcagtaaagccactgtacagataaagacaatggtcccttcatcacaaattgtgaaagaaaggatattctctttggctactaaatgcccgtttctgtttgtctagtaagtggtgttggttattattatcaagatcactttccagagaaactttgctgaagacctgtccaaattaaggcaaaccatgatgatttggttttttaagggctttttaatatatttataaaatattgacctaatatagaaattacatctgattttctgcaaagttgcattgatagctcatagcccagctctgctcttaccaacatgggcaaatcagttaacttctttgagcttgttttcctgttataaatgatgcaagagtttctgttgctttggtaatgctgtgtaacaatcaatcacaaagcctcactggcatttgacaataagcagttactgctgatgcatctggagtcagtggtgggcccccatgcagctctgttgattttggccaggctggcttgaatttctgggggttggctgatcaaggttggctttggcagaggtgattggaatgactcggctctgcttcatgtgtcctgcttccttcagccggctagcctgtgcatgttctcatggtgatggcagaagttcaagcaagcaagtagaaacatgtgaggtctcctgagacctaggctcaggacaggcataatgtaatatctgcattttgttggccaaagcaagtcacaaggccggtccagatttacagactagggagatagggtctgcatttttttttttttttttttttttgagacaaggtctggctctgtcccccaggctggagtgcagtggtgcgatctcggctcactgcagcctctgcctcccaggctcaagccatcttcccactttagcctgcgagtagctgggactacaggtgtgcgccatgatgcccggctaatttttgtattttttgtagagatggggctttggcgtgttgtccaggctggtcttggactcgtgagcttaagcgatctgcccgccttggcttcccaaagtgttaggattacaggtgtgagccacctgtaactctgcatttttaatgagaggatctgcaaagtcacacagtaaggggtgtggataaatgaaggagtatggcattaaagctgtcagtgctgtgtatcacaaatagggataaaagtatacctccttctttcatttgaggtgagagttaaatgatataatctatgtagaaggcctagcataatacctggtacacaaaaagtgctcagtgaatgtcatctactcttattgctaatattgccatgcctaatgttaataattaagatagaatttataatatcaacttcctggcacaggctgtggcaacttctgcatttagattgcctctttttaatttatcatagagtgagggaggtgcctggggggttttgctgtcgctactcctccatacatgcctagtatagtagctttcattggaataaagatccttttcatgttagtgccctggccacattccagaacccaccctatcatttaacgccaagtctggctcatacaagagtctcatgaaattactcatgaaattactcgaggagccaaatataatttctttttcttttttttttttttttgagaccaagtctcgccctgttgcccaggctggagtgcagtggtgcgatcttggctcactgcaagctctgcctcccgggttcacgccattttcccgcctcagcctcccaagtagctgggaccacaggtgcatgccacctcgcctggctaattttttgtatttttagtagagatggggtttcactgtgttagccaggatggtctcgatctcctgacctcgtgatctgccctcctcagcgtcccaaagtgctgggattacaggcatgagccaccatgcccggccatgtaatttctagaataggtccagatttcataaccctctgcaggctaaatcttgttacaacaaatatcatccggtcccaatcgtgacagctcatttatgcaatcttcggtcaagtaacatccagcaaaacaagtaatttagatagctcattgggaattcttttgaaataagtatgaacacttactcttgtccttgtctttgagtgtgctgccacgacgatgacacattggctcacctttcttgtttgttttctccatttctggctagcattgggcagtgttgcctttgccacatattatcagccacagtcttgtcaagcagatctggtcagacctatggaatgtgaagaccctttattagaaattcatttacctaaagaaaacatttatgccttccaacagatctgaatgttggaagtgaccagacatagttacttgctggggagaatttacccacagccaaaggctagactatttgagactgattgacttgtaaatattattctggtttctgatccatcctctcttaaagttggaaagtggaaaacaggaaaagatgagttataaaattagaacacagcctatatgttcatatccagcaaatagaaatataaatatctacctgagtcttatgaatatatacctttagataaaaggacatgagaaactcctcctgtaccaccagaataacccactttatagcaccaaataatttgattttttcttcttttgccaaaatgtttaatagctatgtaacactgctaatcctgacaaactgatatgatttattcactcacttggctgccagaaacctcagcattttctaactatccttagttcttctggtttaaccacatgtcccacttcaatataggtcactttttacttattttgttgccattattttttatcaggagccaatccaagggcatttttataaatagttatagtataagtaattaattaatgaatatttcatatttattggtgcattcatttatttaatgtctgtgtttctagtaaagtgacaattgccagaaagaaaattttaagagtccccctgagattaaagcctatttcttcagggttatccacataaattattaacaacgatttccatttttcacattccaccaatcagtggttacaactcaagaaaacttgccctgttctagagcaatgagaagactggaaacattttaatctcatggtttttttccagatattataacttctaagtatgttaaagaggaaagcctactcaacattatgccttttcgttaagaattttattaacattaaattagtttaaggttaatgcccataatcaaccttactgattttttttctttttcctttcttttctttttcagaactcctagcctataattattcctactagatatgtactatatttttaaaccattccaagctgtttgtcatgtaccatgttgacatcacctatcttagaatggactaggctaacttacagagtcacttgatttccactaaagtttgtgtttggtagtaggctacagtcattctggagacatttgctgtgaaccttgtcccctaatataacgatggattttctattcactgataagttctactcatggattcaggctttgaattactaaatcagagtaggtctctcttttcaaaaatgacttcacctaaaaagggtaccatgcattttttttttccctttttcagctttcatgttgttaaatctcatgatcatatctgcacagcaccatattttctatgagtgagtttgttaatattttctctttatactattggaataactgttatctgttagcatatatgaaagatatttgattcaatttcaactctgctaggtgccaattgaaggtttcaaaaagcataaattgatcagcttgtatttactgagcatctgctatattttagtattaggtatgaatgtgagatatggactcgtgaaaaatcatatcacatgagatatgaaatcataaaactaacaaaattttaaattagcagaatacttttttgtttgcttacatattcatgatctcatttgatctaaatcatggttcctgttctcaaagcttatgggtcttgttagggagaccaaataaatataaatgaaaagacaacaattaaacacacacctatgtattattctgattttaagcctcacaggaactcagagagggaattgaaagtgtgggtttaagtgtttgggattcatgggtatgagataggatttgagttgccttgtgggatttctttattatcagggacaaagctttgaagaaaactacaaccgatcatggggcaaactaatccctccttaaagcaatgttggcatatgtcccttcaaatgtattaatagaaccatcatgactcatttatgcaaagtacagaattcttatgtctatgtgatgggaggaagggtaaggagagggcaagaggagcaggagagataatttataatttgctaagataggagcatctcattaaagtaaagccctggattgaagggtaacaagtgcctatgcatatgtgactcaccaatgtctggtgtctgatgtagaactctatgggcaaaatcctggggtgcaaagaatgaaaaaggaagaacctatttttagataacactggttgaggaagagaactaagaactgcccatagatcaaccaaatgaactgtatttttatagtgtggatccataaaatctgaaatagttgtttttttttttttttttttttttttgagacagagtcttgctctgtcacccaggctcgagtgcagtggggtgatctcagctcactgcaccctccacctcccgggttcaagcgattcttgtgcctcagcctctcgagtagctgagattacagttgcccgccaccatgcctggctaatttttgtatttttagtagagacagggtttcaccatgttggccaggctggtcttgagctcctgacctcaggtgattcgcccacctcggcctcccaaagtgctgggattacaggtgggagccattgcgccctgcccctgaaataaatagatatttaacaaaacgttgctttgcctagagggctcttaccctgaatatggcagattttaccaaaataacacttgagttaatttttatatgttatattttgacctttgactggctctaaataaatatttcctatggataacttcaccttaagacttccactttaagggatttctattaatgttatatgctgcctggttgaggtgtgaggtccaagtttggtgaagaaatactatttctctatttttttcttattttaaaattacagcaggtttttgacttgactgaaggcaatgttattatgtgatgctgtagagtagtctaaagataaaaatcagaagtgttcagtgatttatcttcctagttccagcatgctaaaataattatttctcttatttgcattgacatgtcaaccaatgaaattaatcaccttcaaagattttccttgttcttgaagtctgctggggtagttcaacaccatttcacagaaaatgttatacaataaatctgtaaagtctgccaaaaaaaaaaaaattgagaacctgaggtgggggatggtgtggggagtggaggtgccagagaagacaagggcaaagagcagctgaggctcatgggaaaaaaaaagtgatttacccgcgttttgacaaatgtgagagggccacaaagagtgagttaccgaagtgtggattcagggaagacagaggtggtgggggcaggggaggaggtggaagaaaaggcagaggagggaggaactggcatgtgaataaactatttgtcatttttcactctggcagtgggctgaaatgtttttgcctctttttattttcatttagaatgccaatcaatgggttacagacaaagagctttgaaaaccttttcttatttatttatttagagacggaatcttgctctgtcgcccaggctggagtgctgtggcgcgatcttggctcactgcaacctccgcctcgcgggttcaagcaattatcctgtctcagcctcccaagttgctgaggttacaggcatgtgccaccacacctggctaatttctttttttgtatctagtagagacggggtttcaccatgttggtcaggctggtcttgaactccagacctcaggtgatccaaccgcctcagcctcccaaagtgctgggattacaggcgtgagccactgcacccgccctgaaaaccttttcaaaatgcattaaattttaatgaatttgatagccattttaatgcctgggagatgctggacagggagggtcctatgaaaccaagctgcttagagagaagtatctggaaacactcagccccattttaataatagccacatactccataaaaatacctcaaagagaacaggagcaaaatgaccttaagattcatcataggaatccaaaaattccaaaatttgctgaagatctttttagcttggagagtgcttatttttttgataatttattttaaaacctaataaaatgttttgcttttgtacaccttgtcccaaataaatattttctttggacatattcaactttttattatttattgggtgctttctattattgctacatcctggccagggtattgagagggaaccttttattgtcctctttgtccctatctgtaaatatagtaatccccccttatctgagacagatactttccaagaccccccccaacccccgcccagtggatgagactggagttagtactaaactctatatatactatgtttttcctatgcatatataactatcataaggtttattttataaagtaggcacagtaagagattaacaccaataactaataataaaatagaacagttataatgatatactgtaataaaagttatgtgaatgtggtctctctttctctcaaagtatcttatggtattgaactcatgcatgtacttcctatgatctgtctgataaccaagatagctagcaagtgactattgggtgcgtatatacagggtggagatgctggacaaacgaagggtgattcacatcccgggccagacaggctgggatggcatgaaacttcatcacactaatcagaatggtgtgcaatttaaaatttgtgaattgtttatttctggaattttccatttaatattttcagaacacagttgcccataggtaactgaaactatggaaagcaaaatcgtgaataagggggtactactgtacttctcttcctagtaatatgttcatgctgccaggatgcacatagccatgtgcgaagaaatataattttttagataaacctccctttaagcagaaggtctcaatcctatttcatggagaaaagacccacgtttatactaggactctctcaaccttctacatctaatctttagattcttctgcatgcctgcctatcattttaatcttctctcctctcataagtctgtctcatatctaaggtgaatccttccatatagtctctggatcccatcacctcctttgccctctgagacaccactcatggcttgctttgtcccatattttcagtctcttccttttcgctggatcctttctattggtatttaaacatagtcaaatctctcagcttttcaacaacaacaaaaacagtaggaacagcattagcaagcatatgcatgaaacccaaactccaaaccctcagacccttcccttaaccctacctctacttctctcctatctttgctttttctccttcatagacaaactcaattaatttgtccagacttgctgtcttcgcttcccacacactcttcatcccactagtttggcttctgtccccatccctctttttcttccaattttctcagtcttattgaatgacggtgtttgccaatatctttctgaagcctaggaatgaatctgactctctctgcgttcctcactttcccacataaaatgagtcacctgtttccattggtttggtcactaaatctctcctttgagtccacccacttctttccctccccattgcccctccctaatttgggaagatataatttctttttctctgtgaacgtgatgggccagccaatgcatgttgctacatgatgagtccctaaagacttaggaccaggtgtggtggctcacgcctgtaatcccagcactttgggagactgaggcgggtggatcacctgagctcggaggttcgagactagcctgggcaatatggtgaaagcccgtctctactaaaaatacacaaaaattagctgggcatggtggtgcatgtctgtgatcccagctacttaggaggctgaggcagaagaatcgcttgaacctgggaggtggaggttacagtgagcagtgagccaagatcatgccactgcactccagcctgggcgacacagtcagactcattctcaaaaaaaaaaaaaaaaaaaaaaaacttaggcatgctgataggcaaaagatctagtccccggagatttccttgtcattttaacatcctcctgatgtgggttttctgtttgaaattgtgacttatgcatctctcagttgattccctttcactccctggcatttctctctgattttgggagggatcctctgttgttactagaggctctgagctctccactgttattttagctctttggtcaggtcctggctctggtcctcattagctgtgtcagcttgagcagatcatagactccttgacccttaatttccttatctgtcaaataaatggtttcccctggtctagtgggtctcagccctgactgcacattagaattacctggggaactttttaaaccctcccaatgcccaggctggacctcagaacaatgatactagcatcccgatgcccacgacgcaggattttttattttatttagaaattttttgtcagtattattttttttttcttttgagactgagtctcgctctgtcacccagactggagtgcagtggtgtaatctcagctcactgtgacctctgcctcccgagttccagtgattctcctgcctcagcctcctgagtagctgggattacaggcgcctgctactacacccagctaattttttgtatttttagtagagacggggtttcaccatgttggccaggctggtctcgaactcctgacctcaagtaatctgcccgcctcagcctcccaaagtgctgggattacaggtatgagcccctgcggccagctctcagtattttttaaagttcctccaaagattctaatgggcagacaaagttaagaaccaccgacttaatgatttttaaaggaccttttgctctttgctcttctagcagtttgtgttttatcccaagttgaagtttctcttcttttaatgtttttaccaagttgggaagaaatagctgtgaagctcccccgacccccttccatctgctgtttgttcttatttacatatgatggaacccagcccactgatttatagctctggttccctcacaactgttattgaactgaaaacatagctgaaaacttattaaacagaaaaaacttattttgagcttcatgctgacaatttattatagaaccaaggaaacatttcaacgtctttccttctagagttaatgttaacaattgatttacaaccccatgctctcaaatgaaaaagttcattctggggccaaacccagtgttttttttttcttgggtgtcccattgagaaagccaaagcatctctgcaggagaactggatttcgaggggtttgtatccatgaacaggcagggcctcctcacattgctgccggtggcctctaatgtgacgtgtcagtagcccctttcctccagtcctctcttctggtccacagacaccggcagcaaagccaggcacgtacatcctcactatgggtgtggcctcactgttcaaatgctttgcgataggtctttcagaagtccacctttcggtagcagccccctttagacctaccattttattttattattatttttttagagacaaggtctcactctgtcacccaggctgaagtatagtggtacagtcatagcttactgcagcctcaaactcctgagctcaagtgatcttcctgcctcagcctcctgagtacctaggactacaggtgcaggcgccaccatgcctggcctttaaaaaataattttgtttttatagagatgaggtcctcttgtgttgcccaggctggtctcgaactcctggcctcaagcaatcctcctgcttcggccttccaaagtcctgagattataggggtgagccactgcccctggcctatacctacccttttaaattggaaataacaagacttttctgagctgccaaggagtagagaggagagtaggaagatgatatagaagagccgaacatttagtttaacccacggaactaaatctggaaagaactggggtcctgacataagtgtgattcatattggtgaagtgtcctttggggtgctaagtctccctgcccgtttctctgtgttaacagttatctctttcaactgttcactttcttctgcaatacctatctgaaatgcacagcccatgcctttcctgtctctctcagtcctttattaaatgattaaaattagttggcaccttgataaggatgaactagtttagtagctacagacaggtaagttattggtttgtcataatctatggtgaattcctatccctgtatacccgtataattcattttatagctgggccaccacattattctcatggaaagaaatggttttttttttttaatgttttttattttttggagacagggtcttgctttgttgcccaggctggagtacagtggtgcagtcatggctcactgcaacctccacctcttgggctcaagcaatcctctcacttcagcctcctgagtagctgggactaaggcatttgcctctacaccaagctaatttttatattttttgtagagatggggttttgccatgttgcccatgttggtcttgaactcctgggctcaagggatctgctcatctcagcctcccaaagtcctgggattacaggcatgagccaccatgcccagctaatttttatatttttggtagagatggggtttcaccatgttgtccgcgctggtctcaaactcctgggctcaagtgatccacctgccttggcctcccaaattgttgggattacaggcatgagccaccatgctgggcctggttagttatcttttagtggtggaaaaaagggaattttcctggaaaaagaagtgttgccagagcatggagtcaagctgaaagaaccccttacttaccatgttgagtaaagagtcatttctcatgcaagccaattttgttccagaaaacctcgactgaagcttcttggctttgacgttccctctttgggtattttcttgtagatggaggaattggttgagggcgttcgctgggcctttattgacatgctagagaaagaaaatgagtggatggatgcaggaacgaaaaggaaagccaaagaaaaggtaaggattccttttgatgaaaaaaaaataagacttctggtttaatggatgttcatgcttgacattgactgtgtagttggtttttatattgactgaactgttgactctgaatgaccccagagttagctgtctgcttttggatgaatacatagatttttgtttcaccaggaggtaagagaaaataatacctgaatttttcgaactgcattttcaaataccttgtaattcggcctttcctttctcctaattgctgtctgtaagaggcacatggcttgctgcctggtgaattgtgtcataaaccatcactggatatggcagaatgcagagcagtggggagtcacagggagcagctggaacaagagcccctaagacaccaaaacgaagaaaacccatattggccacatgtccttctgctctgtgcatgatgcatgcaaatgtcctggggcaaatcctttcctgtaaccaagcatatctccttcccgacccatcatttggcacaaatgacccaaatagtatactgataaactgcagaccagtgttctaccattgcttaggactacaaacgtatttcctaatagaagtggacacttgctgggccttgtaaaattttctgatactatgcgacacgataagggaacaaaggagaaaagtattgacagccatgctgtttaaaagtagaaaacgggctgggtgcagtggctcacgcctgtaataccaggactttgggaggctgaggcaggtggatcacttgaggtcaggagtttgagatcagcctggccaacatggcaaaaccccatctctgctaaaaatacaaaaaaattagtcgggtgtggtggcatgcatctgtagtcccagctactcgggaggctgaggcaggagaatcgcttgagcctgggaggcggaggttgcagtgagttgagatcgtgccactgcactccagcctgggtgacagagcgagactccatctctgaataaatgaatgaatgaatgggatccattttgaattccagagattctgatagagctggaattcaagtgggtggagcatacctgctagactcttgatggatgcttctctgcagctgagcatttcttgtatctagaggtatttttgaaagcttcctgagtataacaatcacctgggttgcctggacgctctggctttctgggccccttcccagcaaggcctgggttaatggatcatggatgcaggctgaacagctgtcactttagccagtctccgggtgattgttatcactaggcaggtctggggaaacactgcctggagtcatactgagtcatactgagcacaaatatttttgcctcagcgttctgggaatgcttaaccttgttgaaatgagaacacgtagagttttagcaaggatattttctagtgctttaaactcatggtactggagatggataaacattgccatagatacttttgtcagtagatgtgaaaaggcgtttgttcagtgtttataatgaaggaagaactgggatggtgggtggcaaggcagcgttggaggaagacaaagagtaggtttgattttttgtttccccttcaaaaatctgtcaaagctgtcctcagtcacataaggcacaggctgatgaaggcaagagcacatgggctgtgatgggaaactctccagatggtagacaactttcaacaccaacatattgttgttttatgaaggcttcatttatttgctgagctagcttgtggtatgtggaacaggatgtgtcttgccctgggcagttgagcgcttagtgtattaagggctctttatcctcgcctgaccccacatgaaccgaagaggtgcttgcatgaattagtacaggaccaccagggtggagggtggggtggagtgtgtgtgtatgtataggtgttgggggtaatgtgttatgaatagctggatgccaggggaatgttctgggaagtgcagtcagttctttgagcagtgtggattgcagttgcctcagggagctcttctgagtggcataagggagtgggtgcctcacagttggcccttctcggcaagtggcccatgggtccttcttgaagcaggactattctcagttcttctaatattagacatgttcctgtttgcctcccgagttgctctccagtcttctattttatttcaatgagagctgtcagtttttcttctaaaagcgttctttgaacactctgctttctttgagctgagttcaacctgccaggaactctgctagttccacgacaggtacaaatatcaaaggcaaattggatctcacaaagttccccgactgtatcttgcatttcagagttcagagaagtttctttaacgaaatgcaagaaagatggatgttgttgaagcaatttcagcagttctttgaagtgggtcctttcctggaccccagaagatgtaaattttttttttttttttcccctcaaaattaaatgaacatgcagttcttaaaatgacctctgggtggagctcgtggtactcacaaagaacactagcggcgttgaaagcttttatgcagctttctactccggcgttgtttttgaaaaaaaaaaaatttcttgccctttttctctgctgtcctcgatttgattgccttttaatagtcaacaagaaaggagagactttgcctaataattccttgaatcttagatggaaatctcccactatcttagggttttgtctttctgatactgagtagcccctgcattaagaaaggatttgcctgcatttgaagtggaggtgaataactcgcctgctcttcctggtatgacttggcactgttctttgggcatgtgttgtatgcagtgtatcacccaggcggaagatttctcatcaataatagtgcccacactgggccaatgctgagtcacttggcaacccattgggaaagctggaaaaatgttctgatttgtgaaagggagaagcttttctttccctcaccatgaagctctggaccgcagctaattacagagcctcctaagaagtgttaacctcagcattccatagtgaccgacctcctgaaccgggcaggtacagaaagctgcagtgttctgaggcctaataccttggcttttgtagcaatgacctcgtctcaaaatggaagtgtgtggatgtggctttgttgtactctttgctaggggtgttcactgtaaaagataaatgaggatgcctctgctcccgtgaagggtaaatttgttttctctgtctccctgccttttcctgctcatctcttaagaggtcacgagtagtttttgtattgtgaaactgatggtgtaggtttcaagtggaaatttagtatcgtgaaataagcaccgctttttgtttaggattctctgttccctgcaagcatgtgctcttattgtaaataagcagcaaaggacagggcatctgttatttttctggtgaccacagctgttgaatgagtgtcaggtgataaaataatgattttaggggtgtcttctggaggatttgcccttgccagagtagaagaggaggatctcaaggtcgctacatcaggattctgactgagacctggcaggagagcgtcagatcaggaggagcaacttcctgagcttggcttatctccagctggatttgactatatagccaaaaagctggatcccttcggaattatttgtttgtttgtgctctttgcccctgggacctaagtttgtcaggtcacatccaaagaaaaatagcaggatgggactcacagggaggtggcatcctaatgatgctctgagggagtggccttaaccttggccacagcaggtgcagagaagtcggctgaatggtcctaaatttattggcatgtgactctcacacacaggctttgagtgaggtggtgagagttttcttgcagagggcgaaacagaggtgtagcccacttctttggctttgtctctaagctctaccaggcctaggtactggacttctcccaggtatgcggtcagggctctgcttatatccggagcctggtggttctcaaggtgtggttccagaccagtagcagcagtggtccctgggaactcattagagatgcaaattttcacatccccacctgctgagctctgggagtagggctcagtgccttgtgttttacctggtgattctgctgcgtgaaaagggttgggaacccctgtcttgtccttaccacttcacagcacacctgcctgacttccaactgcagcctcctgcattttggccaagagcattctctccctgctacagcctgctttgctactcataaagagggcccaaaggacggggaatgaccacaccttcctcagaagtcctcacccaacagttgatgggagttgctgtgtgtggcccccgctccctcatccctctagtgcgtgttccacatgggctctgggagcttttccaatgggctagagctattatactagctaagatactcgttgctgactgcctttctttctctacatatttcctctttctcctaccagtgtttcttttgctgcccaaatgaactgctcgcacttgaatccttgtcttagagtctgtttctgggggattcccaactaggacacagcccctgggggtatacgctttcccagtgcttccttgcctgtaaggcaacagcacatttcaccgagtctggttgctagcactgcttcagcagactcaatgccacaaacatttctagcacaccaacagcatgccaggtgctgagccgggattcggactcagagatgagcagccacagtcccttttctgcgggggccttcaggctcctaggagagaacaggaggccatggatgcagggcagaccaggagaagtgttaggtaacgtgatggagacgaaaggggtcctgggagtctaggggagctcaaacatgacatgtgagggtgccttacttgggaagtgcctactctgcccctttctctcttcctctgtggtgttcccacaccctgtcttgcagccttgtggcaagtcttcctcttccttccttactaatcccaactctgcatctggctgtcacttccccttgataccttcactcctgcttcacctcactgtgcattttaaattgtttcgtaggagaaaagaaacagaagggctttcatcaaactgtctcctgccctttccagttacagattctagcacatttgcataaccgctcaagaatgcagtcaccctgcgtctggcatccactccagggctcaccagggacagtgactggtagaccagcatggaaaccgcgggctgtggctccctcccatgtgccaccttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccaccctcagttttcacatccataaactggggagattggtccctgtctcagaagatttgttatgaggattaaaagagccactgtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtattgtcgttgtgatatatattttaaacacaaaagtaaatatctggtataagtgggagtttgatgcatatatctatttattttttcgagttaaagtctcgctctgttgcccaggctggagtgcagtgttacaatcatagctcactgcagcctgaaactcctgggctcaagcgatccacccaccttagcctcctgagtatctggaactataggtgtgtgcccccacccaccttagccttctgagtacctggaactataggtgtgtgcccccacatccagctaagtggttttcttaatttttttttttttttttggtagagatgggatctcactgtgttgcccaggctggtctcaaactcttggcctcaaccgatccgccagctacagcctcccaaaatgctgggattacagtgtgagccactgccacacccagccaacatatatttattaaaggcatagtacatgtgatatcttaccggagtgattttccatgctctagagcctcatgtaaatgtcatttagggggatgctttaggtcattcattctcacacttgagcatgcatcagtgccatctgaagggcttgttaaaacaccaattgccagccccacccctagaatttctgattcagtagtgctaaggtggagcctggatatttgcatttctgacaagttctcaggcaattctgatgctgctggtctggggcctgtgctttgagagctctaggtgattacaagtgaaaatgtccttatgccaagcctgtgttaatagaagggtataatgttcattaagtgattgtcttacctcttactggagtccccttttcaccatttctcgcaggtgggtcccctgagtgagtactaggacacccagaacccagccaggccacctactctactgttgctgtctctgctaaagagccctgcttgagagagatccaaaggctctttcttggtcatttctgctccttgactccacatctgtccccaggaactacccaggttaagtcttccacataaaagcccttccaacgtttgaagatgtttaaatgtttttcttttttctttattttattttatttatttatttttttcgagacagagtcttgctctgtggcccagactagagtgcagtggtgcaatcttggctcactgcaacccctgcctcccgggttcaagtgattctcctgtctcagcctcccgagtagctgggaccacaggcatgcgccaccatgcccggctaatttttgtatttttagtagagatggggttttgctatgttggccgggctggtcttgagttcctgacctcaagtgatccgcctgcctcagcctcccaaagtgctgggattacaggcatgagccaccgtgcctggctgttttttctatttcaaataaaacacctttagtgtttctcacattaaattaaccaacattacagtcagactggatgttctaaatgcttcacaaatattagctctctcaatgccataatatccgtatgaggtaggtactttttttttttttttaatacagatgaggaaactgaagcacagagagtgtgagcacacttacccaaggtcacacagctagtaggtagaagagctgggattccctccctagaggtctggtttcacagtctgtgcttttatccgcaatgccagtgggtctcaaagtgtggtccccagtccagaagcatcgccatcactcaggactagctaaaaatgcagattcttggctctatcccacatctatagaatcagcaactctgggagaggccctaggcatctgtactttaatcagtcctgctggtgattctgatgcagcccaagtatgagaaccattgctctaaggtgtggttctgatgcctcatcctgctggctgctctccagttttcaatatcttttttagaagcttaagttcaaggctgtgcacaatattctaggtatagtgtaactcacacagcacaatgggaatattattactgcctttgtcttgcatacaaattatattaagaaatccaaagtttacattatggctatcttttcccctcagccattcactgttggctcataacgaatttctagtcagttaatttctaggtctttttttccccgctcacaggaactgttgttaagccctgttgctccagtcctaaacttggcattaaaaaacaaacaaaaaaaaaaaccctcatcccagaacttcacatttattcttattaaaatccatttagttgttttggttcatggctctggctttcaaaaagtatatttctggacctcctacatgtttattattgttttaaaaatctatgctcatttaaaaaatctggaaaataaagcacaacagtagaaagacaaaaaaaagttctagttccatcatctaaacataactgctgctaacattttgatgtatcactttgacttttttcccatacataggctttgaaaggcattcttgaacaatgatgtttataaaaatttgagttcttttttctcttaacatttattataagcatttcttgtattattgcatattctttatgcaagaatattcactgttggctgggcacagtggcccacacttgtaatcccagcactttgggaggccgaggcgggtggatcgctagaggtcaggagtttgagaccagcctggccaacatggtgaaaccctgtctctactaaaaatacaaaaaattagccgggtgtggtggcaggcgcctgtaatcccagctacttgggaggctgaagcaggagaatcgcttgaacccggaaggcggaggttgcagtgagccaagattacgccgctgcactccagcctgggcgacagagtgagattctatctctcacacacacaaaaagaatattcactactatgacatattcttctagtggtggcacaggaggtactacttaaacatttctctatagttgcatgtttaggttgtgctgttatagttattactatgatacacatcttttgcataatgccttctccctaaatgtaggactaattccttagaatggcatctcagacaacctttgaaaaggtcaactctttccttcagtatatcaactactgtttctatgtcgttcataacttgataagtttgttttttagttttattattttggggttattatgaatggacatgctcaaaaaaagggaattggaatcagccaatttgttcatcctttggcaatgcccttccagatttatctattgaacaaaaatattcagggagaaacttctaagtggtgagtcttttgttaggtgccagtcaattcactaactaatagatttttggtctagttgttctactttggacaaactccatggaactatgatttaaattctcccttttgcctgcaaggagaccttgagatatttagcaatgcgttgatatcatccagttatactgtatttagggcattctttaatttaccaatgtattgttctgtttaaaatgtggaaacctgaggaaatgaacaaagcttcactgggttctcatttttctgaagttccatgttacctaagtgcagattatatcattctgtgaaaacagccagctgttcaggcaaccaaatcagaaatctcagtctttcctcttagccaacttgtaagcacaaatcgtgttgcttctttctgccagctctcaaatttataccatttctgttttagttattcccctcccttagcttctcatccttaaacattttttttaattgaggtaaaattcacctaacataaaactaaccattttaaagtgaacaattctcaattagatagaagaaataagctctcatgctcaatagcagattatagtgactacagttagcaacagtatattgtatattccaaagcggctagaagaaaggacttgaaatgttaccaacacatagaaataatgaatattcacagtgatgggcactccaaataccctgacttgatcattacacattctatgcaggtaaaaactactcacatgtacccataaatatgtacaaatattatgcatcaataaaagaaaagaaatgaagtgagcaattcagtggcacttagaacattcacagtgttgtgtgatcaccacctctatccagttccaaaacatttttgtaactcccaaaggacactttgtacccattaagcagtcactctccattccccactcccccagctcctgacaactaccaatctgctttttgtttctatggattcatgtattttggatatttcctgtgaatgagatcacgcaccaatgcgatttttgtgactggcttctttcacttagccttatgttttcgagactcatccactttgtagcatgtatcttctcattctgtttaattggcgtccccattgatagtcttggaaaaggaatagcaaaataaacccctgtagcatttctgatagtgagatctttcctgtcttctctgaactttttgcaatagcatcgtagtgtttattcatagctgaaatactatcccccagctatatattactgaattgaagcaactcctgtagggaaagaagtatgtctgactactttatttttgtattttcagaacctaatgtggatctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcatttttttttcccaagtttcctctaactgcctccctcactaaataacatgctccattatagtgtcttaaaactgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccattttactataaatatttcattatgtatctccaacatataaggaattttaaaaacctaactataataccattaacatacttgacaatattaacattaattccttattagtatcctgtctgtgtgcagtttcctgtaattatctcaaaattgtttgctttcttttttttgaaaaaaaaaaaaatggttgatttgaatcagtatccagatgaggtctgcatattgcagtcaataggtacatcttttaaagctttttaaattttaagagtaccgcctctccatccatgaaatttatttatgaaataaattgagtcatttgtctggtagaatttttaacaatcttgttttgctagttatttcttaatgttgtcttttaacatgttgttctgtctcttacattttctgtaattggttctatctagaggtttgattagattcaggttcaattttctttggataagaagacttcataggcagtgctgtgagcttcctgttgcatctatcaagaggctcacaatgccacgttgtcccacttgcaaagcgaagggcgatccgtgtgttcaggtgttgtcagcctgatcctttcatttgaactttcttaccattcctcatgcagcagtcctgtttcttggctgtacattagaatcacctgggaagctttttaaaaatcctgaggctcaggccacaccccatatgaagatcagactctctgggagtgggacacaggcattttctaaagttacccaggaggggcccggcgcagaggcttacgcctgtaaacgcatcactttgggaggccgaggtgggtagatcacttgaggtcaggagtttgagaccagaccagcctggccgacatggtgaaaccccatctttactaaaagtacaaaaattagccaggcatggtgtcatgcacgtgtaatcccagctacttgggaggctaagacaggagaattgctcgaatccaggaggtggaggttgcagtgagccaagatcatgccactgcactccagcctgggtgatagagcaagactctgtctcaaaaaaaaaaaaaaaaagttacccaggagatacaaatgtgcagccaggcttgaaaccactgacttaattgtttcagtggccattgataatatttcattgattcgtgattccattcggtgttgcaatgtttgattttcaaattctatcattctttttgcatttattagctaggctgtttttataaaaaaggattttccctcatcaaccacttgattactctgacatatagtttatacaggaaagacagcataaatggctatctttctcttgattaattttcacaagttggtgccctaagcacttccagaggtgccaaaatagttttctttttagtatcaccaacttagggaatcttatgtatttgatgtgtttaaatttgttatgatcatcattcactgaagctcagattgtcccatcttggccaatgtggggctcttcctttagtgaattttgacatgaccctagttgtttttgaaagcatctttgcctcctggcacaagatattctctttaatgtttaacctctatttaatcataagctgttttgaacaatttgtaaatcagtgcctaaattagttctcccaccaatgaacagtatattgatttttttctgatggggaaagggtagcaccttactaacttgaaatacagcattttattaatgagcaaatttgcagaaatatctgttagagactgatgtaaattatcttttgtaaggggcagtagcttatatcaatagaaacacacgtaatatgtactccatggtttttgaaaacctctgcagtgttgcattttcagtgttgatcatcaagaatacaaatatataaccatgtcatacattttaaaaacaaataatgctagtgttgaggaatataactaatttcaaatttgtggaacagtgggactatattaaaagatgagtctgggtgtggtggctcacatctgtaatctcagcactttaggaggctgaggcaggcggatcacttgaggccagaagtttgagaccagcctggccaacgtggcgaaatcccatctctactaaaaatacaaaaattagctggacgtgttggcacgcacctgtaatcccagctatttgggaggctgaggcaggagaatcgcttgaacccaggaggcagaggttgcagtgagccaagattgtgccactgcactccagcctgggcaagagagtgagactctgtctccaaaaaataaataaataaaataaaattaattaattaattaattaaaaaaataaaagacgaaacttggaatagtaaatacttaaaaattctaacaatatcaacaggtagtgatagtttaaacatgtactgtaaaagtgtttggtttttaagggtatgtaagagactggttgtctgtgggactttgaaagcagttgggaaatgccacaatagcctcagtataaaattctagagacccaaagcggagagagatgcctcttaagaattatggaggatatttattacttttattcatgggatgggtggtggtgatttaatgcctgtctcttgtttcttttgtttttttttgttatccaaatccaaatccaaattatatgaggaattcacttaaaaatatacgtttagtttggtttaataaaaataatcagttttgatgtattgacttttaatttcatgggggaaagagtccattaggaatgttcaggctttctgtgtatattttgtgttgctcattctctttggcccaagatgaaactaatagccacaatgtgtctgctttggtgctgtctctagggttgtgtctgctgctgtcagctgcacccttgttatctggctgctggtcctgctcagtcagttgtacaggaatgtcatttccattaataaccccagggccggacaggcagatagtggaaaatgggtgaagagagagaaattgtatttaacccagtgttctgagttgtcatttttgagaccctagcatagctgggtaaaggcaagcagagggcatgacagcaaatctatttctggcagaatctcatatacaaactggagaaacagcctgataccaagagaagaaagggtgaaatatactgggaaaagagggaaagatttggggttggaaaagtcagaggaaacaatgttaggaagaaataacatgatcaagtattctgatagaggtgctgacaactttgcaaaataaatttaattttgattgtaaatgccatcatttgtggtggttcaaatgaacaaaattcctttttaaaaaatgaaatttatgtaaggattgctcatagaagattttggagttttgtgctatgtttttttttttttggttctggatcagtgaaaggcccgaggaacagagtaggttttatttttttttccatctaggtagaatgactcagttactgtagttgtctgtgttttggttatttattgctgcataacaaattaccccaaaacttgctggcttaaaacaagtattttattatttcctatgattctgtgggttggctgggctcagctgggtggctcctctgctggtttcacctggagtcccttaggcagttgcagtcagatggtggctgtggctggacgtccaaggtggcttcttcacacatgtgtctggcacctcagtgttcctcatgtggctttctcaacagggtgctgtggtactcctacagggtagctaagagtgccaagaagagaaagcagaagctgccggtcctcttaatgtctgttctcagaagtctcagaatataattgacaaataataattgtatatatatttttggggtacagtgtgatgttttgatgtatgtatacattatagaaagattcaatcaaactacttaacatatccatcacttcacaaacttatttttttggtaagaacattaaaaatctattattttagcaattttgaaatatataataaattattattaactgtggccaccatgcagtacaattggttactaaaacttattcttccagtctaattgaaattttgtgccctttaatcaaaatctcccctttccctatctctccccctccctccagcctttggtaactactttctactctctgtttctatgagaacaactttttaagattccacatataagtgagattatacagtatttttctttctgtgttttgcttacttagcattttttttctatttttctgtttggttgattaggctatttttcattattgactgaattatttttttctgtttagctcaagaccattgtatacatcgactcacagaagtatttgagtaagcctaatcattgttgaactgtgatggggaaaggattcagccttgggacacgtgacctttgtgtacaggtgtaagaaattcctactaggttttagggcccagaactggactaggccatgagggacccaacccatcctagtaggcaaatcattttccagttttatatttgagttcattagtaaataagtttactttccattatagacaccccctccactgacttatggggtcctgtacgccataaccaaagactcagtgttggaaaggtgatgctccactctgtgtctttgtttagctaaggtgaaggggacaggtctgccaccctggtatattctggtattctctcattggcagtcttagtgaaggctcatgagagcttcctcacagaggtttgtaaggattagaactgagtggaatagacctgttccagggcagagtgaagccgaggacaacagtgagattgtgtccttcagggccacagaccagaacctttactcaactctgatgttaagctataaagctagtttacaagtttatggaacaattcagcttgttcttccaggctcttgaaaatgaaggttaaggctgggcccgtggctcatgcctgtaatcctgtaatcccagcactttgggaggccaaggcgggtggatcacttgaggtcaggagttcgagaccagcctggccaacatggcaaaaccctgtctctactaaaaatacaaaaattagccaggcgtggtggtgcctgcctgtaattccagctactcgggaggctgaggcaggagaatcgcttgaacctgggaggcggaggttgcagtgagccgagatcatgccattgcactccagcctgggcgacaagagcgagactccgtctcaaaaaagaaaatgaaggttaagttttggcaaagtgatttgtatagatctgtaatacatcatgttctaatgaggtccaatgagttctaagtaatttctgatttccattaaaaatgattcatgaaaaaataagaatctcatcagagagagagagagaccacttttgaaatgaggaaaaatgacagaatagaaaaggagaaagtctcttttctctcttcttccccaagcccccctcatcactggttacttatttgagcatcctttatcagcatctaatgagaatgagaacatagtgggatgccatgtgaccttttgagtaggaattggaagctcttatgaagtttccagcctgatgtcacttcagatccaggtcattaatatttaaaaaaataaaaaaaataaaaactcttaggtgattcgaatgagcagccaagtttgagaagcagagccctactggagcaatgcttctgcaacttgaatgtacatgcaaatctcctggggacttggttaaaaatgcagattcttaataagtttggaggggagcctgagagtctgcatttctaacaagctcccaatggaggccgatgctgctggacaatggcctatggaccatactttgagaatatagagcagggggcagcaaacttttcacatatgaaggcctgagagtaaatatattgggctttgcaggtcatgtggtctctgttgcagcaacccaaatatacctgtagtacagagcagcaataggcaataggcaaacaaatgggtgtggctgcgtgccaataaaactttatttacaacaccaggcagtatcctgaatttgtcttacaggccgtgagccaataaaactttatttataacaccaggcagtatcctgaatttattttacaggctgtgacttgccaacttggtctagagctttccctgtctcaagtttttgagccgtatcttgcttcttccctgttttgttgggctgaatcttaggtaagaattaaatggttttgaaagaggttactcaatggctttgttgaactgatgaataattgatgatgacatttaggctctgtttacaaacagccccaattgtcccttggttgtggctcattgctttgccttgaatataggtggcctttctgatttctctccctagactgcctcttcagcaatggatcgaaacagagctagggtttattctaaaatgtggcccacgggcatctcagaataaataaccaggtctgaactgtagaggcagagggtggcttcaggtcacttttccttgacctgcattttacaactcatctctggtgttttgtctaaggcgacagaggctggtattttggctatctgagaggtagagagcagagaggttcctggacatgtacattttgtgttgagataggtcatgccccagatatggctattaatggtagcagagagttaaatgttgctgataatatattctaataagtagataatacagaaccaagttgtcagagttttggggggacccaaatttggaaccaaggactcaaagctcagaagggttccatcttgtgggcttcaggagtaaggtgcaagattcctggtctgctgctcatggtaaatttcctgcatttcaaaccccaaagtcagttaggcctaagcttcaggaaagttttcagtttaattggttcaaaactgaaacagactctcatctatctttatgacagtgctaggattcctaagggagaggtgttactcctcttctgaaatgggaggatgtgggccaggaatccttgggccagggatgcttatggcagactccatttctcagcatggttttggctgggaatttcctctatgagattgacccttctctccccgaggtgccattttctggaataccaccttctctctgctggtaaaatctaatttaccttagtgccttgactggtctgcaaaataaatgttctgacgtttcctgacaggagagcctgtcctctctgctttctgcttctttatcattcttgtactttcttgccttgccttttccattttgatcttctctcttggccaagtcttgtcttccgggggctctcagtcaaagtttagtcccaccgatgtccagaacagaaagctcagtggtattatttttagagagggagggagaacctcttaaaagcatacttaaaattctatctgtgtgtgtcttttcatccttacatctgagaatattatttgtcttggcatgttgaatatggttactaatgcagatgtggtctgtgccttacatgttattcagtttgatttataaaaaatgaataattatataatagaatatttaatcactcagaagataatatatgttgggaaaacatgaaatttgaagtcagattaaggctaaattaatctaggtgagaagttggttttggccctcattgcctgtgtagacttggggtgagttgcgctcattttctgagtcttagcttatgagctgtgaaatggggatgatctgtacctaccttgtacagttagggtaggatttggatctgatgatgaagtaaagtacttagcacagtacctggtttatagtaagggtttaatggagagcattacttttgttatttaaaaaattatgtctattgtttctgtttctgtttagctctgagatctcctcctctttgaaaatgtcctttccacaaggcccttcccttcccatccattccatctgaccctctaccttcttctgttgttttttctcttacatcgcattctctccctatgaccaactatgaactcctgaaggaaagaaatccagtttattaaactgtgtgtcttcactccgtctaaacacaacaacatggacaaatttcacagatgtgttgttgagtggaagaagccagatacaaaagagtacacactttttttgaagttcaagaacaggaaaaagtaatttatggagacagagatcaggatagcggttcttttgaaggtggaagggttattcactggggaggtacccaggggagtcttcaggatgctataaatgttttaaatcttgtctcaggcctactaacacagatgtgtgtatgttttaaaaaatatttgattggtatacttagtatttgtgcactttgtacgatatagtgcagtaaaaattttaaaagatgtttcccagtatgcagggcttatttgccttttagtgatcattcagtaaaaggttgaatatttaatggatgtcatgatgaagtaaatgatcaacttttttttttttttttgagacagggtcttgctctgtcacctaggctggagtgcagtggcaccatcatagctcactgcagcctcaatctcctgggctcaagagatagtcctgcctcagcttcctgagtaattgggactataggcatgcaccacaatgccaaactaatttatttttttgtaaagatggtgtctccctatgttgcccaggctggtctcgaactcctgggctcaagcccccaccttggcctcccaaaatgctgagattacagctgtgagccaccgtacctggccctaagtggttaatcttaatcaccatgtgaccaagaccaaattttaaggaagatgtagcatacattttggaaaacatggtagacataattcataatttatagccagaattcacgctgttgttcatggcgctacttggatcttcacatagctgtttcagaaaatatagtaaatgcgaacggcaggacttgcaatttcagacagtttgtgcagttggcaggacagagaacacagagtggggatacggtcctgtcagattggtggaaaacctcatttttaattgattgtctattgcatctatgcccctcttttcccaccctccctttgtccttttatcaattctacttggaaataaaatctgcaactctaatagatgctactgacactcgtgcagcaattctaccagatggcattcgaatctcgggtgttctatgaaaaatgaaaagaccaaacacatgcacaaataaatgaaggttgaattaatctttataattaaacggaatattaccctgctatgactgatttttgctttcaaactggattgcgtgctaatttttcagtgaactgtaattgtattaacatggcttttttgatgcctgaaagtacttaaaaatagattttgcgaagttactgagagaaaagttattagaacttttaatctaaacatctctaagatcctgaggtatatttatatcacgacttacagctgcaaagcattttccaatagttttttattctttgtcccttatcatcctgggatttaggtggcactggccagaaattgggttgaattgcaagtacctgaggcacgttagaaaattgatgtcctactgtgtacccacaaaaattaaaaataaaaattagaaaacaaatatgtacaactgctatgtacccacaaaaattaaaaattaaaaaaatgagtgggagggaaggtggtagagttttctacataaagtgcacctactagcttagtagtggtgactattagtgaaatccctaaggattattgaagcagaggatgagtcccctacttatgaactgataacacagtgttgggggttctcagaagtgggtccagaagccttggtaccatggcaagtaccatgatctacagcagagagtatctcaaatttcagcaggcatgagactcccctatagtagtggttttcaacccagagtgatgttacacacctggagacatttggcaatgtctggagatatttttgatcacaactggggggacagagggtgttactggcatttagtgggtagcagccaggaatgctgctaaatatcctacaatccacagaacagtccccagagataagaatgattctttcccaaatgtcaatagtgccaaggttgagaaaccctgccttatggtaaggctcattataatgcagattcctgggtcccagttcagaagcattctaactcaagagatgtagcattgtcccacaaatttgtgttttcaacaagctcccacgtgacacagatgctgccagtccaaagacaaagctttgggaagccctaagctagacgatgccagtgtcaaaggaacaagccatatatgtgggcactggccctatgacattcccttcttttagaaaaatgatatgaaaattcccacttgcattgattgattgattgagacggggtctcgctccgttgcccaggctcgagtgcagtggcatgatatcggctcactgcaacctccgcctcccgcatttaagcaattcgcctgcctcagcctcccacgtagctgggattacaggcacacgccaccatgcctagctaatttttgtatttttagtagagacgaggtttcaccatattggtcgggctagtttcaaacttctgaccgcaggcaatccacccgcctcgacctcccaaagtgctgggattacaggcgtgagccatcgtgcccagcccacacttgtctaatttaataattcaccaaagttatctcatttgatctctccccaccagtttatgagggaggtacttcacaaggtttttaggtggtaaagaattgttcatataagagctaaccttaaaggaaagaatgacaacaattcccacttaaactgttgatgagacaaggggatatgtttatctaggttaatctccaacttgcctcctgtttaaataagtaatttaacaactggaggaggattaagtagctgattaaatttctctgagaaacgttaggtgttagggccttggtatttattgcaggtgtgtttctaagccctttcaaccttgatatttgaaaatgtttttaaataatttgtaagtattttttcccattccccaaaaaatgcattgatttatttcatagtatttattcccattttggttaatatttctatactggctgtgttttaaatgtagatatttacctcaacaaaatatgaatattacagctaattatagaattatttaaatagttattatttaattatatatttctatcttgatgaaactttccgaaaagattaacctttgtgccttatttttcccttgctatctttactattggttttgaaaaatggggaaacctcttgtgtagaagaggggttggcaaaccatttctgtaaagagacaaatggtaaacatcttaggcattgtgtgggctatatggcttctgttgcaactactcaaactccactgctgtagcatgaaagtggcagtaaacaatacttaaatgaacgtggctgtcgtcagagagaaaaaagcaacttttcctttaccactttaggtttaatgtcagggcctgtgaattaaactataaaagatggattaacaagagaaaagcaaagtttattcactaacctgcatgagagcttacagaaaacacagcccagagaaacagaattggggggttacatattgtcttaagaaggggtagggttaggattttaagggacaataaatggtgggaaatgactgagaaatatatgaggggacctaacagaaagtcaggcttgctttagtaaggtctgtttatgtaagttctcatcctggcgccaactttttatccccggtgagaggagttattttcccccggtgcaagaagtgtctcttaaaagggggatttacgacagttgaattcttttggaagtctctgcttgtaggccgataagggaagcatggagaaagcctctttctgcttgtcttgattctcagataccttcagctcaaaatagtcctttgctacagtagcatattccggaccaataaaactttctttacaaaaaaacatgtggtaggctggcttgggctgtagtttgctgacctctgatacagagccctgtgagtgagacagagacaaacataatttattttggctcatataaaagcctaagtgtgatataggattgttcccactcttgggctgttatcattttggttatgtctggataaatgggcttagctaattgaggcttagggtattcatttgactaggtctagcagctgttctatttgcaaactttgtgagcagtttaaccacatataatcgaaaccaataaaaacattgatttaaaaatttatgatttggccactcttctgcccagtttcttttcatctttttttttttaatttaatttttatcatttgggacagggtctcactctgttgcccaggctggagtgcagtggcacaatcttggctcactgcaacctctgcctcccaagttcaagtgatccttctgcctcggcctcccaggtagctgggatttcaggtgcaagccaccacgcccagctaatttttgtatttttagtagagacagggttttaccatgttggccaggctggtctggaactcctgacctcaagtgatacacctgcctgagcctcccaaagtgctggaataacaggtgtgagccacggtgcccagctcctgcccagttttaaaggaaataaatgagccgggtgtggtggctcacacctgccatcccagcactttgagaggcagaggtgagcggattgcttgagtccaggagtttgagacaagcctggacaacacggtgaaaccctgtctatattaaacaaacaaacaaataagggaaataaatgagagttgcctctatttttaaggtaatattgctaccactctaaggacgatgggtgtgttgttttattaattaatcataaggtggctttggcttctaaaatctattgctactacctgctccatctgtttaccaagaaaactcaaatattactttctttctttaactctgttcagtacagggctcacccaagtaagaggagcatcacaaagacaccagggaaatgtttagtgccagtatggcaaaattaagatttacttctgccagagtagtttccttttgcagacagaagaaactgcccacctccaaaatatattgagttggtgttttaggagagagcatggatggtgcttgtttataatttggaacatgccttcctagaatgttgtctatcttagagagtaatgagggttttctgctatactggggcattattcacatggggttgagggtggatgacctgaaatctgatctttcctgtcttttacttcttgtacaattagaactgtgatttgcacttagagagccttctgattcatggaagtgcttatctatcttctacccctgtatgatgcatctgcttgtggaccgcacccaaaagcaatttgcagaattaaagtttttgaagactcataataaatcagttcaattttatcaagagaataaaatttgattcatcagataactgcattgttattatttgtgggatcctgatagacccagaggatattaaagcctgttcccctgactaattttcatcaataccattagctccgcttagggtaatatcttcagctaaggcatctatactagtcaatcatttgtttggcattatggaaactgccattgttttgaatgatagtgtaattcatgtacagtctcctgaacttctgggtgcttaaagctcagaattttgattgatgtttaatagttattacagaactcatcagagaaaatgaggccttggcatgattgagcctgactgaagctttcaaagccactgcaagcttaggaaagttgccctataaattttttatgaaagggcagtgatcagttgttccatttttttcttaagttggttaaattaataaaaaagaaaaaatatgctgagacttaaccacgtatactaaacatacagctatttaattaagtgattaaagtggtctctttgatgtgatacatgcaagacatttgagaatttatctgactctcctaaatagccaagtcagtggggattaaaataaatgagctttctgtcttcctttctgtagatcagcttaatagtaagtggctttgaaaattcaggagtaaagcagtcaacctagccaatctttaaatcagttcagtcacatatataaaaagtagatgccatttcagagctcacagctaaataaagcagaattatgcctgattctgttcttcccaccagcattatcaagttgtagtatacagtattgaaaattctgggaaggtgggggtgatttgagagtttaaatcatgttgtatattaggttttcaatgttcctcatttttctgagttcatttgtgatagctgttgtttctctcttcaaataataatctttacaaactctctgttgtctccatggaaattaattgtgatttttaaagctctagcactaagactttagggcagggagtcaactcccaagcaactgagatctgtcgcatgtaaatggtagtaatagcaaagagcaaagcaaaaacaaataaaaatcttgatagctaagccgtgcgtgcacgtgcacacacatgcacacagatgatgctgttgagcatggatcagtttggaagcattgttaagcacttactgtgtactagcccctgtgtcatgaattgaggcaactcagcgaataacctagctttatttaattatctgtgttggcttagtaagttatggcccttgggccatatttggcattctgcctgtttttgtgtgaaccacaagttatgaatggatttcacattttttaaatagttttaaaaaatcagcttggcacaatggctcatgcctggaaccccagtacttagggagggagatgtgggaggattgcttgagcccaggagtttgagacctgtctgggcaacgtagtgagacctcgttctccacaaaaaggaaaacaacaacaacaacaacaacaacacaaaaggacaaaaaaacacaccaagtgtaaacaaccaaaagaagaatatattatgatacatgaaagttgtatgagattcaaatttcagtgtctataaagttttattggaacagagtcacagccattcatttatgtgttgttctagcttgtttctgctttctcaggtacaatcacagagctgagtagttgtgcagaggccatatggattgcaaagcctaaaatatttactatttggcactttacagaaaaagtttggttattcctgatatgggtaaggcaaacttcataattcctttattatctgaatacttctcccaactctctattttactttattggtattagaactaaatgtatccatattctacagacgaggaacctgaggaacagagagattcagaaaattcagctattgctaataccttatgtgatgatgataacttgttatagaatggttttcctcagctttttaaataaaaatgcagttaagtaatcgataatattacgtttgtatgttctttcagcattaaggagagtcctgagccttgattttatgttcagtatgtgtattagtctgttctcatgctgctaataaagacatacctgggactgggtaatttataaagaaagaggtttagttgactcacagttccacatggctggggaggcctcacaatcatggcggaaggcaaaggaagagcaaagtcatatcttgcatagcggcaggcaagcaagagaaagcatgtgcaggctgggcacagtgtctcacgcctgtaatcccagcactttgggaggctgaggcaggtggatcacctgaggtcaggagttcgagaccagcctggccaatatggtaaaaccccatctccactaaaaatacaaaaaattagctggacatggtgtgggcacctgacatcccagctacttgggacgctgaggcaggagaatcacttgaacccaggaggtggaggttgcagtgagctgagattgtggcattgcacttcagcctgggcaacaagagtgaaactccgtctcaaaaaaaaaaaaaaaagaaaagaaaaaagaaagcaagcatgtgcagaggaactccccttcataaaaccatcagatctcctgagacttactcactatcaagagaacagcacaggaaagacccaccctcatgaatcaattacctcccactgggtctctcccatgacgtgggaattatgggagctacaatttgagatttgggtggggatacagccaaaacatatcagtaagtatttgctgattgattgaaatagcttacataaaatatatagttttgtttgccaccaagaattaattgcattggaagctgagtgtggtggctcacacctgtaatcccagcactttgggaggctgaggtggacatatcatttgaggtcaggagttcgagaccagcctggccaacatgatgaaactccgtctctactaaaaaatacaaaaattagccgggaatggtggtgcatgcctgtaatcccagctactcggtgggaggctgaagcagaagatgcttgaacccgagaggtggaggttgcagtgggctgagattgtgccactacactccaacctggttgacagagcgaggctccacctcaaaaaaaaaaattaattgcaatggattttatatcttgcttaattttccagaatgttttatatgttctcacaaaatatctcattttctccccttttttctctcctgtggtaagatcagttaatattgaaatataccttaatgttagctgggcatggtggcacacgcctgtgatcccagctacttggtaggctgaggcacaagaattacttgaacctgggacatggaggttgcaatgagccgagatcgtgctactgcactccagcctggatgacaccgtgagactgtctcaagacaacaacaacaaaacccagggaaacgtaccttggtgtgaacagcactgaatgatgtttatgattgtatgttaatcctcttatatttaaaggttaaatgtaaaatatagccttttatattttctgatactcttgatgacattgatcatagtgggtttatcaaattattcattatatgaattaatatttattgagtattggtcacttgctatgttacctgtggtaacatggtgattaggtggaataggctattggtttaatttgaatagtattagaagattctctcagctacaaaacctctcatttaattgtatttattcctttggctaataaactactcttttaaataaaagtatttctccagagtaaatatattagattgctattagtgacttacattctattataaactagtttgaggccccagtggcagctagtggattagcaaccttgaagaattaataattttgatggatgagaagggaagggggagatatctttggagcacagagtattgctaaggaaaggccaactagggtacgatggtattgcaagtggtatgaacacataggacctgctaggtgttgaaaggaacagataagagaaagagaaagaggaggaaggcagaaaccaagatggcaagtgctaaaagcaacctgtatctttgatcttttctagggttagatttggtagtgtttcttgtgtctgttttcagaggtgtgccaatagtggctctcaaaagagtcctccaacttttggggggctgcaaatagcctggattcttttgactcatatgcagagtctggctttgctaggaaaatctcctaccatgctccaagaagcttgtacatttgtcttccattgataagagggttgcctcaatagcttttctccctaagcatttcttttctcgatatttttcctctcaccacaagtgtggccttctgaaactggacctatgactaaaagagtgacattatttctcaggggtttcaggtgtttggttaggggtataagatgacctggactcttctggaagacctccaaacactacacatcacagttactccaaatccttggaaaaagtcacgtttctactttcttggtgtagtctacaactaacatttgctcatcatgtactctggaccaagggaaaaaagtgttttacatgcaatgtcatcctgaactcttgcagacaatgctatgaaataggtactaatttttagtaatttttttctcaacatctgatgtaaaggagagtgtgttaggattacattagctaatggaaaacatgacacataatgcctcaaacaaataagggctttattttctgtatgtcatgaagggaaaagagggaggcagtccaggtctaatatgctggccttcgaatgccatcagcttttcatcccaccatcttcagcatgtagattttttcctcatatgtgttgccttgtgattactagatggctgctcggcttctggcattgcatcagcattccagaaaggaagaagaggaaaggctaaagcagtagttctcagctggaggtgattttgccaccaggggcacatttggcaatatatggagatatttttggttgtcacaacttgcggaggggggcatgggttgctcctggtatctaatttgtagaagccaaagatgctgctaaacatcctacaatttataggacaaaccccagagcaagaattatctggcccaaagtgttgagaaaccctggactcgaggcagaaagcatatgctgatgaatctgtccccttttaaaatggatcattggaagtgcaacaagaagtttttcttaaatgtcattggcccgaatctcatcctgtagctgactccagttggaaaggaagctgggcaacacagctattttgttgttgttgttgttgttgttgttgagtccattgtcatcctgagcagaattggagtcctgacagtaagagaagaaagggagaatagttattaggtagacagtaggcggtgtttatttcaaaaagttaagtactctgcctaaggtcacagaggtagtgaagatcagcagctgcgtaaacctcctctattgaggaacggatgtccagctgtcaagtgcagcttctctctacatgtctgtatgaataaagcatgaaaatgcatgcactgggtatggaaagccctggagtttttgatcagccacaaacagcctaggaaatatttcttgcaggatataatatgcaatctgttaaatatttatatcactgctctctcagcatttacagtgggacttgcctttcctttttgtccatgtaaccaatagggtaattaatctcagacctgactcactaatactttgcccttcaagccatcaaactattggtgcttcacttctcccattttgaaaaattaaaaagtgatgtgattactatttgccttacttagggttcattcaggaaaccagacactcttctaagtatatcaaccagcaagacatttaatacagggaattggaggcttaggtaacctttcagagggctggggagtgaagggcagagtctgtcaatgatctctgctgcttgtacaccaaagaggtctttctcaggagaatgcctggaagttgctggaaaagggctgtatctgctgtctgcagatgcccacatatctgtataaggctaccaacagcaaatgaatggcatctcctcttctacctttggaattgcctatgagtgcttctcattggcagtctaacctggagccatgggatattgcaagatgtatttctgaagcttctcagggaaaaatgtagaatggggtggggtaggatgaggaggaattgacaacgaagtctgtggcagaaaaaaacatttgaatctgaatagaggaatacatatatagcatattttaggaagaagaacactctcttcagatgttggcaatgttgctactagtattattaccttattctaggtatgtatctttgggaggtaaatagggattctttgtatgtgttctgattatcttcaagtcatgatgatgctcaataaataataaaaaaggattcaataacctgcatagatggtgcagaaggtaatatattctgtgaggctctgtagtgcagtgggggtcccagagatgaggtttaaaaaacaatgcataattcaccagcatgctctggaaagaccagtcttcagaaaacaattgtggatgactcagcttgtccgttcgttcgttcttttcttttcttcttttcttttctctctctctctttttctcactttctctccaaaactatctggaattctttacttgctatagttatgcatatgacttatagcgagctgataaaatatagtgcaaaattaaatacaatgccggaaataatagaataatctcagaatgaggtaacctatagatgtatgacatagtttggtgttgggggtagagttgtaacctctagttatctgctatctgggtcacatcaagcttttagtgtgtgtaactcacagagttttgaaggtgtaatttgatctgtgctatacttgagtctgtgaaacagcaaaacccattatgactatgtcctacagcccttgtaaaatcctaagtcttgagcttcaggattctgctgatatttaatatctgaattatttcaaggaaggtaaggaaagtgtactatcttactatgtttatttcttgagtgaggaaaattgaaagggactaaaggaaagaactcgttgccaagagcagtgtccagaggtcactggttttgctttgtggctttgctggaataaaaccaacgtgtttggggttgcctaggtcttatgttgggtcatctggaggcagatctggagatgagaattcctgtgtaagtgattcattaaacaaatactcccaagagaaatcagtaagggaatgggagaagcaagacagggagggatgagagtccaatttcaggagacatctcagaactagtctgatcctgcagggaactttggaagtacaaattatacctcagagtttgtcctgaattgaggcaagggggctgggctttcatattgccgcttagggctgcttgggtggaggcagaggcggaggcggaggtgcaggtgcaggaaaagtgggtagaaggcaaataaacccccaggaactagctatttttgattgcaggcaaggagctctagtagttcctagggcaggccttcagaaagtctcaggtgttggccattagaaaagaaaaaacatagatgctggagggatgtacagaagttataaaagggatcccagggaatctggtcagagccctgacagtgtacttgtaagcttctcttttgcttttatgaaacccagaatctggagaagggagagagaaattttcacatggaactgtaaagtttctctaaagcaagggttgacgaactttttctagaaagggccagataaaatatttgaggctttgtgggccacagggtgtctgacccaattattcaactctacaactgtactgcagaagcagccatagttgacaggtaaacaaatgagtgtggctatgttccaataaaactttatttataaaaacaggggtagggtggctggatttggcccagggaccatattttgccaatcgctgctcttgaggttctttatatgtgcctaagtttgtttttcctttatttattccctatctgttataaaacacagaggataattagtacctttgtctatctaaatgatggttatgacattatgatgtatcttaaattattctagatcactgcctccaatctttctggcatcctggccatctttcacaatgttgcaaagataatcttcctgaagcatgactcatctccttttattcccatgctaaacatatttagctctctcttagctgtaaaataaaatataggcttgttaacatggcattcaggaatccctgtgatctgaccccaggccaattttcctgcattattttctgttctccatcctcatgtacttatagtccagctacattaaattactcgccctctctccaatatgccatatcgtgtgtgtttgctatctccttgtagtttttttcatttttatgtatttaaactgactatatactgtcaaaattttatatatatatatatgatgtacaacatgatgttttgatacatgtatacattagaaaatgggtaaattaacatatccatcacctcatatatttatcatttttgtggtaagaacatttaaaatctactcccttagccattttctagtgtacaatacattgatattaactatagtcactatgttgtacaatacatctcctaaacttattcctcttatctaactgaaattttgtatcttttgaccaactccctaaccccattcccccacccctggtaaccaccatcctactgtactctgttatgagtttgactgctttaaatttcgcatgaatgagatcatgcagtatttgccttttggtgcctggcttatttcacttagcatgaagtcctacagattcatccacgttgtcacaaatgacaggattttcttcttttttaaagctgaatagtattccattgtgtatatatactacattttatattccattgtgtacatatactacatttttaatccattcctctgttaatagacatttaggttaattccatatcttggctattttgaatagtgcttcaatgaacatggaggcactctctttagcgtactgatttcatttcctttggatatatccccagaagtaggattactgctttgtatggtagttacatttttaatttttagaggaacctccatagtgtttttcatagtgactgtaccaaattatattgccaccaacagtgctcaagagttcccttttctccacacccttaccaacacttgttatctcttgtcttgttgatagtcgccattctaactggtgataggtaatatctcattgtgtttttaatttttatttccctgatgagtaatgatgtggatcattaaaaaaatctgttgacaatttgcatgtcttcttttgagaaatgtattttcacgttattttccctttttaattttttaatttctttttttttttttttttggagacagggtcttgttctgtcacccaggctggagtgcagtagtgtgatcatagttcactgcagcctctacctcccaggctcaagtgatcctcctgcctcaacctcccaagtaattggaactataggcaggtgccaccatgcccggctttttttaaaatttatttttgtagagacagggtcccgctgtgttgcccaggctggtcttgaattcctggcctcaagcaatcctcctgcctcagcctcccaaagctctgggattacaggcatgaacaactgtgcccgacctcctttccccattttttaaccaggtgatttgctttcttgatattgagttgagttttaaatatattttggatattaaccctttatcagatgtatggtttgcacatatttttgcctctgtctttgcccctgtttcttctcctggaatgttcttctagctctacattttgaaatcctaaccattctcttaagactcgattcagtcaccttctccattaagcattttctccatgcagaaacagtctctcctctggactttgataacaatattgtctatttctattaaattttttattttgtttacattgtactagacagttatttgctacattcactgcatttttagtatactgaggtctctcaatatatatctatatatttttgcccttcacagtggcttgcatatagtagatattcagtaaatggagttttcagatgaagggcgcatttctacatcttgtgattattaatgatttaagtgctgaaactctgacattatttttctttttcctttttgtaggcgagagctgttttggcaaaagttggctatccagagtttataatgaatgatactcatgttaatgaagacctcaaagctgtaagtgctaaatttactgtacttttttttttctggcaagttttactggccttgtgcctttcaactaacccaagtcctagcaattaaaactggtgatgccagaaaacaccaacttttgattaattccttggctagatatgagcctgaatatgccaggcagatcacaagatttagggcagattcaaaataaagaagtgtcagaaacgatgcgtagctgagtgggtaccaaaaaacaaatggacttgggtttggcctaatttgatcataaaagaaagaattaagcaaattgagtatgttacaattagtgggcatgttctaatggcaaatgcatcatgtttgttgttaaatactttttatttgcttcattcgtattaaatgaatagtaataaatctgcctgctgggagttaacttcattaaactttatgagtgttttggcaaattaaatgcatatacatacgactctataatttattgtgaattggattgtgtatttgcagtaagttactgatgaaaaatggtcataattcttttttatttcaatatttttggacatgtattttccagtaggtgtattaattacaggcctttctattcacaagcactgttatttcctctcctacaaatagttctgataagtgatttttcttcctcatttaaaaaaacctgtttttactattcactagattttcttgaaaatgtagtcttttgaaattctttaagtaactatagttctgaggtatagctctttcctgaaattgtggttcaacaagtggcatatctgaaaacgatcccagctttgtagatgagcatcaaaattttacaagactattcaaaagtgagagaaagcattaattagaatcttcctccattgggctctaagatatagcctcccaaaatattgatacagttgctctggaagaaaataatgatgcctcatagcatcctaaaactcagtctatcttattatacactgttttgatgatgctgaaaatcccattattattatcgtaactaaaaatattgaagcacttgacatattcatgtacattatcttttaattccttcagtgattctgtgaaatagatgatgttcattcccattttgcagaaaaggacatagagactcaataatttaagtgagctcctcagttccacacagactttcagagccaggactgatatctgggctcaggaagctctgcctgtaatcagacaagggattcttgagggtcctttttaggcagctatgctggaggaacagaggcatcagggtggagacttggtgggggcagtgtgaccagggctgttggaagaagagcagagggaaggccatgttatcaaatggttaagagcacaggctccagtatcatgggcctgggtttgaattctgcttcttgtacttactagttatttcatcctgtgtaggttacttaacttcggttagcctccctttggttatctggctactggaaatataataaccaagtcttagtattgttgggaagattagatgagactgtataaatgtaaaagcacttggcataatactctggctcagagtatagcctacttcctataaagggtagctttgcggatcaatatggaccatttgtggtccattttcaaatcagccatataaaatattccatttcattgatccttaatagaaatagactcaagcgtgaatttctaccaattttggaaatatatctgtatcagccaggaaagcaaaaagcacagtaggtattttaaacagggaatttaatacaggaaatgggttggaaggcaagaaaagggaaaatagataaaccacaggttaaactgctgttgctactaagaagagtatcatcagggcacaaagtaccttagcaggagaacctgggtaactccatactattggtatatattctgagtcagcatgtggatgagaaggtttgagagacagtttgatgtagaggttataaatagggaccgtggagtcaaagtgcctggagtaaaacccccagtctaccatgtaccaccttgttacctagggtaggttatgtatcctctctgtgcctttcttcatctgaagaatgaaggtcataccaatccctcccatataggatttctgggaggatcaaataagttaacatatttgaagtgtttagaatgaaccctaacatacaatcagcacaatacatgtgttagctatgacatcctcaattcacacttgtggtagtgaactattttggtttgaaaaagtcctcatgaattaactcatgcactgtccaggtccctcaaattgatttaaaagggtatacagatggagcagtctcaagctttaatcgaataaggtagaacttaaggcttactcacaatatttagttgatcaagttttgttggcattctgttgctaagttcagagccccaaatttaaggacccattgaatgcaatatcttttgtgaaaagaaaccagatgccaaacaggatgccatgttggctgtgcttctttgtttctctggggcctgaactgaagacattacacaccaagatttttaatcacttctttgaagaaatggctttcatctgactcattgccaaagcagacacaattacgcccaagagttttaacagtttaaaaacctgacagtgaaaaaaattccaggtacatgaagtaaaaagacatttgtattcagaaaccgattgttttagtcaatttacacggtgctataaagaaatacccgagactggataatttatagaggaaagaggtttaattgactcacagttccacacggctggggaggcctcaggaaacctacaatcatggcggaaagtgaaggggaaacaggcaccttcttcacaaggcggcaggagggaagagtgagagttcaggaaaaaactgccacttttaaaaccatcagatctcatgagaactcactatcacaagaacagcatgggggaaactgcccccatgattcaatcacctccctcccttgacatatggggattacaagtccctccctcgacacgtggggattacaattcgagatgagatttgtgctctctcactttctctccccctcaagccccgcccttttctttttctgacagtgacttcagtccctcctccaaacctcagctctggagtggcaggcagttctcctctactctcctaagtgatggtaccatcacctcctcccttctgtgaccctagacacaggagtcgcagctgtgtactcctgtgactctcacagagccaaatcatatcactgatagagaaaatgaataaaacccaccctaaaaataggtaaaggatgatatgatagattgtaatattgtcactgagggcaatagcaaaaagactgaagtattcctggtacacaatgagactgttttcagttttaagaaacatgtagataaggactgctataggacctatgagaaatttctggtaatacgagctctgagcatgagaggctgttacaaatgaaaaacagcatgctgcatttgagacaggtggagatatgattcatcaggcacaaatgcaaaaggaaagaggagcgagattacctgatggatcagacgaaggtcaaggagaaatgttgaaaattgaagttgggctcatgtggaaataaaagcaaatgagatagaattaagaggtaaatatgcaaaggaatcagaaattttttaaggatgacaaggtaaactgaggtactcagcaaagcatttccgaacaacaatcttgtagtttttgaaaagaacaggaagaaataaaatgccctttatttgaacccccatcaacatgcaggaaagcctgttagcctaaaaaggtaggcatgagcccattttcaaatcagcctaataaagtattccatttcattgattcttaatagaaatagattcaaaagtgagtctctcccaattttggaaatatttcagtattagccaggaaagcaaaaagcacactaggtattttaaacaaggaatttaatacatgaaatatgttggaaggcaagaagagggaaaaatgagataaaccacagattagtaactttagaaagcagctgcgactcctgtgtctagggtcacagaagggaggaggtgatggtaccgtcacttaggagagtagaggagaactgccactccagagctgagctttgcaggaggaactaaagattcttccagagttattgtcagaaaaagaaaagggagggagtagagggggagagagagtgagagacagcaacacagcacccttttcccttctgcaacccactaatttcctgtagtgcctcctatttgcaggaagctaattggcaaaggagcttgagaaacagttttcagattcccagtccccagcattacggaacagagtgaaagggtaggcatgtagctgaaaaactacaggtaaataactggcactattaaggacgttactaaggaccaaagtcagaatcatggctggcctccatttacttaggagaattggaaatgagaaaattttcagaggccaaagtttctggtgagtgatacacacatatatagacataaatgtgcatatagggatatgcagatatgtgaacctatgtaagattctctgtggtgggtctggtctactttggccagtgaaacactagtgtgtgtgtgtagtgtgtgtgtgtgtgtgtgtgtacatgacagagagtgccactctgcaagagtgaggtgatattcagatggaatgctagaatgctgcagaaaaagaggttgttaaaatattaaaataattctttactatttgttaaaaaacacaaaacattgcgctcagctctttcaagggacccctggccatcatggcactggagagctaagggtgggcattggaggtgggacaccctggtgccccccaaccttccagccaggcctctgtaactctctcacattggccttcatccagactgttccactggtcagagcagaccaagaccagccccagtgtggagatgggacatctggttccagtgctagtgtgctggctggaactccctcagacccaccttcacatagctgtttgtaggaattgcatcctccatggtacactgtatatgtggattattaaacattttgagcatcacctcagtatatattaggttggtgcaaaagtaattgtggtttttgccattactattaatgccaaaaactgcaattacttttgcaccaacataataagtatgtctacatgtatagacacacattacttttgggcaaagccatctaaacacaccaatcttgcatgttgctttgttgtttgaataaggggacatgtagatataaaatacggattccattaagtattcagaaaatcctttgggtgcctaacataaagtctttctaatagatatttggatatatctctgagtatctttaaatggatttaaattaaatgaaaggtatcctagaatttacacttcctactggcacagtaaggaaagtaccacaattagtgcttcagtatttttcatctgcctattcctacatgtaggccgaagactatactacagatcatttgcattcctatgtactgccttataaacatgtacttatcctacagagaagctgaacacatttccttgttctgcgcttattacaggttctccatctttggggtggtggtggtggtaataactttattcttccatttagtctgtggatctgggataggatattcaagaagagaaatgtaggctctcctgaattttatgatcgggacagctgttcctgggaaatgacacaagaatcccaattaattccccaaaggtcacgcaattgaaaagtcaagagatggaattgattgaaagtgatcatcaacttgacctagactttttccagtaactgaaaggacaagaggcttttgagccaagtattgtctcttgccaaatttaattttttcattttggagattacaagcggctttaaaatattcatgcgaattcattcttgtttctacttctagaaaaaatagaactttctcaatagttgctgggtttcaattctttttctcatccaagggccttttgaaatatttaaaattatcaaaatattattacaattagcaagtcttctaaaagtaaaaactgatcccactgatattattttttaaaagttaatatttttgaaggaaattcttctgagaaaatttcccagaaagtgttctgagcccaagaacatatctgaattttctatcagttataatcatattctgaaggttttggcagaaaatttgggaactagagaaaacgcactcataatattgctacataatatatacttctgttacagtttattaatttgtttttctctatttctgtactgccgtaattgatgtttacatataatttggtacaccaacctttacagtaacatattgttttgctactgtctttatagcctttgttaccatgattttaactgctgtatagtatttcaagtaagttgtatcatgattgatttaatcactgcttctactcccttcctcaatctcactttgtccttgaatcactggttctcttattaagaccaacgaaaataacattggagtcagagccaaatgacttggacggtgtagctttgccaaattccgtaatctccttagccctgtttcccatctatcatatgtgaataacagtgactggcccctgcctacccccaaacacttaacctgtctcaaggaaaaacgtaagacctgtcctctattacttgtgatttccattaaataaatggaatagatcaattaaaccaggctaagaaagaagaaatattctcaacttaataatgaaaacaatttttaaattatctttctaaacataaataagctatggcaaattgtaattaattacctctgagttttgtttcccccaattattttcagggttctggtaggtccttacttatctaatgtatttttagacttgggacccttttcttctttacaacgttttttttttttttaatttttaggcagagtctccctctgttgcccaggctggagtgcagtggcacaatctcggctcactgcaacctccacctcccaagttcaagtgattctcctgcctcagcctcccgagtagctgggattacaggcatgtgccaccacacctggttaattttcatatttttagaagagacgggatttcaccatgttggccaggctggcctcgaactcctgacctcaagttatctgccagcctcggcctcccaaagtgttgggattacaggcatgagtcactgtgcccagccctttagaaagttttgagatggctttctgtttaatgtctgtagaccaacctgaatatcaagggatttttttttttcagatggaacagtaatgaaagtatcacaattagcaagttttctaaaagtaaaaactgaccccactgatattatttttaaaaagttaatatttttgaaggaaattcctctgagagaatttcccagaatgtgttctgaacccaagaacatacctgaattttctatcagttataatcatattctgaaggttttggcagagctgtcttggaaacaaaagctgaaaaaggcaaagggttgaacagtggacacatcttttaaccatatgatctgggaatgccttaggattgctagtaaggttgctttctataacaaggtgcttactctgtttcttctgaggctaaaagaaaacctttatcttaaaatataatcaattataagattttggccagcgcggtggcccacacctgtaatcccagcactttgggaggccaaggtgggcggatcacttgagtccaggaattcaaggccagcctggccaacatggcaagaccgcatctctactaaaaatataaaaattagctgggcatggtggtgcatgtctgtaatcccagctactcgggaggctgaggcacaagaatcgcatgaacctgggaggtagaggttgcagtgagctgagattgcactgctgcactctagcctgggtgacagagcgagactgtctcaaaaaaaaaaaaaaaaaaatatatatatatatatatatatatgtatgtatatatgatttctttttattatgaagcatttcaaatgttggaacatgagtaaaataatttgaacacatctattttaacacatagtaaacatattgccatattagctttgtacatgcacacacacattttaaatgaacagatgcatttgaaattttgtctgtaatcttccttgatctaatctccttcctctgcgtctatctccatctctgcatataaacactaccttgagttcagtcttattattgttattcccatgcctttctttatgcttttgctacataggtacgcatccatcaacagcatacagtgttgttttgcatgtttaaaaactttaaatttcctcatagatacaacttaccttattcactctgcataatttttaagattatttcatgttcatgcatacagaacaatcatgtaaactgttgtattgccttccattatgtgaatataccacaatttgtttatcagcccctcttccctgagcaagcagtttgagggacaatttaaagtcatagtgttataatttgttggccaagcagaacacagagggtgccaggaatcaatacttttatttctgcctttctccatgtgccttcagttattttactccttcctttatattttggcttggtctcctggaaagattgttaagatgactccttaacaaaaacttctccacggacatgagaacccactctgtgttagggaggagctaaatgtgagccagacattggtcaacaagtaggtgactgtcgagcctattaccatcaaattgcatatatacattcgtatctataatgtaatgccttgtgggtttcatatacacgagtattttactttttgcttttaaaagactattaaagttataaaaattacagtttataagaatttggttacccttggttatctccttattcaaatgtgtatttttcttaatttccatagtaatatatttaaaaacccaagcattggaggtcactacaaacgattgcatgaacagctccacagatcttatttacaataaatagctaggttaggtattgctagttttgtagatggagtgcctatagaatggaaaccgtctgccattctccttccaaaacaaggaaaggaactaaaaaagcaattatgtctgtttccttgtcttaatagacaacattgttgtgagctgctaccagctttctgtgttcccatgcaagctataatctatgatttgcctctgtaatttcattaatatttagtgaccagagactttttgagtgttaacagatacattctgttaataattattctggtgacttcattgtgcttatggtggaaaataggtctctgaatcacatttattgttttcctttacgaacaactaccaattatttgactaaatcattgtctataagctaaatgagttttcagccaactaaactgcatgttactgaaaaaacttacgtgacaaattaacaaagtacacattttaaaaaagatcaaggactcgtgagccaagaaatttcaaaccaaagataatatgttttataaaggttgaagtagatttttcaattagaaagtaaatggaacgcattgtaaatgactgcagcttctcttgttgtgtttttactgtgatccagaaatgactatattgatttttgaagtttttacgttaacaaaatcactgagactaaatttcatggctttgtgacttctgggtcaactgataacagctgagagaggctgtgactgatgcagcttctctgctagttgctccttcctatgctgaagtatttttttagagccatcttttatctttacttagaacaatgatgttgtggtttgttttattcagatcaagttttcagaagccgactactttggcaacgtcctacaaactcgcaagtatttagcacagtctgatttcttctggctaagaaaagccgttccaaaaacagagtgagtattaaacaaaaaaagttaaatagataaatacattggtgagaagcggagtctctttagattaaactttgtaattcccctcaagtcagagtagctggcttgccagttaacttgttttagcaaaatctgtgtcatgttttgccaactcttattttttatattacgtgattcagatcttaagtctaattacaggtcccccatttctagcatcaacacatatcaagagaaggcttattagaatgcaaacattaaagttatgtctagatctagttatgaatatatagagagggaataatttctctggatttttacattcatgtaataacttttgaagaccttaaaaaagaataaatacttaaactatgattagaaatgtcaaagtaaatgtatagaagcaactagaaaatatttgttgaggtaatgcctatcaaagaactgatagctatattgtttttatctaatagcagttatgatttatttgccttcctctcagctgcctataggagtttttcctacagataggagagtttccttaggaacttttaggcccagagcccaccagctacgatttcatcccttagcaaaatgtcagtgatgaatgtagcagctaacaattattatttgtttacattgtaccagaaagtgctttacaatttttaattcattttatcctcatacgaattctgtgtggtataggtactgttatccccattttacaggaaaataaaaggcttacaactgagaaattcttcagcttaggtttggatcacattttgttctgtctgctggtgcttttgattcctgggactggattctgttctgctaaggcccacttctccaatgcttttttttctctctgttctccagattggataatttctattggtctggatttcaactccagaatttctttttttaatttaattgtattattatttttttaacttattttttatttcaatagattttgggggaacagatggtggttggttacatgaataagttctttagtggtgatttctgagatttcagtgcacccatcacacgagcagtgtacatgtatactgtatcagtgtgtagtcttttattcctcacccccctcccactctttccccctaagtctctaaagtccactgtatcattcttatgcctttgtgtcctcatagcttagctccctcttatgagtaagaacatacaatgtgtggttttccattcctaagttacataggataatggtctccaattccatccaggttgctgtgaatgccattatttcattcctttttatggctgacaacttcggaatttccgtttgttttttgtagtttctatttctctgttgtgattctttgttaagtcattgtcatcatattttctattaattcttcaaataaagtttattttaattctttgaagtcatctataatagtcactttcaagtctttgctaaatctaatatgtgggctcaaactaactagagttagtttctattgattgcctttttattaaattaattaatttttttttacagtttttcctttgcttaacattttttgttgttgttgctaatgacagtttagatagcatgttgtagcaactctggattctgatttatttttctgaggctttttttttttaaaatcaaaagtaactgtcctaacttatactgccgaatagatcttctctgtggtatgtagctgtcgatgtctccactcagttttttaactcttatttgtagttattagcctcacttcctgctggttgtccctgtgtctacatagcttagtgctcaatcagtgattaggtcagagcttgtgcttaaacaccttgagtccatagggcttctaccctctgccagttgctctgtgtgtgggttgggagcaccttcaaagttatagccagttctcagtccaccttcaatttcaccttccaccaggccctcactggtcttccctgcacatgtgcctagtttcccagtcagccagggatgtgtggagtgcttatttggcccttctattactatttcagttataggatctctcttttaaatttctgactgggttttcctcgttagttttctactaagttggccattcaaaaattaaaaaaaaaatgttgtgggtatgtagtaggtgtacgtatttatgaggtacatgagatatttcaatacaggcataaaatgtgtaataatcacatcagagtaaatggggtatccatagcctcaagcatttatcctttctttatgttacagacaatccaattatacagttttagttatttttaaatctataaaaagttgttgactgcagtcaccctgttatgctatcaaatagatcttattcattctatctaagtatatttttgtacccattaaccatcccctcgacccagtacccttctcagcctcattctactctctatctccatgggttcaattgttttcatttttagctcccacaaataagtgagaacatgtgaagttttctttctggggctggcttatttcacttagtattgtctagtttcatccatgtagttgtaaatgacaggatttcattcttttttatggcttaattgtactccattgtatatatataccacattttctttatccatttgtctgttgatgaacacataggttgcttccaaatcttggctattgtgaacagttctacaataaacacgggagtgcagatgttccttcgatgtactgattttctttcttttaggtatatacccagcagtgggattggtggactgtaaggtagctctatttttagttgttcgaggatcctccaaactgttctccatagtggttgtactaatttacattcccagtaacaaagtacaagggttctcttttctcaacaacctcaccagaatttgtttttgcctgtcttttgaataaaagccattttaactggggtaagatgatatctcattgtaatttttgatttgcatttctctgataatcattcatgttgtgcaccttttcatatacctgtttgccttttgtatgccttcatttgagaaatgtctattcagatctttgtgtctatgtgtctgtttttatgccaatatcatgccattttggttactatagctctgtagtataatttgaagttaagtaatgtgattcttccagttttgttgtttttgctcaggataacattggctattctggatcttttgtggttccatataaattttaggaatttttttctatttctttgaagaatgtcattgatattttgatggggattacagtgaatctgtagattgcttttggtagtatgggcgttttcacagtattgattcttctaatccattaacatggagtatctacttttttgtgtcctcttcaatttctcgcatcaatgtttttatagttttcattgtggagacctttcacttctttagttaagtttattcctaggtattttattttattcgtagctattgtaaatgagattatcttcttgacttcttttacagatcgctttctcttagaatatagaaatgctactgatatttgtatgttgattttgtatcctgtaactttactcagtttatcattttaatagtttttttggtagaacctttaggtttttccaaatataagatcatattgtctacaaacaagggtaatttgacttctttctttctaatttggatgccccttatttccttctgttgtctgattgctctagctaggacttctagtactatgttgaataatagtggtaaaagtggacatccttgtcttgtctagatcttagaggaaaggctttcagtttttccccattcagtgtgatactaactgtggctctgtcatatatgactattactgtgtttaggtatattccttctatatccggtttttcgagagtttttatcctgaaacgatgttgaattttattaaatgcttctttagcatcagtttacatgatcatatgccccgtgtttctttccactgtgataggacagcactgagttccagtgcaaagtcccacaatcaccgtactctccttcccccaagcgcagaggtttttctctctgtgcccatgtggctgctgctggggaatgagggaaggacggtataggcaattcaagactggctttcctaccctcttcagtgcctctttccttgatgtgatgttaaaaccaggtattgtgattgttcacctggattttggttcttatgaagatgctttgtgtgtgtgtgtgtgtgtgtgtgtgtgtggctagttgttcaatttggtgttcctgcagggaggacacttgctggaggtttctacagccttcttgctctgcttcatcctctatgttggccatttttatctgacaaagctgtggcttttcactgccacccccagttgagtctacccactggggcagcaaagctgctgatttcccagccagcctttttctgacaaaactaaggtctcactgagctaggagggacaggagtagtctcaggcaaaaaggccatagtgcctgctctacttaatgccaagttctagcagtttttaaatattaaattttgtttaatttattgctcccccttgatgaattcccagattcctaaaatggttatttgttgacaatgttgtccagttttatacttggtttttgtagaaatgatttgtcaaccttctcatgccattatacctgcaagcctggcttccatggattacaattttttttttcatggcccactttttaaccttggctaatattctgatttctagatctttgactggctgtttttatgctgcctagtcttttgctactctccctttcaagtccctgttctgtcctggcttctagaaactctgagcccctgtgctttcccttggcttaagtggtgattaccacttctccctcttatgtttccatccggccatccctgctctctgcccttcaaaccttcctataatatgcacctgaaaaattcattggaggttactgactttaagaggtaggcctaaagctgaatctctcccctacctaaccctgactccagtcaaaagcacaaaggaaaacagctttagaactgctttgaaaaatgatagataatggtttaaagccatttgctccactgtctttggttctttcctctcatcacgttatttctcagtccacctatcctgtttcattcccagtctaaattattcaatagttttagatttaggcttcttaaatccaatactcaaatctgatgactttggcaaatgatttccagtatccctatgaccatctacatgtaatacggtagtcacagatctatataatcttgcccttcaatatttgcttcagatcagttccaactcttttttaaaaaaaaaaatctgtggaaaattgaagggtttcaccaattttttggtgaattttcagggtcttctcaggggctcctgcatattggcaatacagtcagtctaattgtttgatttcaaaatgtcattattcatttagttgtgtagaaaggcctggattagtaattgaaaaactcctaaatgtgttatctttaacatcgtcctaggatactgatgaactttcagattctaatggtcttaactatttctaatattttattcatgccttagaaatatactggctttgcaggcttaggcaaactgagatttgtgtggttttcttttctgtcattgaaaaacaaatagctctttcacaagggtattaaattggttaacttttgggaaaagttctccagaaatggaaatcagtgcaatgcttgtaattcttgtttcctcagactatatgtctatttcagggaaataacatttagaaatttaaggtcttctttgcatagtaaagggatatgagtaaattccttttccttcttgttttttttttttaaaggaaacatctggctggaccttttcaggcattgtagagacttttagcctcatgatactcattggcttgaatggacatctttcaggtctgaaaattcatgagttaatcgagtggggatcattctggagtagctctactacactagtttactttgaacagcatcatgattatattttcacaaagccctgaaataacgttttgcttctttgtgggtgtaggagataaagaccctttatcttttattctcatggaatccattttagctgcactaatgtgcattaagaagtttctaaggcgatgggaaatgtcagcaagaatgaaattaattgggtggtcatccctgaaggtacatatttaggggttggttcacagaattgtcacttcatcagcttgcttaaaaatagaggatttacttactgctcggcttgagttgaaagtaatttctttccctcaggatcaccttctttgacagaaattattttagcccgcctcacttttaactcactctcattctactgagaccaaacacgtctgaattctctatcttttgaaaaatatgtaaaaatgcattaaatgtctttataaattatgttcctgcccagaacttttgtttgcaaaagcattatctatagcatggaatgtgagtgatataatctgcaggatattaataagaaagcaataaatacactattgcttttccattccatattccctagactatctgtaggagttgataagaaaaatgtaaaactttagcctgatgtatatctattttatatggtccaaagaaataggtgtaccaatgtctttttcttcagattcttgtattttggtattatattccttttatgtatctcattctccagtataatttcatccccattattgtgggatttgaaatttctatgagacctctccttaccttatccaccaaatcctttctcaaacacagactgcagaagcaccctaaagacatagtaagaagaatttaaagcacttgaatgatattctctgtttattgaagtggatgtatacatgcaataaattcattttaatggatttagtgatcttctgttcagcacttaccatttggacaacagtcaaagcccataagcaacttaaaatcttgttgggacataagctgtgcaaactcagatgccttcaggggccagtcagttaacaaatggttgacctacatgggtgtaaacaacagggagtggtagggactgtagaaaactagtaattacacacaccacttgaaggaattccaattcaatagtttgttaagccattgtgttgggcaagcaaaacagttttctgggaagattcagcccattgggttggacttagtctgtggatagccaacttttcagcattccatttatctattgctgtgtgataaacctcccccaaatttagagtactgaaacaacagtcattatttttctctctcatggttctgggggtcactaggctcagctgcatggttctcgtttgtggtttttttttttttttttggacacagagtctcactctgtcaccaggctggagtacattggcgtgatctcggctcactgcaacctccgtctcccaggttcaagcgattctcctgcctcagcctcctgagtagctgagattacaggtgcccgccaccacgctgagctaatttttgtagttttagtacagacagcatttcaccatgttggccaggctggtttcgaactcctgacttcaggtgatctgcccacctcagcctcccaaagtgctgggattacaggcatgagccactgcacctgaccatttgtggtctttcatgtagttacagtcagatagtggctggggctagagtcatatggaaggctacctctctcacatgtctaatggttgatgctgactgttgactagaacatctacatatggcctcttcatgtatgttgggtttccttacagcatgttgattgatatagaaagttcaaagagcagcttttctgagaaagaagaagggagggagggtgtgtttgtatgcatcagggggaagttgtatcacctttaattacctagccttggaagtcacactgtcatttctgctgcgtattattctttagaagtgagtcactaaggctaacccataatcaaggggagaggaatttagattccatctcttaatgggaggagtgtaaaaaagttcacaaacacatattaaaactagcacatgtagccttacattagagaatagtaaaactaaatatataataaacttggatgtaatacgggagatatacaaaatgtttaacagctggtttggcatgggccctgaacaaatagaagaaataacagcatcaacaactggtaggatctactggtgcagctgcttaatatcagctctgggtattatcaagtctccatacgtgccctagagtcaataagagccctgggaggtcaggaatggtaagatcatgtgtctgaaataagatgttttcgttattcttgttgaagcttcagaagccccattaaggtctagtttcagagactggttgtttggtttgctttgtctacctttgtctaccagcagttaggaacattttccctgcatggcccttacctgaatattttaaaagtttgttattttaaagagaggggagttgggaagaacaaaaagagaagggacaagctctaggaatacacgttatcttttgtatgtattatgattcattccagtgttatttagaagccaaggcacccacctggattttcccctcttgacctacaaatgttgggttctttggatagtgcattagtttcctattgctactgtaacaaactcctacaacctaagcagcttaaaacagcacagatttattatctcacagttctctagctcagaagtctagggtagcttggttgttttctctgctttggatttcataaggctgaaatcagagtgtcagccggctgggctcttatggggaggttctgggaataatccccttccaaggggattcaagttgttggcagaatccagttctttctgattgtaggggtaaggtctttacttccttgctggctatcgcctggaagccactctttgttctcagagggatttatgcagtccttgcccattgcccctacatcttagagccagcagcgtgtcaaatccttcttacccttcctcctctccgacttcctcctctgttgcatctctctgattccagccaaacaaggttgtctgcttttaagggcttgtgattagattgagcctacctgaataatccaggataatctctctattttaaggtccttaagcttaattacacctgcaaagtccttcttactatgtaatgtaacatgttcataggatccagggattaggacttggccataattttacctactacaggtagccaagttaggtcaatagaggtgctttccccttcacttgtttcctcaggaaagtaggccaaccagcaagtttatgttaaacactagggcttaattgaaataccctaaatttgaaggaaaagaatatgcattttatggaaatatgtctaggtttcggttttgaagagagaagaggtgctctttcttgatttccagtaatgtctacagtataatataatgcttaggcgaactggtttgaagtcagacagaccaggcctcgtacaagcacataatgctcataaatctcattatcctcgtctgtgaaatgggctaataattcctatgttgccatggggaaaaactgatgaatagaaggtgcttaggacatagtaagtgctcaatgaatgttagctaaatataatgataatgataacagaatgacatattcatagacttctttgtagctggggagaaggtatgagtttaccaactagtatcaataattgggtttcctattagtttcatattaacctgatataaattaatttgttagtctgacataattatcctattagacgtaaatgagtaatacaattattctagaaagggatttatacaagttttttttttctttttaatttttttagagactggaacttctgggctcaggcagtcctcctgcctcagcctcccaagtagctggaactatatttgcatgccactgctgggcctaggagtttatttttagcaattttgcttaagatgaattgcttggttttaatcataacaagcagtcactgaaactcacaaccatctaagtcagggtttggccactatggcctgtgggccaaatctcacctgctgcctgtttttgtgtggcccatgagctaagaataatttttagagataaatgtttgcaggtggtttgatgatggggaagccctaactttgttctgttttttgtttttgttttttaattaaaataacttttgttggtacgtagtagttgtaaatatttatggggtacatgagatattttgatacaggcctgcaatgcataatcatcacatcatggaaaatgggagtatccatcccctcaagcatttatcctttgtgttacaaacaatccgcttatattattatagttatcttaaaatgtacaattactattgactatagtcaccctgttgtgctatcaaatactaggtcttattcattctttctaactatacattttttgtacccattacccatccccacttctcccccattcccctaccgcccttcccaacctctggtaaccatccttctactctctatctccacgagttcaatcgttttggtttttagatcccacaaatacgtgagatctcacaaatacgtgagaacatgcaatgtttgtctttctgtgcctggcttatttcacttaacataatgacctccagttccatccatgtgttgcaaatgacaggatatcattctttttatggctgaatagtactccattgtgtatatgtaccacattttctttatccattcacctgttggtggacacttaggctgcttccaaatcttggctattgtgaacagtgctgcaacaaacatgggagtgcagatatctctttgattatttcctttcctttgagtatatacccagcagtggggctgctggatcatatggtagctccatttttagttctttgaggaacctccaaattggagaagcataactttgaaccccaattaagcaaaaggttatctcatcccaaaataattccattattctcattaataggcatatattagaaataattgtactcagctgggcatggtggctcacgcctgtagtcccagaactttgggaggctgaagtgggtggatcacttgaggtcaggagtttgagaccagcctggccaacatgccgaaaccctgtctctgaaaaaaaaaagagaaataattgtacttgattactattgttattttttggatttcatcaataaaatttgtggacagtttgctcttaagtacctacgtaatatccttgattttgcctctttgcctgtaaagcctaaaatatttatgatctcactctttacagaaaaaaatttgctgactgctgatcccagtaacctattgtgcatttaaggtttgggtgtagactccttttagatagaagggatcctttagatgtcctaatgcaatgccttaattttatagctaaaaccaaaccccaggaaggtaggtgactcttcccacacaattcagctagttagtgatagaggcagtacactttccactggagcaggcagaccctctgggtggcatagttggactttattcatctttctttaaatggacctctgtgttgtcaccaatccagaacttttaaatggacaggccagaggtaatgcagcatagaaacccaattgtccattcaacccattgaatagggcctggcaaatatatagttgctgtgtttccatttgcagggacagccctttagattctagaatttctctttaaaactttttcaaaagcactggtgtgctgactttttttctgttaagttagtaacaataaataactgggcatgttaatatattttcattgagccatgttcagtttaggatgagattgttcattgagcagtacagtagccccaaactgagggaataatttcccctcatgtccaacatccccattgttccatgttatctgctaataaacccagccatgctgtgtttgtctttgcttccctcctgcctgtataatgatgattgctctctggcatttgtttctttttctacaggtggtttacaaatccgacgactgtcaatgccttctacagtgcatccaccaaccagatccgtgagtacgggttccttgtctccttggtaacctggtataaaatgcaaagaacttttccatgactatgatggagggtaagacatttcttatttcccccaaaagtggcagggtatgctggtgaaggaaggttgttctcctacctatatgccaaattttcctcactctcttcaccttaccagttttttttaaagctttatgtcaccactgattgaaaaaaagtcaactacagtaaaccaaattaaaccataatgaagtttgccatgaaaaggagcaagtttccactttcctttcataatggccttactgattttgtccatgccattttattcattcctaggattggtggggaaaacagcaggtaactgagcagattgtagaacctgagcggaccatctgtatgtaagaaagaagcttggaaatattcttattaacgctaggaagttatgtcttgaggttttctacttacatgtatcaggtatatgtaattaaaaataccatgataaatttaaaaaattattatttttattattttttaaagacagagtctccctctgtcacctaggctggagttcagtggtacgatcctggctcactgcaacctctgcctcccaggttcaaattattcttgtgcctcagcctcctgagtagctaggagtacaggtgtgcaccaccacgcccagctaaattttttttatttgtatttttagcagagatggggttttgacatgttgactaggctggtctcaaactcctggcctcaagtgatctgcccaccttggccttccaaagtgctgggattacaggcgtgagccactgcacctggccttaaaaaattattaagatctgaatggcacaaataaaaagtctgacagcttccagccttggcaataaggacacatactcactgctggtggaaagatagatgggctcatccactttgcagggcaatttgacaatatctcaaaaagctgaagttgtgcatgcatacctatgaccatgatgtgtgctcctggaatgtgctctaatgttgtgagtcttgaaatgtggtccttggacctgcagtaatagcatcatgggggatcttgttagaaatgcaaattcccaggccccaccttaggtctattgatcaaactttggatgtggagctcagaaatctggtgcaataaaacctgcaggtgattgtaatgtatgctaaagtttgggaacagctgccctagagaactcttgcacaaggcataaagaagcccatgcaaaaatgctcataacagtattatttataatagtagaaaaagcaaaataacctacatattcctctgcaggaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtgggccactgttgctcaaatccttgctggtttctcctcatctcccatatctcttaatgatggcatgccccaaggctcagtctgcaccttttctgttctcttctctccatctttgctcacttgcttggtgataacatctaatctcatggttttaatcacatttctacagtgttgaatgcaggggatggaatttatcacccttgttcataccactactatctcccacctggattatggtaatagcctcctcattggcctccctgcttttgttcttaccccccttcagtctattctaaatataatattgtagcgattttaagacgttttacaatcacatcgtgtcacttctttgctcaaaagcttttatcagcatcccatctcactcagagaaagagccaaattatttataatggccttaaggtctgttatctttctgcctgtacctcctgctactctcccccttcctccctccttctgttccggccacactggcctccttcgtgtttatagagcacacctgacacgctctgctctgggagcatttatacctggggttggctttctcttggaaaacttccccaagtgacctgcctggtttatgctcccatttccttcaaatctttattcaaaggccaggccacctccttagggaggcatcctgccttccctctggccagttggccagtctgccgtgggtcctccatactggccgttgttcctacaggactctggtcagaggacagccggaaggctgtggctgctcactaccagctggcacatcttcttagagccgccctcgtgtggccactgttaggaatggcagtttctgcccgacttcggtctgagagagaaatgaacagaaagacgaaagacaagcagatggcgggatttttttatttatacattaatttacataaccaagtaagttgttaaatattttgaatgtcacttcttactgtataaatattcattatcacgaaactaccattgctttcttaaggccctaaatgccaacttgagaactaagttgcatatgttatatgggaacttatgatatttgagttattaattataactaatacttataataatttattattaattataatcacatttaggacattctattgggaaatagaaattgtttagattattcacttaaaaacgttttattgtctaatatttggtacatgcaaaagaacatgtaacattttggcacatataagttataaagaatatatgaaaacatgacgaaattaatatgtgcctacgacgccctcaccccatcaggaaccatccctccctctcaccacagaagtaacactcttctgatttgagggtttatcatttttgttttgtttttttaaaataaaactttatttatataggtatccctaaagaatatgttgtttatttttacttgtttcttagtataataaaaatggtatcttactgtatgcaatcttaaacaactgcgatttttcagtcaacatgtttttaggatttgttcgtgtagcatgtggtggtaggttgttttcatgttcactgctgtataatatttcatgactgtacccccagattgtttattcttctgttgtccagcctatgagtccccacacccaggtttttgcttatgaacagtgctgctctgcatattcttgtgaatgtctcttggaacaagtgtctgagggtatacatccaggagtggaattattggctgataggaagaagttatctaccagataatatcaaatgttttccaaagctggtgttccaaagtacagaagtgtttctgttgttcctcattttcatcaactcttggcattggtagatttaattttcaccagtctagcgagtgtaagagatcagctctgatgcaagaaaagccgacgtttccgcattcactttaaaatgtcactgaaggcttactgctccttggggtacttaagtgtgtctaataatagttccatctccagggttcacccctgctcagcctttttcttgcctgggaagggctaatcctatcagaggtttactgaggaagaaaccatttcagggtaacccaatggtttcatgaaagctcatgggcagagggttttttttaaaatgaacaatttgaaacagtattttaattaagagattcaagctgtttctgttttcctaatgaccagtgcttgctctcattgtaaattacattcccaggcaagatgacaaggaatcctttgggtgacttttttttcccctctctcctttctgattttctggactacaaattaagacaggtggagtttcttcttacacacttccccaccgggtttcctgggacttcccccaccctacaactgccttctttttgcttcgctgaagaagtgaaaaattgaggtgattctctaaaatgaacatctttattgattaggggctgattctgacagcatgtggccatctgtttaattgggttttacatctaagatgtaactatacttagtaacgtgatttatgacaatttcattcagttcccattatcattttctgatttatgctacttaaatcttcttctgcacgcaatagagacttgaatagaaaacagaaaaacctgtagttgttttttctttttcaaatccatgcctttgtgtggaaccctatgatttgtggccatctttcaatgttagatttttacagggtggttacaacttcttatttttcttcccttgtcaagctgggtagcaacgtctctagacatggcatgtagtgtgaaattataatgatttaaatctgctgtatgaggagttaaactcagtagctgtcataaaatttaattatatttgaataaggtggttaaagaggaaaacacaaatctgaaatgattggtgcttaaccctaactttgtgataactgcgacactgatcttgctgcttttcagagtggcaaggtgagaacatgaatcagagatctagtttgtatggccttagtcgaggtttttatccttccagacccctattgtcctgtctgccacatgttgaggctatctagcccatagggttttaggggaagatttaatgagacgaatttgtaaagtgccagcacattgccaagctcagggcttgtatatctaaacctggcatgccaggaatccctgcgataaccattgtgtcacaagacaaacagcaaaatataaagatcggcaggggggattatttcaaacttttgccctcaagagatcttaggccgggcatggtggctcacgcctgtaatcccagcactttgggaggctgaggcaggcggatcacctgaggttgggagttcgagaccagcctggccgacgtggtgaaacctcatctctaccaaaaatataaaaaattagccaggcttggtggcaggcgcctgtaatcctagctgctcgggaggctgaggcaggagaatcacttgaacccaaaaggcggaggttgcagtgagccgagattgtgccagtgcactacagcctgggcgacagagtgagactctgtctcaaaaaaaaaaaaagagattttattataatgttccacattataatatgtatgcatgcaactgactaaatgctgagtaaaagaagccaggtgtaagactaaatactgttctgtttcatgtgtataaagttcaggaacaggcaaatacatctatatgatagaagttaaaataatgactacctttgttgggggtattgactgagaggaggcatgtgacacattctttatcttgatctcagatgtggttacacaggtgatacaagagtaaaaactcaccgtgttctatcattaaaatttgtgtctggctgggtgtggtggctcacgcttgtaatcccagcactttgggaggccagggtgggaggattgctttaacccaggagttcgagactagcctgggccatatagcaagaccctgtgtctacaaaaaacaacaaaaaattagccaggtgtggtggcatgcacttgtagtcccagctactctggaggctaaggtgggaggattgcttgagcccaggggtttgagacagcagtgagctatgattatgccactgtactccagcctgggtgacagagcaagatcctgtctttaacaacaacaaaaatgtatgcttttactgtatgttaagtgacacctcaaaataaataggaacactgctccttttctccataaaaatgtttggaacagcgtatagtatgcatggacatctggagctaataataggttgcctcaggctaagtctctagatgtgtagaccagggattggcaaactatttctgtaaattgccagatagtaatatttttggctttgcaagtcatagtgtctttgttgcaatttctcaactctgccatggcagccatagacagttcataaaccaatgaacctggctgtgttccagtaaaactttatttacaaaacaggtggcaatattcaggtagtggtagtggtgggaagagtgaacagctcatatttggttttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatgggggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctcatccaaatttctcactacctaaaagagatcctgacactcagagcaattcttagtaattttttttccacttattcacttgattttcaagtgaattttcaaggccccaatgattttcacttcccggtattcattcccctgtctagtcccctgccacactgagtaaggcttaccactgtaactaataggatgctatggaaattctagattatgacttctgaggctgggtcataaaaaacattgtggcttttgttttttggataatgttcactctgggggaagccaaccaccacactgtgagggcattcagggagctcacacagagatccacatgtgaaggaactggggccccctgctcattaggagtaccatgtgagtgcgccatcttggaagtagatccccagtgcagccaagctttcagatgaccgtggcccaggctgacatcttggctgcaacctcacgagacactgatacagaaccacccaaataagctgtttccaaactcctgacccagagaaatggggagatagcaactatgtctggggatgatttgttacacagcaagaggtaactaatatagctattagagcatgcccaggtactaactgagtttggtaggagggtatataactttgtgtggtttagtggttaagggtgtgagctctgaagtatgacagtttgattttgaatcctggcttggccactaataacttgcaaccttgggcaagttacttaacatctttaagcctcagtttaattatctgtaaaatggagctaatagtagtaaccatcctatagggtttttgtgaagattaaatgatactatatatttaatatctaatgttatctagtacattttataatctaatattagatacataatattaatatgtaatattaaatattaattatatctaatattaatatacatttatagttatatattataaattatacatataatatattatataatatttatataatatatatcaatatgtaatatataagtatatattaaattatatatacttatatatatgttaatattgtatatataatatcatttaatcttaaccctataggatggttactactattatatatatatataaaatgcttggtatagagtgtggttcatagtaggcacccaataaacattagctattagtccttgcttttgaggagctgggagagagagacttgttaccaggtcatttagaagacatcatggtgagtgtgcaacagaagggtgtgcagtgcattctgggagccacagtggaggggcaattaagcctgggggagtcaagattggattccctatgaaactgatgtttgagtggactttggaaagaaaaagaaatttctctgggcacagaagtgagattagggcatttaggaagaagcactgttgtttggtgcaaaggcgcagatatggcagaacatagcacaggaacagactgtgagatggccacaaatgctggggcacagcttgcactggtggaagagacagcaaagggagtgatgggagatgataagtggaaggaaggctttgtgggtcatgtcaaagaacaggccagagggagctagtatagtttttttgcggggaggcaaataacttaagttttacttctgtattggtctgttttcacactgctagtaaagacgtacccaagactgggtaatttataaaggaaagaggtttaatggactcacagttccacatggctgggaggcctcacaattatggcggacggcgaaggagcagcaaaggcatgtcttacatggtggcaggcaagagagtgtatgcaggggaactcccatttataaaaccatcagatctcatgagacttattcactatcatgagaacagcatgggaacaacctgcccctatgatttaattacctcccactgggtccctcctacaacatgtgggaattatgggagctacaattcaagatgagctttgggtgggaacacagcctaaccatatcaacttccttaatcctagtattaaagatcatggtctggagagggacagattgcagccactaagaccagttaggagttttgcaaatggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaaatgccagaagtaaacagttcctaagttttaagtcgtgtgccattctgagtagcatgatgaaatctcttgctgtccagctctgtgccacctgggacgtgaatcatctctttgtccagtgtatccatgttgtatatgctacttgcctgttagtcacttagtagctgtctcagttaccagatcaactgtcacagtgcttgtgcccaagtaacccttatgttacttaataatggccccaaagcataagagtagtgatgctggcaattcaggtatgccaaagagaagcttcctttcagtgctaaggtgaaagttctccacttaaggaaatttaaaaagaaatcatatactgaggttgctaagatctacagtaagaacgaatcttctatacatgaagttgtggaggaaaaagaaatttgtgcattgtgtgcgtgtgtgtattagtttggtactatctgaggtttcaggtgtccaccaggggtcttggaacatatctcccaaggacaagagcggggactactgtacttttctaactcttccactagggctttacaggacttccatcaaatggagattataactgttctgtgcagctaggctttgctgaggaaccattaatatgccaaccattatgccaggtactttaatgtatgttatctctaatcttcacaacagttctataaacttggtattatgggctcattttacagaagaagaaactgaagctcagagaggtgatgcaacttgcaaaagactgcaaaactagcaaattgcagagctgggagtataacccagcttatctgattgcatcctgtttatcgtcacactacactgttcaaaactggataggaaatgtgagaattacagtcacgtgataggctgggtgcagtggctcacgcctgtaatcccagcactttgggaggctgaggtgggtggatcacttgaggccaggagtttaagaccagcctggccaacgtggtgaaaccctgtctctactgaaactacaaaaattagctgagcatggtggctggtgcctgtaatcccagctactcgggaggctgaggcacgagaatcacttgaacccgggaggcggaggttgcagtgagctgagatcgtgccactgtactccagtctgggtgacagagtgagactctgtctcaaaaataaaaataaaaaataaaataaaaaatagccatgagatgatatacaggaacacactctgaaaaggttaagggtatgatataaatgtgttagagtaatcattattatatcaccccctcacccatgctgctcgttcactggttgggggattgtttctcttctggtatggaaacaagatattatagaatgtaaggcagccaggaggtgagagtgagaagtttagatggtccccaagtcctactgatttcatgtccaaaagggttgtggcatcaagcagttcattattgcctcttctaacgatgctgttctctgcaagctttttggccaagcctgtgatctccttgggtctttagcttatgggaagagtggaggaggggttattctgtaagctagcttaaaaggagtatttagatatactcccccaaaaggctttactttccaaagtttacactgagattttaaaagttttgttaagtgagctgaagttaagtcatgaacaaactttgaatagtttgtgaaattgacagatgatgcacttagcaagtctgtggaacacctgctacaacttttttgtttttgttgttgtgacagagtctcactctgtcacccaggctggagtgcagtggcccgatcttggcttactgcaaccttcacctcctgggttcaagcgattcccctgcctcagcctcctgagcagctgggactacaggcgctcaccaccacgcctggctatttttttaaaatatatatttttattagagacaggagtttgccatgttggccaggctggtctcgaactcttgacctcaagtgatccacctgcctcggcctcccaaagttctgcgattacaggtgtgagccaccatgcccagacctgctacacctattttaaggcattcttgtcctggtctagttgaggaatttggaggtcctgatacagacccccagtttctgaagcctaaccaaggaggcacctgagaatggtgttctgggtagtatcctgggaggacaaaactagcttcatctggaatgctctgcagtctcatgggattcctgttaccatggtaagtcccagaaccaatgcctgtaaggatgcaatttgccgcttgcagggtatttctaaatgctgttttcagacatagtgcactggtcaggttggctgcagggctggtagtaggaaagcatgaaatgattatcagagtcaacctgattaaagacaggatgtaagcaagccagggtgaggtgagcatagggacctaaaaaccagccatgggaacaggagacaggatgtcagggagaaatctcattaattgaccttgatggtcacagtctcatttgtcttctctttaaaaaatcaattgttttttacccttatttacaaaaggagttcatatttattgtagaaaatctagaaaaattttaagtgaactaaaaatttaaaaagttaatatcatttaaagatagtcatggttaatacctttgttgaataccactgagatgtatgtttatctacaaatattttacagtttaaattaactagactcatccaacagtactactttttccccactgaacattgtaacatgaatattttttccatttattacatattcttccaagtcatcgagtgtagtgttcaattgagaaaacaccttaatttatttaattacttcccaatggacatttaggctgtttccctattgttaaagaaccctctgtattaataagttttgtggctttctgtctaaatctgagaccatttctttagagtaaattcctagaagtggaggagttgctgtatcaaatggtatgccccatttgagggttttgaaatgcatcttacccaacttctctcaagaaagcagtacaaatttgtatttccagtaacaacaaatgagatggtttaacctttaatgagttgcatcttaaagatactgttggaggaaatgaatagagagactcagttttttgtctaactgatatagggaaaatatcagtcacatttcattcttgagaccattattgcataaccagatatggttcagtgaacccacataagcatttgttgagtacctaccatgctcccaggcctgggctgaatatccctgctgctagtgtcagtttcaaatacttagtacagcaatcaataaatgagaggacctgttggaatatgagtagaatatgagacaccgagctttatagtggaaggaaattagtgttttctttgccagatgttaaactatagcagtggttctcaaagtgcggtccctggatcatcagcatcgcttgtgatagatggggattatctggccctacctcctgaatcagagactctgggatttgggcccagcaatttatgttttaacaaggtcttaaccaccaaacttctgcaagatgccgaagattgaggaccgctgagctataaaaaggcagcaaatgcagaagaggtcagacttgttgggtaaaggtggggtgactaacttctcctggtttgcctgggaccatcccagttttagcacagaaagtctcgcatcccaggagccccttctgtcccagctagacagggatggttggtcaccctggtaaagggtggcaggggtgaagggaggttctctttgttgcagcctaaaggtaattatggcagaaaaagaatagaagggccagcagagaaggtttcaagatggagggcagatttcagaagctgctttctgcttgtcagctctaggctgatagatgtggtggcaggaggttacctgcaggaagccagcagatggctaaggcatcttgctgaatcccttgacaggagtcacagctgttagaacttgatactttctggaaaggggaaggttggcattcaccaaactactgcaagatgccaacttgaaaaaaaagccatgattaatcttagcagtgatgacaatgaaatcattttacagcaaaaaccataaccaaaagtgctttgtaattgcagcaatttccatgtcctgactgatggccccctagattctagaatggtgtcgggcttatctgattacaagaactaatcctgaataagatgtaacattcattcttagagtaagcattcatcccggattttctaaagcaggtgcaatttaaactctttttgttctttactacagtcaataatgtataaggcatgtaaagtttcagttttgaaagtatagtgtgcaaaattttaataaaagtaatcatacgttacattgttacatgcatggtgttgatgacagaaagacaggagggctgatttatagatcagttaaacataagaaattccttatttttcctaaaccaacaattctgaacctgttttcatagtcgaatcacctggggagcttttaaaaaatgcttatgttcagggttccatcccagagatggtgacttaataggtttgaggcaggggcttggacatagatattaaacaagcaaaattccccaggtgatgtgcatttggggttgagaatactgtacttaccctgatataaaccaatgggtcccaactttagcatgtaccagaatagcctgaagtgctattcagtaggtctagggaggtgggggtgcaaacatttgcacctctaaggagtgccctggtgatgctgatgctgctggtttgcagaccaagatttgatcaccagtttcctaaaccattcctactccaaaccccagataatcgtacaaaccacatctgtcacccattagctagacatgtgaataaataactccctctcaaaacacttctgcacatctactcccacgtatccagtatttcttttctctactgagtttaaaacatatttcaattaaaaagcatactttagaaagcttggtataggtttaccttcctctttaggtcttgcaaaataggattatttgtcgagtggtatcctttctccctcactagattgtaggttctctgaggacatttgtttgttcgaaggttgcccatgtggcttaggacatcataggtgctcagtaaatgttagtagtcagtggttatgcatagaaattgcatcatcataaccaaacccacctattcccagtagtttttataatgggatctaaatagactgacactccaaaattaggatcataaaacgtattcacttagagaagtcgaagctattgcacaggacaagtaaaataatcaaagaagttagcagaaggtaactacaagggaatttcaccaagaaggacaataatgtagataagatgatatatcagcaatagccctgaaatgtggactgatacatagagtagtttagtaatataagcacacacttaaggcttttgaaaaaaaaataactgtcacaacttgtactggagccacattaatacatcaaaaaatccatgcaaatgaccaaatatcccattgtttgacaaaactaataatgcaacagaatgtattgacatagtccaccccttaacaaaactatcacaaacatccacactgaaagaaaacagacacaggtacacacttaatgaaaaaacccaagtatatttctggagaaagcagctacagcaaatatggaaacagatttagttcaataaacagctgaatgtgtatgctggtccacacatcctcaagcccattgaattttcctttggaattttcccttggtcacctttttttggattgaatttactttgtcatttgcccctggctctgtcacttctgtccagaggctgctgcagggatcctaaatgaacaaattcaatgatgcttattccttcagaggagtcaaaagagatgttgaatttaagaatgaaatgctcctgaaggtagatgagttcaagttgtcttgcattgtgttactacacttacaaaagtttgctatagagaaaggagaaaagcacatggtctgggtttctgaagactggcagtgaaagttggaggcttcctattttgtaaaatctgaccaaacatggaaataacaggaaaagatgtctgagtctggttcatagttgtctaaaatcatcagcatttataagttattaacacatcaatattaaaaattaatattaaattattaatttattaatactttattaatattaaattattattattaatatttaaaaaacttccaaataacatacaattttggaaggtaatgttttaaaaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaaaaggaagaatattccacttttattgggggtcagcagggagggctaagaggatacaggagtgatggtatttgcataaaactggctggactatttagcttgttaatatctgtattgtgattgaaagtttattggaaaaatgtgctgatctcaaaactacactagttcggcaatgatagcaagagaatggaaccaacaaattctttcatctagaaggaaaatgaaaaccagaacttgaataatgggatgtatcttagatctggtactgaatgtggaaaattcaagaagtaatacattggtactactaatagtatcatgtaaggttttaaactttgtctaacaagatgtactcataatgataggtaatgcttcaaccccagtcatccctctgagtttcacaagatacagaatcagttcattcaacaagtatttattgagtgcttaccatgaaccaggtattgttctagctctgaagacatcaccattaaagaatagtaaaaaataaaaatcccttttgtcatggaacttgcattctagttggggaaagacagaaaacgcatacaaaataagtcaaatgtaaactgtcttagatggtggtaagtgttacgatgagttacaaagcaagaaagtgggtagaataacatcctgccccttaaaaaagcactagggaaggggttaatgaaaagatgatcttagcctacatacctgaagcgagccatacagatagtggcggaaagtaggttctaggttaggagaagagaggcgtagggcaaaaggaaaattattccctttttgcatgtccttctatacagtgtgaatttgctaggcctgaatatatttatttatttgttttcttgaggtctgagctgtggaataatgtgctaaatttgttttcttctctatacttgtttgtactaaaaaaaactctaattaatgcagcttacaataatgtgtactgaaacccagacacattgaggcatttaacttttctgggaaagctgtagctaccgtcagggtatgatttatgactataaaagtcaaatagttgagcctggggtaatcacccactgaatgtgattggttctttggcaattgtgtcctaaacaaaagcactctgtcttttatggtcagcattttgctaagctccaactaggttactccatatttactgataggagaattgtaatgagaaacaccagtaaaaaggagaggttgaccccagtagaaaaccaaaagcaggttcttgtggctttcccaggtgcagatttgaaaaagacagtattactgataaataattaggttattacaaagaccaatattttcttttgtcagaattttaatcattgaagtggtataaccacaatttgtatttttgcctgaaataggagtggaatttgctggtgttaacaaatgcaagaacaaaataatactatataagcttagttaactgtttttcaatagcctttagaagaattttctgtaatacacacacacttctttttttttgagatgctaaaagaaattttaataattgttacataacatactgtgtagctatttgatgaaatctacctctgtgtaataattattaaagtaagtcttgaaatgtatgataagaatatattagttttttgggtacaatttccatgaaaaaaataagaaaacaaataaataactaaaataagaaataggaggttttttatacatactgttgtcatcatacaaaattactctattaactaaatttacctgacattgtcaccgttaaaagcaaaatcaagacaaaactaattctcaaatttatttaattttagtaatatattttatttaaccctatatacccaaaatattttcattctaatatgtaatcaatatacaaaaattattaaagagatgttttatgttcttttttcatactaaggcttgaaaatccagggggtattttatttatttttatttagtgtactttaagttctagggtacatgtgcacaatgtgcaggtttgttacataggtatacatgtgccgtgttggtttgctgcacccatcaactcgtcatttacatttggtatttctcctaatgctatccctcccctagccccccaccccccgacaggcccctgtgtacacacacacttatttctaaaagaattaattttaattacacaagtttattatctttggataatcaaaaggtaaaacattacgtttatgtgtagagccctttttacgagccaccaccccaaatcctgattttcttcaaaaggtaaccactgtgatcactttgataggtattttacagacttttaaggaatttacatatgtatacacatatacacacaatacatgtatatgctcacactggtaggatagttatgtaagaagataaatggtatttatatgtctatatctgtaccttgctttatgccaacaacatgtcttggggattatttcccatgctggaattttaagacctacctctttcttttcacttactgcatagcagtccacaatatggttataccataattaattggcctcttatttggacatttagcttgttgcacacttctcaactacaagccatgcagcaatgaattctgtagtgcacttgtgcaagtgatcaggcagtggttctcacggtggcacccagaccagccgcatctgcatcgcctgagaacttgctagatgcaaattcttagccctaccctagacttattgactcataaactgaggatggggcccagcaatctgtagtttaacaagccctctggtgaatctgatgcattatacaatttgaaaaccactggcaggtatgtctgtttctacagacacacatgtacggatacagtcagttctataatgtaacatatgtgttcttaaacaccactgtgctatgcaaaagtatgtaataaaaggcctcggggcttttgagaaaaatgaggttggggcacaacagttaaaaacttcatcagtgacacgttaaaaacaaaagctgggagaccaataaaaatgatagtgcggttttatacatgttaaatgggtaaatacacaaacgctacagtaaatatggcaccttcccttgaaaagaccagaagtttgcttgtgtaagttggtattggaggggttgacccttgtgagtttttgggtagtggcggaaggagggttacatgaaattggaaggtaagttttaacagcagatgtggtgagtgtggctcctgccgcacgtggtgaactgaggcagttggtcatgttgaggtgtgtgtgtgtgtgcattttgggtattcctatatggctcagtccatttgggtgcatttttctgcttttccctagcatttcttgtggataagcaaatgcgaaattggagttatgtccaaattttcccccagtgtatcaatttccttggaataaatttgccttttcaatacaggtgtcacagctgtatgtatggatgcttattcttttgcgtacattacacaaaataactccatacactgtactgaatgctgtttttcacttaatatttcttagagctttttccatatcgccacatagttactcgtttttttttttaatggcatttaaagcattaagagatgactaaattgatctccaaaatgcttgcaacaacctacactcccatcaacatgcttcctacaccttggccaatattacctattatcacatttattaacttttgccaaccactagttaaacgtctctctccttcctctccctccctctcctccctctcctccctctccctctcttccctctgctccctctgctccctctgctccctctgctccctctcctccctctcctccctctcctccctctcctccctctctctctccctctccctctccctctcctccctctgtctcctcccccacctccacagagacatttacactgtgaggaatgcctcccgtaagtacactgatagaaaaaggaactttaaaagtgtgaaacaggtggcgaggtggtgttgaaatggtaaaaaaaaaaaaaaataaataaataaaaataaaaaggaaataaaatggatatgaaagaatacataaaaacctattaaaaaggcagaaaaaaggaattccctttctgcttatttttcacttctacctttgctaaatacaacttatccactttatgagataagatattgagttgaccctgtaggattccatctatcactctagctggttgacatctccaaaaatgcagcttacactattaatccattcacttcagcaaaacatgcctaagggcatcagattcttctgtttatcagtattgggttccttggccccaacaagctcagcagatacagctgaacagagtgatgtgtggtggcttcaactcttgagtctggggcttctaacggcaaaagtgacagacatagaggctcatgcaggtgtcagatgttttcctgtaaagaggttggcaatggacgtaaatgcttccagctgggcacattaccaggcaggataagccataatgatttaataatgaaatcacattggtttatgatcattgttcttattaggaaatatcattgctttttgatgatttattatgtgaaactgagttttcatataaacactgtgatttgcatttatttgtaatatatatttgcatatgtatatatatctgagtgagaatgacttactaaaagtaatcaccaaaaaaagaggatggaatattgatgtaaatatgccacaaatatttaaggaaatgtagaaattatgaagattattatgatgttgccacttcaaaataatattagatgcattttcctttatgtgaaactgacagagaactagtagctggatccatctctgttttgcaattaggcttttgcacctaatcacaaactacgatattattaataaaatataaagaatatatataagggttatatagaaccaccatttcccttctaaattaaggacttgctttcctgtcctcatttctcctcatgtgttctgacatggaggagagagagaaaaaaaaaagttaagaagagggaggaagaacattttgacttatgaaagagctttcagtctcatggggcctggaacagttgctctggagcagtgaaggacactacagaaggcttctctctctctttttggttatgattctttgctctatcagctgtgatgacttgtaagtacagttcctaggatcaacccagggtgcaaaatttagtggtgagttgcaagggcaaagcaaagcatgtctcccactcatctgcactcaatgtcaggtacataatttgggaagcccagtgcaaaataaaaatgtggggtctcttgttccaaaagcaggaaaaaatgccattgagggggctaaaatataaagccttgccctatctttcatgggctttctctttcaacttgtcatggtattgttttatttgctattcagtgctactataagaaaaattaaagacgtaagtcattagcctgagtgttacttttcatctcaatattgtgcaatgtcagttttaaatgcaaacataagagcatttaacttggatgtggaatcaccaaaattacatagtttgtattttgtagcttgtatgtgcgtatgtattttgttcttaccagcatggaggaaatgctgaacaaaactcaactgtttttattttacttcttaatacatgtacattctaccaatactctctacctttggtttactgatgaataaagaaggactaaaaggaaaagaatctataggttattgtataagtctgttctcacactgctaataaagacatacctgagactgggtaatttataaaggtaagaggtttaatggacttacagttccacatggctgaggaggcctcacaattatcgtggaagataaaagaggagcaaagtcatgttttacatggcggcaggcaagagagcttgtacaggggaactcccctttataaaaccattggatctcatgagacttattcactaccatgagaacagtatgggggaaaccgcgcccatgattcaattatctccacctggccccacccttgacacatggggactattacaattcaaggtgagatttgagtggggacacagccaaaccatataattcaccctttctctgtccttttctgtcatcgttttcagtgtaggtgtttggccaatacagggaagtaacaggtataagaaaggttatgacaggattccttggtcattcatgtttcttagaatgccactaccttcttttggtggttgaagcaaattctggtttgaatggaaagtatggcctcttagggctatcagagcttactcagttctagatgtatcgtatttaccttgtatttgtttggcatctcgctgaactcccatgcactatgggcctgatggagtcctgtgctcctggggcattgtgaatgctgtgtgtaaatggggctcctaggaacaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccaatagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcactgaatcaatctctctatatctcttaacattttttccttctcataggatttccagcaggagagctccagaagcctttcttttggggaacagaatatcctcggtgagtaaatgagtacagaaaccagttactgaccaattaggaagaacatgttgctttggtagaggacagaagaaacaaagtcaaaggttattcagcagaaagaagccatggaatctggcgtgggtcgcctgtactcttatcattttaggtatttgttttctgatccttgttaccagggtgtatggctggacaggaaagccatcttacacataggtggctttcatttttatgcatttattctcttacccattaactcatactaccagtatttggacattgaaggattgttgggatttgaattgatgggatgagtctaaaaccattccaggtagaagaaacagtgtgagataaggagggaaaagtgcttctataatggcagagtctagtttggctagcccaaatggtatatgaaaggaagtagtggaaaagaagattgaggtttgatattggagggctctgcatggcaaataaggagcttggatactaataggcaatagaaaatattgaactttttgagcaagttagtaagataatcgaatttatctttagaaatataacctgtgtagctacagaataagtcaaaattggtagtgtatggacttagggataccagtttaaaggtcattttaataccaacagattgtagactcatgtaattcagaatttccatacatagtagagattctgataatatttgatgtcaataatatcaccatttctattatatactttttacttttgtgttttaatgcttggaaaattttagtcttgattctatacattgagtctcttgtgttttggtttggatatatgacaatttaaaaatatgtaggtttaaaagatacagattcccataaatatatcaataagagaaatatgttggcaatgttttcatttggcctttgggctttcccggtagcagaccttgtggtaagtattcaagtgcaattagttctttcgggaggtggtacaaggaaacaccagtaggggagtggagaattgagacagtgagggaaataagccaaatgaattatgtcctgtgagtcttttatggctgccaaaatgaattactacaaacttagtggcttaaaatgacataaacttataagcttatagttctgtaggtcagaagtccaaactggttctcactgggctaaaatcaagttgtcagcagggctactttcctttctggaagctctagagatgaatctgttttcttgccttttctagtttctagagggggcccacattccttggcttatgacctcttcctccatctttaaagttccatagtcacatctccttctgactctcatcttctgtctctcccttctacttataaggacccttgtgattacactggtaccattcagataattcaggataatcttcctgttttaagttcaactgattagcaaccttaattccgtctgcagcccctttactgtgtaacataacatattcacaggttccaaagattagcaatatggacatcttttgtaggccattattccacctaccacatgtgtgttacaaagccagttatcaccatgggcaactggagctcagtcttgctggggaactgtaaaacatgcttcagagtgatcccatctcagggacatgggagctggggtatttatctgtcctccaactcaccttccatcattgattgagggctcctaccaggggtacctggcagtgcccatcctaggccaagagggctctagtggctggagaaagtcttcaggcaactagtttcaggtgctgacatttgaaggctgtcagattggtgtgctcaaaaatagtgagggctacgaggacgtgggcagccatcgataaagcttactacagggaagcaccatcgttagagtaaataaaaattgcaggttcttatttaaccaaatccattaataatatcccaggcctcagctccatagttttctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttattgatgaagtaatttgtttattgggtctgtgagcatgttagtgtctatttgtttgtaccttaggctaggtcacagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgctcacagtggtcagcttagtcctcacctgagtgttgagtctaattatggggcatgaacaagctgaattgtttccagaagagagaatcaggactgtaaatggttgaagacaacgtttcccaaagtgtgtgttccatgaaatagtaatagaggtaagacatcctcccctcccttcagttttggggaatcataataattatcaccataaaaatttcctagaagctctccaagaaagaaacctatttagatgtgtttaacacaactaccttttttgtacccattaaccatccccacttctgaccccagccccccaccacccttcccaggctctggtaaccatccttcgaaatgcagaggttcccaaactccccggtgttttgggaaatgctgatctagaattcatgactgaagaataagagttgaaagaacttaataacacttgaagtggaacctcataactgtctgcatatttttgaaggaaagttaaggtggtagaacgacttattatattcaggagattcagcaagtgttcagttagaggctacactagaccaatagatgggagccatagaaaagacatttcagatcagcattatggagagctattacgtttagacccgcccaaagaggaaatgggttaccttagaaggggatgagctcttggtcattggaaatacccaagcagggtattataaccatttgaatgggtttttctagagggggcccattcctctagtaggaagttggagtagatgacctctaagccatttccaactcagaaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttatttatttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtgagccaccacgcctggccaatgacatgctaatttaaatactcttcattgataaaatagaggacatgaatctaatattatgaaatattattattgtcaggcttagtcatataaaattactttttctttgtctcttgtccaaaggattgtgattaagtaactgagaattgaaacttaaaatgattcaatcattttctgaattctctattgccttttgcaaataggaagcttgttggagcagccctgcttaaaggacatttattgcacagcaatttctataagctcccattgttcatgccttcaattcatccagtcaacagcattgactgagggatgtagaggaccaagtacttattctcagagctgagagacctggaaaaactaaatgttgcaatctgcacactgatagctactgccgcaaaaattaacactatgtaaaattacaaatttgtcccacactgctatgatagctctatgattgaaatgaataatttcactcttacttctttaatgaaggtttgcaatgatggaaaaacagtaggaagcattttttcaaatgcaaattaccttacaggaaagaaataacaaaggaaagcattgccaccaaggggaaaaattaaatcttacaccacttccttgggtgtagttgagacaaacagttagcatggtaaggatcatttatgtcctgtaataacatattactttaaaaatttccattccttccagttatgggtcctatctatttgctgggtgactttgatgttgcatgtcaggaactaactgtgagatatttttagcataattgcaaatctcatgaagaatcttcacaataaggattctaagtggtgtgtaattctcatccacaggttgaatgactaaattaagatacatacagatctgtcacttgcatgagatggtaaagttaactaatcagttaaatcattgttactttcttacgctgtacaaggcatagaggatgtagcaatgaacaagtagataagagagtggcctcaatagaacttacatttgagagagaaaatcccagacatacatatggaaaccccattattgatttcttcatatattcttaatatgctttgctatgtaacaaagcaccaccaagcaaccatttattagctcatgattctgtaatttgggcaggactgagctgagacagctgctctgtatggtgctggccggggtcgctcaactagggctggactcacagacaggtgagtgaaggcgacctcactcacctgtctgtgccccagttgggctggctctcgtggctggggcatggcagggcctctctctcttcctttggagtctctcaacttctggggtttctcgcttcttcatttggcctcattccctctagctgtgtagttgaacttctttgcaagtgacttccaagaaggtggaaaatggaagctactaagtttcttaaggcctagacccagaagtcatacctgaccccttccactgcattctgttggtcatagcaagtcccaaggccagtccaaatttaagaagagggaaatagattgtctcttgatgggaggaggggctatgtgcattcaggggtagggagaattgttggtgtccccttttatagataatctaccacatgcttcttcagaggtgaagagaaataatgtggcacctttttcaaatctttgctattcagttgctatcttgtctacaacagaaagaggaacgtgactacctttgaaaatagagtgatcccttttaatctctactctattcctttttttatgactacatttggaaaacaatttaacttctaagactatagtgacttttcaacaagtttccagataaaatatacatgatatatttactgacaggatcttttcaagccctgttctaggtgttcataaatatatagctatagcagataaaaaaatcatagcaatcttaaggctgaaagggactttagaaatcatctctttcacatccctaatttcagagagtagggcactaaggttcatatgtggtaataatgacaatgtttgttagaatttatattttctttgtctatttcaattggaaggtatgtttagattttttacagctttatgggtatggttattcgattgttattaccatggttactagaaagcagtttatcttggctttccattgaaaaaattaaaggattatgctctgagattcatgcttgtaattgtctccaaattatgtattaatgccatagatctctgagttatggtgctataggagtaattgtcggacatgaatttacacatggatttgataataatggtaagtaccggttcattttataagctgctgcttttataataatgttgactatatggatgttaattgttatgattatctttgcatagcagcagcatcatagcttgaagattatccaaagcaatatgattgctgattgaaaacttttcaccgtgtcttgctgtgatggcttgcaataagtaaacaattgttcccattggtgatcggggtagactttaaaaggcagccttgtaatttcaataaaattagctttgcatttagatcaggattgctgtagctgccacaatagttacagagattgatttatagcttctccctttgtcatttattcattgtcttgagatattctccctggaggagcaagctctgctccaacgatgattatacatgctgccaagttaggactcgttgagttaggactctggagcttggctgactggttcccttttacgatttcgaagattatgcaatgcttaatctatatttttctctatactggcttatattctgattattattattattattatcattattgagacggagtctagctctgtcgccaggctggagtgcagtggcacgatctcggctcactgcaacctcggcctcccgtgttcaagtgattctcctgcctcagcctcccgagtagctgggattacgggcacgtgccactatgcccagctaatttttgtatttttaatagagacggggtttcaccacattagccaggatggtctcgatctcctgacctcgtgatctgcccacctcagcttcccaaagtgctgggattacaggcatgagctaccgcgcctggcctattctgattattttaaagtctatactttcctgataatttatataataggatatgctttgtatcccgatgacatttaagcaaaaagaaaaagcagaatatgacataaactaaagaaatggcttcctttgagagtcctcatcatcattaatcagcactcttttctcctttaactttggagtattatcggaaggccacatgaaatctctgaaacttacggattagtagcaaattactatcacatccatacccacacagtgatttacaggcagtctcaggaaccagctgccctaaggcaacgttatatagaaggggacctctttcttccatccctgtagtatctccaacatccttcctggatgcctaccccagggccagagacacttaggctcttctagaaaagtcttcctgtactcccaccagcccttccttaatcacctagattttttgctcccctggtcttcccttctctgttaaaatgtggctgacttgtagttataaatgtggctgacttgtagttatctgactctgcagagctagactttctgcctttgggtgtttggtttatctgagatgagagtcttagctaagaaaaaaaaaagctaatagtcctttcttcgttctggacctctcttgataggaaatttaagtacagttcctccccagaaccttctggagtctttctcaaaggactgaatctaatggtggcaatttcactctgtaaccaatgcttagaacagtgcattgcacatataagtacatgcccggtacctatttaatgattggttggttagtgggtagaggacagtgactccatactatcccagggggtggtgttagtagtatgtagccttgctgaagagttttggattgttccaattaacaactttacttacgggacttttttgtaagctctctgtataattaaatttaaacgatgcctctgattctcatagtaaccctgaatatagaagacagtctagcagcatccaaattttgtttcaaaggctgtagagaaaatgaagagtgagcacatagcaagaaagcatgtgtaatctttcttcccattgtgttttggagattttcattcttattccaagttttctttttagagcaatcttccctgtctaagcaggacagatgggccttccgtccacactagtggctgtggaatgaatcataacagaggttttatgtgtctttcagctcctggcaacttggaggaaacaggttcctatagggctgagtcagggtctatgatcgcacagtatggatgactcactggggctattcctatggatcatttggaatttcactggtagtaatgctctgattgcctccatgggctttctgaatgaagccattttatttcataatccagtgaacactttgggtcaaatcaggtgaagacacagaatccaagattgaataagactagtatatgtaataaattgatgaatctcatttttaaggtgctctttgttccttagaaggaaagaacttcctcaattgtctttatcctttttgccctttttacaattaacctgtgacattggagagaatgcaggagctgatctcaggaagagtgttccctgctgttatgactgctttttgaaggcttgtcgaggtgagggaaaggaaagatgaatttagtttccataaataacacaaatgtcttcgaacttttccttttgctaggtagaaaatatgataaaaatggaaacctggatccttggtggtctactgaatcagaagaaaagtttaaggaaaaaacaaaatgcatgattaaccagtatagcaactattattggaagaaagctggcttaaatgtgagtacaactgtggctaaggggggcaccttgtggttcatttttcctcatttggacattagcttgctttaaaccattggttctcaaagcgtgtttacaagatcaacagcatctgtcttccttgggaacattcttgagtcctaccccatacctgctgaatcagaatctttggggttggggcctggtcatcccttaaccaggcatgaactttttcctgatatattactagggctggaaaaatacctaaatccttgctatgcctcaaatctattatacttgtagatgaatttaggtaaaaatccacgtgcttcttttaaagggaatgtttataaacactgacttggttctcctggttcttaaaccatgctcagcccaagtgagaccactgctcattcaggcagagaaaccagagtctgtatccttgaatggtgtctagctcttttatcagtgtcctggacagccatttctctgcctatatatttttaaatatctacaactgtgacatgagaagacctaaaatgggtgcttctatgtatctctatatagtgcaggggttttcacactgtgaaaattcatctggagtatatgttgcttcaagaaaagcatagcagaaaggggttctagagtcagacatgggtccaaatctaggttcaactagttttatgaacttgggcaagttacttaatgttcctgagtctcagcatcttcatctgtgaaacgggtcaatgtttctgaactcatggatttgttgtaagaattaagtgagcaaagcaatgtggagcactagcacaaggcctgacataaagcaagtgctcaataaaagatcgttagttaatattcctgatccttcgtgacatactcattagtaccctatcccaggaaaaaacaaagccaaagatttttgggttaaaaaccccccaaaaaacaatagaacagctttcttggaggaagggaatttatatttcctgatgattagtatatacaggcatgaagatgaaacttttcacttaattgaaacaaatgtatccccatactagtcctgagaggtatagattattactaagtgtacaggttttacgtatgaggttcaaaggaattaaactgaggttcaaagagattaaaatccacggtagagtctagattagagtttaagtaagtctgtacgactccaaagtccatactgcttcccctatatcatgctgaggttcttattttaagttcattttatatctgggtgatgtgtgggtggactgctcttcaccattcattttggccaaagtgtcagagattgaaacttaattctgacaaatgtgtacctttgtcacaaggacgatagaaagggcatgcctgtcttagcaccaatccacttaaccatcagaaaacagcttcagtttcattcccacaggagagtgggtggcttcctttgtggatataagggccatgctttattatttttctggcttcatttataggagccgttcctttgtgcctgaatcttgctttgtagtgacttcgggggagctcagatggggcactacagatgcagactgtcagcagctgttgagtctttttttgttgttgttccttttcgtagctgttgagtcttgggagtccaaacctagggccacgtggtctactgaggcagaccagagttcaaggagccagaggggtgaggctgctccaaaaggctctaaattagatataaagcttagagtgaatggctgggcatggtgactcatgcctgtattctaaacactttggaaggccaaggtgggaggatcacttgaacctaggattttgataccagcctgggaaacatacggagaccctgtctctacagaaaattttttaaaaaattagccgggtgtagtggtgcatgcctgtagtcccagctactcaggaggctgaggtggaagaattgtttgttgaaaccctatagtgagatatgatcacaccactgcactccagtgtgggtgaaagagagagaccctgtctcaaaacacacaaacacacacgaaaccctcagagtaaaaaggaaggagattaaattttttaagcaggagtggatataatcataatcttcaagagccaagaggagttgggacttgagaaagtagcatattaggaagcaaaggctctggagacagaagactgcttgggttcgaatcccagtgacatgcgagcagtttacttcatcactctgtcttaggttcactagaagcagagcccaagaaggggttccttaggtcattgacttttttgagacagcgtctcgctgagtcacccaggctggagtgcggtggtgtgatctcggctcactacaacctctgcctccctggttcaagtgattctcctgcctcagcctccccagtagctgcgattacaggtgccagccaccacgcctggctgatttttgtatttttaatagatacggggtttcttcatgttggccagtctggtctcaaacccctgacctcaggcaatctgcccgccccagcctcccgaagtgctgggattacaggtgtgagccaccgcacccagcccaggtcagtgatttattcagaaagtcgtttcaggaaaaacctataatggaatgagggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgttagcagttgtgggaatgggtgcacagtttaggcagaaaaggggatctggtgggatatcgacatctgctacactctcggagctttagatcctcatttgttgagcaagggtggtggtaattagcacttacttacctcatacgactgtggataacaaagaatatacgtaaagcaggaatggtagcttttgtgtactgaagctaggagggtcctgagtgattacagtgaataatattttccaaagatttgtttttattcattgatattgcttgatacctgggtgactgggctagcttaaaagtaaagtgttggtaagatccatggcttgaaagttaaaagcaaggtatattagttttctgttgcttgctataacaagttactataaacttagtagcttcaaataacataaattatcatacagcgctgtatgatttattatcatacagcgctgtatgtcagaagtctgacatggatctcagtggactaaaatcaaagtgtcagcagggccacattcctttgtagaggttctaggggagtatctgtttcctcgccttttctagcttttagaggctgcccacattccttagctcatggccccttcgtttttcaaagccagcactggccggtggagtcttctcatgttgcatcactctgacactcgctctcctgcctcccttttcctcttgtaagaacttttgtaattacactgggtccacctggacaatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccactgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataattttttttaccatgctggctggttgtcatacatatcgcagacctcgaccttgtgatctgcactacttctgtttgatttttcttccctaggagaaccactttccttttaattttccatggaaattgctgaaggtaaaatgatgatagttggtcttgaaatcttgttcctgtgtggatggtaaatttttggaaacacaggcacaatgagaagaatactcaaattatgtgagttaatcagagaaagtaacctgtgtattgacattcctgttttttcccattaaaccagagtcactcagaatattgttaacattttattggagctggctagattggttagaatgaagaggtaggtgagaaagaagtgtgtagcataatgaaatagaaagtattacattccagagcaccttgctgaggatagtttgccatctttcttacaatatattatgcctacctctgatttattgaatgtgattttctctttaaaatatgatacttttcttgctataatattgatgcctcttgctgaatgatagttgaccgtgaaacacgcattcattttttttttccttttttctttctgttaggtcaaggggaagaggaccctgggagaaaatattgctgataatggaggcctgcgggaagcttttagggtatgcgctgctacatttaccgtggttctaaaaatcaagccataaaacaccatatgggggtacctcaattcataccatagccatgttcttgaggagttagttagttagatattatggaatttctgtaaatagaagtgtgtctccccattgaccctattacataaagagaactatatttcttttttctttttggggtgtgaagtcaccctaaagaataatatttgttattaagaatcatgtatttaaagaatagcttttagaaaatacattcaccatcagatcgaagcatgctacagcaatctccttggggctaggttcatttgttttccttgagtacaggtctttctgtagtcctcctataaatttctcttaaaatatcaaacttctaaattatgaccagagggtagtggttctcatatactgggccaagtgatagttcataataacgttttcatcatccactagtttgtggtcaaataagaagcataaagataatacagaaagatttcataaagctaaatgcattaaatttaatgactagactgttattcctggttatatccttcctatattctagttgaaatatactttattttataaaatgagggcactagaagatgataggttttctcttacgtgtcaaaatgaaaaaaggtaatatgcggaccccaaaatgtattgccataggggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgctattcctgtgctagctgagcaaagagaaaaacccaccgttgcagagactcatctcttcttcttctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatgcaggacttgagtttgctcccttgatcaaagaaagatttcaaacaaaagtttaatggcatgactttgattttcagcaaaaatgttatcttgattattttcagggtaaatctcatcttcttaatgttctgtagtacataattaattaactgattgaatcaaggtttattagtattttttaaatcaaatgggttagcagccctgtggtaattcatttgatagttcctcaatgtatcttgacttcttaatgtgtttgatactatttatttgtaaccatttctagtaacttgctctttggctttcatgggcctgctctttcctatattgctcctcctttgcctcatttgctgactttatgccaccactctcagcctgtgggggaccctcagggtcatgttcccaactgtctaatgcatatgcagagacccctagagctgaaaaagaacaaaggcaaggagagtcatgtcactcttttgtgagtttaataggctcttggagcagaaattgaaaggaagatgtacacgaaataaagcacagttccgagcctgagtctctgtctaatgaggcaagtgccaaatctttattagctattatactggtttatgtcataaacatacgggcagccttttcaaagaagtcagggataggtcaataaaggttctagtgaatggcctcaccgtgggcaaatgtgtatgaatatgctcaaagctagacaaaaattttcatcagtacaaccttttgttcctaagtctgtctttgctttcactgctaagtaagctcattctcacacgagtcttctataattcactctggtcacaggattcttgcttgcctgcggtcttttatttcttaaagctaataaaaaacactaaataaattattatttagcaacctaatgtcaacaaaactcaactctagtcatccacaacatgactttccttttacttttcctgtttctatcatcacatcccatctttagattttcctggttagaaagcctggattcttaggtcttatttgatgcatctgtcctcaattttacaacatgtattccagaagccagatgtttcatactttactttactttaaaaaaaaattatactttaagttctggggtacacgtgcagaacgtgcagttttgttacataggtatacatgtgccatggtagtttgctgcacccatcaacccgtcacctacattaggtatttttcctaatgctatagctcttctagcccccaaccaaccctctgacaggccctggtgtgtgatgttcccctctctgtgtctatgtgttttcattgttcgactcccactcatgagtgagaacatgcggggtttggttttctgttcttgtgatagtttgctgagaatgacggtttccagattcatccatgtccctgcaaagaacatgagctcatccttttttatggctacacagtatgccatggtgtatatgtgccacattttctttatccagtctagtctatcactgatggacatttgggttggtgccaagtctttgccattgtgaatagtgccacaataaacataagtgtgcatggcatctttctttatagtagcatggtttataatcctttgggtatatacccagtaatgggatggctgggtcaaatggcatttctggttctagatccttgaggaatcgccacactgtcttccacaatggttgaactaatttacactcccaccaacagtgtaaaagtgctcctatttctctacatcctctacagcatctgttgtttcctgactttttaatgatcaccattctaacaggcatgagatggtatctcatagtggttttgatttgcatttctctaatgaccagtgatgataatgagcatttttcatatgtttgttggctgcataaatgtcttcttttgagaaatgtctgttcgtagcctttgcccactttttgatgaggttgtttttttcttgtaaatttgtataagttctttgtagattctcgatactagccctttgtcaaatggatagattgcaaaaattttctcccattctttaggatgcctcttcactctggtggtagtttctttggctgtgcagaagctctttagtttaattagattccatttgtcaattttggcttttgttgccattgcttttggtgttttggacatgaagtctttgcccatgcctatgttctgaatggtattgcccaggttttcttctaggatttttatggctttaggtcttaagtttgtttatgtctttaatctatcttgagttaatttttgtataaggtgtaaggaagggatccagtttgttttctgcatatggctagccagttttcccaacatcatttattaaatagggaatcctttccccattgcttgtttttggcaggtttgtcaaagatcagatggttgtagatgtgtggtgttatttctgagggctctgttctgttccattggtctatatatctgttttggtaccagcaccatgctgttttggatactgcagtcttgtagtaaagtttaaagtcaggtagtgtgatgcctccagctttgttctttttgcttaggattgtcttggctatatgggctctttttttttttttttttttttttttttttttttggttccatatgaagtttaaagtagttttttccattctgtgaagaaagaaagtcaatggtagcttgatggggatagcaatgaatctctctctaaattactttgggcagtatggccattttcacgatattgattcttcctatccatgagcatggaatgtttttccattggtttgtgttctctcttatttccttgagcagtggtttgtagttatccttgaagaggtcctttacatcccttgtaagttgtattcctaggtggtttattctcttagtggcaattgtgaatgggagttgactcatgatttggctctctgtttgtctgtgattggtgtataggaatgcttgtgatttttgcccatcgattttgtatcctgagactttgccgaagctgcttatcagcttaaggagattttgggctgagacgatggggttttcttaatatacaatcatgtcatctgcaaacagagacagtttgacttcctcttttcctatttcaataccctttatttctttctcttgcctgactgccctggccagaacttccaatactatgttgaataggagtggtgagagagggcatccttgtctggtgctggtttccaaagggaatgcttccagtttttgcccattcagtatgatattagctgtgggtttgtcataaatagctcttccaattttgagatacgtgccatcaatacctagtttactgagagtttttagcatcaagggtgttgaattttgtcaaaggccttttctgcatctattgagataatcatgtggtttttgtcattggttctgtttatgtttattgatttgcatatgttaaaacagccttgcatcccatgtatgaagccgacttgatcatgtgatggataagctttttgatgtgctgctggatttggtttgcaagtattttatcgggtattttcgcatagatgttcatcagggatattggcctgaaagttttctttttttttgttgtgtctctgccaggttttggtatcaggatcatgctggcctcataaaatgagttagggaggattccctcttcttctgtggtttggaatagcttcagaaggaatggtaccagctcctctttgtacctctggtagaattcggctgtgaatctgtctggtcctcaactttttttggttggtaggctatcaattgctgcctcaatttcagaacttgttattggtctattcagggattcaacttctacctggtttagtcttgggagggtgtatgcgtccaggaatttatccatttcttctagattttctagtttatttgcatagaggtgtttatagtattctctgatggtagtttgaatttctgtgggattcttggtgatatcccctttatcattttttattgcgactatttgattcttctctcccttattagtctttcttgctagtggtctatctgtgttgttgatcttttcaaaaaaccagctcctggattcattgattttttgaagggttttttgtgtctctatctccttcagttctgctctgatgttagttatttcctgttttctgctagcttttgaatttgtttgctcttgcttctctggttcttttcattgtgatgttagggtgtcaattttagatctttcctgctttctcttgtgtgcatttagtgctataaatttctctctacacactgatttaaatgtgtcccagagattctggtacattgtgtctttgttctcactggtttcaaagaacatctttatttctgccttcattttgttatgtacccagtagtcattcaggagcaggttgttcagtttccatgtagctgtgtggttttgagtgagtttcttaatcctgagttctaatttgattgcactgaggtctgagagactgtttgttatgattttctttctttcttttgcatttgctgagaagtgttttacttccaattatgtgatcaattttacaataagagcgatgaggtgctgagaatatatattctattgatttggggtggagagttctgtagatgcctattaggtccacttggtccagagctgagttcaagttctggatatccttgttaattaattttctgtccatttatctaatattgacagtggggcgtaaagtctcccacgattattgtgtcggagtctaagtctctttgtaggtctctaaggacttgcttgatgaatctgggtgttcctgtatagggtgcatatatatttaggatagttagctcttcttgttgcattgacccctttacgattatgtaatgctcttctttgtctcttttgatctttgttcatttaaagtctgttttatcagagattaggattgccacttctgcttttttttttttttttttttttttttttttgctttccatttgcttggtaaatattcctccatccctttatttattttgagcctatgtgtgtctttctttgcatgtgagatgggtttcctgaatacagcacattgatagttcttgactctatccaatttgccagtctgtgtcttttaattggggcatttagcccatttacatttaaggttaatattgttacgtgtgaatttgatcccgtcattatgctgctacctggatattttacccattagttgatgcagtttcttcatagtgttgatggtctttctttacaatttggtgtttttcagtggctggtgccagttgttcctttctgtgttcagtgcttctttgaggagctcttgtaaggaaggcctggtggtgacaaaatctctcagcctttgcttgtctgtaaaggattttatttctcctttgcttatgaagcttagtttggctggatatgaaattgtgggttgaaaattcttttcttttctttgagattgttgaatattggccctcactctctcctggcttgtagagtttgtgctgagagagatccactgtttgttagcctgatgggcatccctttgtgggtaacccgacctttctctctggctccccttaactttttttcctccatttcaaccttggtgaatctgacgattatgtgtcttggggttgctcttctcgaggagtatcttagtggtgttttctgtatttcctgaatttgactgtgggcctgtcttgctagggaggggaagttctcctggataatatcctgaagagtgttttccaacttggttccattctccccgtcactttcaggtacaccaatcaaacgtagatttggtcttttcacatagtcccatatttcttggaggctttgttcatttcatttcactccttcttctctaatcttgtcttctcgctttatttcactgagttgatcttcaatctctgatatcctttcttccgcttgatcaattcggctattgatacttgtgtatgcttcacaaagttctcatgctgtgttttttagctccatcaggtcatttgtgttctcctctaaactggttattctagctagcaattcatctaacctgttttcaaggttcttagcttccttgcattgggttagaacaatgctcctttagctcggagaagtttgttatcacccaccttctgaagcctacttctgtcaattcgtcaaaatcattctccgtccagttttgttcccttgctggcgaggtgttgtgatcctttggaggagaggaggtattttggtttttgtaacttttagcctctttgtgctggtttctccccatctttgtggatttatctacctttggtctttgatgttggtgaccttcggatggggtattttagtagacgtgctgttcctttctgtttgtttgttagttttccttcttacaaacaggctcctctgctgcaggtctgctggaggtgcactccagactctgtttacctgggtatcaccagcagaggctgcagaacagcaaaaattgctgcctgttcttccctccggaagctttgccccagaggggcacctgccagatgccagccagagctctcctgtatgagatgtttgtcggcccctaccgggaggtgtctcccagtcaggatacacgggggtcaggtacccacttgaggaggcagtctgacccttagcagagctcgaccactgcgctggctgtcaggcagggacgtttaagtctgctgaagctgtgcccacagctgccccttcccccaagtgctctgtcctagggagatgggagttttatctataattccctgactggggctgttgccttttttttttagagatgccctgcccagagaggtgacatctggcagtctggccacagtggccgtgctgagctgtggtgggctcctcccagttcaaacttcctggtggctttgtttacactgtgagggtaaaaccacctactgaagcctcagcattggggaacgccccttccccccccaagctcaagtgtcccaggtcaatctcagactgctgctgtactggcagcgagaatttcaagccagtggatcttagcttgctgggctctgtgggggtaggacccgccaagccagaccacttggctccctggctttagaaccccttctgacgggagtgaacggttctgtcttgctggcgttcccagcaccagtggggtatcaaaaaaaaaaaaaaccacacacacacacacagaaaaacaacaacaatgaaacaacaaaaaactcttgcagctagttgggtgtctgcccaaatggccacccagttttgtgctggaaacccagagccctggtggggtaggcactggagggaatctggaatctcctcctgttctgcaggttgcgaagaccgtggggaaagtgcagtatctggactggagtgcacggttcctcaggctcagtccctcatggcttcccttgggtaggggagaaaattccccgaccccttgcacttcctgggtgaggtgacaccagaccctgcttcggcttgccctctgtggcctgcacccactgtccaaccagtcccaatgagatgaactgggtacctcagttggaaatgcagaaatcacccacttactttctgcattgatttggcattgatttcgctgggagctgcagtccagtgctgttcctatttggccatcttctagttcttctcgatgtttcatacttttaagtgcttttcagatttgacatcttctctcctgttttagacagtttgggctgctataacaaagtgtcatagactaggtggcttatgaacaacagaaatttatcacagttctggaggctggaagtctgcgatcagagtgctagtgggatcgagttttggtgagggctttcttctgggttgcacactgccaatttctctctgtgtcctcacatggtggaaagagctagctagctctctggcctcttcttataagggtactaatcccattcctgagggctccaccctcatgatttaattgcctcccaaaggcccaactcctaatgccatcacattgatcagggcttcaacataagaattttgggggatagaaacatttagtccatagcatccccattaccctatcttatcatatatagttagttatcatatataggcataatcttaataaatatcctctactctggattatcccaacagccttatggaatgttaatctgacttcagcatttttttttttaaccactgttatacataccattggaataccacttttatttcattaccaacctgctgaaagaactacagtggctcccaaatgcctaccacattgaagccaaatacctccatctggcttcccaaattttcagtatgatccaactccactcaatccaattcaatttcccataactaactccactgggtgagaaaaaactcagccttagtggggcaagtatcctcacttctaccctacaatgtcatgcccattactgtctctttggctttgcttctgattctccttctataatgcaacccttcctactcttccccttcagatgattattcaatctaagcttcatccttcaggatccatgttgagttccactccctccacatcttccataaactcttccccaaggaccccagtccttattattttcttttatcttcaactccttttatctttcttactttcattaccatgcagttgagtacttaactgctctccaaatgttcaagaattttagttttatctccacagctaatcttctggatccttacacttcctatctccatagcacccagcaaagatgctgggtatattgaagacagttgatatttttagatcaattgcttgaaatgactaaaactaacagttcaactaaggagactcccttttactgggtcagatatataaaataagtatacaaaaatagaactttctagagttgggattggcaaactagggccaaatatggcctgctgcctgtttttgtaaataatgttttattggaaagcagccacattccttcatttattcatgatctgtagctggttttgtactacagtggcagagttgaataattgaaacagggaccttatagtcttcaaagcctaaaatctttaccatctgtctcttttcagaaaaagtttgctaacccctgctctagaggacaaagtatagtgatctatcaatcagttcttactatttacatcctagcccacaatatctctttgtagataaaataaactaattgattgatagtgaagttacttataattctgaaatgtttccagatataataccaaactaaactatagctgactgatttattgtaaactaaagagatagatagatagatttaggggggaaaagtggaaagctattttatatcttatatcactagtgagaaatttatcttggagcttttcccactgacagaatgaagagatttttcagtcttttgcactttaaagtaagtctgcttataaggagtaaaattactttccctcctgggaaggtactaagaaaacagtagcaggcataatgtgttttcagaagtctcttaagtgatatattaagcaaagacaatactatattagagtataagaatataggaagaaataagaaatgaggtaaaatcaaatgccagaaacaacttcatattagccagcttctgaggaaatcaagggatcgcattacaaaacatcatcttcaaagtcaaattcagaaccactgtgactggtggtttatcttcatcaaaagcaacaacatcatatcacctttcctgctttctatgtccctgtagttgctgtgacctctcatttttctcagatattcttctaatccttctacttctttccattctattttctacttatttagtggacatccattgagaaccttcctggtatctataaataatctaactagcctctaatttcttccttccactatacacccctgccagataaatctttttcaaaatctgggttttattattttcctactcaagaatgacttttaaatatagtttaaacgctctgaccaactgctcaggacttcagaaatctgacactgtccttcctctcccactgctgcccgttaggcatcatatactccagcctagctgaatgtctggttctctttcccctcaaacatgtctttgttcccatttccccctccacttagaatatttttttccatatttatgtgtcctagttcaattcacacttgaagaccatatcatacctcaagtcatatggcaagtcaggattaaagtaagtaagttatgctgcagaaacaacacgacaaagtttatttcttgttcactctccatgtccaacatgagtcagcagtggggctcttgtagtttttcatcaagaagttgggttttgggccgggcatggcctgtaatcccagcactttgggaggccgaggcgggtggattgcctgaggtgaggagttagttagtttgagaccagcctggccaacatggcaaaaccccatctctactaaaaaaatacaaaaattaggcaagatggcttaataggaacagctctggtctgcagctcccagcaggattgacacagaaggcgggtgatttctgcatttccaactgaggtacccggttcatctcactgggactggttggacagtgggtgcagcccacggagggtgagccaaagcagggtgggacgtcacttcacccgggaagcacaaggggttgggggatttcctgttcctagccaagggaagccatgagagactttaccaggaggaacagtgcactccagcccagctactgcgcatttcccacagtcttcgcaactggcagaccaggagattccttacagtaccgggctcggtgcatcccacccccatggagcccagcaagctgagatccactggcttgaaattgtcactgctagcacagcagtctgaagttgacctgggatgcttaagcttggagttgggaggggcatccgccattgctgaggcttgagtaggctgttttaccctcacagtgtaaacaaagccactgggaagtttgaactaggtagagcccacagcagttcagcaaggccactgtgaccagactgcctctctaggcagagcatctctgaaaagcagcagccccagtcagggaattataggtaaaacccccatctccctgggacagagcatctaggggaaggggcagctgtgggcacagcttcagcagacttaaacgtccctgcctgacagccagcacagcggtcgagctctgctaagggtcagactgcctcctcaagtgggtcccggacccccgtgtatcctggctgggagatacctcccagtaagggctgacaaacatctcatacaggagagctctcactagcatctggcaggtgcccctctgtggacaaagcttccagaggaaggaacaggcagcaatctttgctcttctgtgtagacttcactggtgatacctagccaaacagggtctggagaggacctccagcaaactccagcagacctacagcagaggagccctgagttagaaggaaaactgacaaacaaacagaaaggaatagtagcaacatcaacaaaaaggatgtccgatcagagaccatatccgaaggtcaccagcatcaaagaccaaaggtagataaatccacgaggatggggagaaaccagtgcaaaaaggctgaaaactccaaaacccagaacgcctcttctccttcaaaggatcacaactcctcgccagcaagggaacaaaactggacggagaaagaatgattttgatgaattgacagaagtaggcttcagaaggcgggtgacaacagactcctccgaggtaaaggagcatgttctaacccattgcaaggaagctaagaaccttgaaaacaggttagaggaactgctaactagaataaccagtttagaggagaacataaatgacttgatggagctgaaaaacacagcacgagaactttgtgaagcatacacaagtatcaatagccgaactgatcaagcggaagaaaggatatcagagattgaagatcaactcaatgaaataaagtgagaagacaagattagagaaaaaagagttaaaagaaatgaacaaagcctccaagaaatatgggactctgtgaaaagaccaaatctacatttgatgggtgtacctgaaagtgacggggagaatggaaccaagttggaaaacactcttcaggatattatccaggagaacgtccccaacctaacaaggcaggccaacattcaaattcaggaaatacagagaacaccgcaaaaatattcctcgaaaagagcaacccaagacatataatcatcagatttaccaaggttgaaatgaaggaaaaaaggttaaggggagccagagagaaaggtcgggttacccacaaagggatgcccatcagactaacaaaggatatttcggcagaaaccctacaagccagaagagagagggggcaagtattcaacaatttcaaagaaaagaattttcaacccacaatttcatatccagccaaactaagcttcataagcaaaggagaaataaaatcctttacagacaagcaaaggctgagagattttgtcaccaccaggcctgccttacaagagctccgcaaagaagcactgaacacagaaaggaacaactggtaccagccactgaaaaacaccaaattgtaaagaccatcaacactatgaagaaactgcatcaactaatgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaagggatggaggaagatctaccaagcaaatggaaagcaaaaaacaaaaacaaacaaaaaaaaaaacagaggttgcaatcctagtctctgataaaacagactttattccaacaaagatcaaaagagacaaagaagagcattacataatggtaaaggggtcaatgcagcatgaagagctaactatcctaaatatatatgcacccaatacaggagtacccagattcataaagcaagttctcagagacctacaaagagacttagattcccaaacagtaacagtgggagactttaacaccccactgtcaacactactgccaacactagacagattgagacaaaattaattaacaaggatatccagggcttgaactcagctctggaccaagtggacctaacaggcatctacagaactgtccatcccaaatcaaatcaacagaatatacattcttctcagcaccacatcacacttattccaaaattgaccacatagttggaggtaaaacacttctcagcaaatgcaaaagaatgaaaatcataacaaacagtctctcagaccacagtgcaaacaaattagaactcaggattaagaaactcactcaaaactccccaactacatggaaactgaacaacctgcacctgaatgactattaggtaaataacaaaatgaaggcagaaataaagatgttctttgaaactaacgagaacaaagacacaacgtacctgaatctctgggacacatttaaagcagtgtgtagaaagaaatttataacactaaatgcccacaagagaaagcaggaaagatctaaaattgacaccctaacatcacaattaaaagtactagagaagcaagagcaaacaaattcaaaagccagcagaaaacaagaaataactaagatcagagcagaacggaaggagatagagacatgaaaaacccttcaaaacatcaatggatccaggagctggcttttcaaaaagatcaacaaaatagaccactagccagactaataaagaataaaagagggaagaatgaaatagacgcaataaaaaatgataaaggcgacatcaccaccgatcccacagaaatacagtctaccatcagagaatactataaacacctctatgcaaataaactagaaaatctagaacaaatggataaattcctgggcacatacaccctcccaagactaaaccaggcagaagttgaatccctgaatagaccaataacaagttctgaaattgaggtagcaattaatagcctactaaccaaaaaaaagttgttgaggaccagacaggttcacagccgaattcgaccagaggtacaaagaggagctggcaccattccttctgaaactattccaaacaatagaaagagagggaacccttcctaactcattttatgaggccagcgtgatcctgataccaaaacctggcagagacacaacaaaaaaagagaattttagaccaatatccctgatgaacatcaaggcaaaaatcctcagtaagatattggcaaactgaatccagtggcacatcaaaaagcttatccaccacaaccaagttggcttcatacctgggatgcaaggctggttcaacatatgcaaatcaataaacataatccatcacatacacagaaccaatgacaaaaaccacacgattatttcaatagatgcagaaaaggcatttgacaaaattcaacaccccttgatgctaaaaactctcaataaactaggtatcgatggaacgtatctcaaaataataagagctatttatgacaaacccacagccaatatcatactgattgggcaaaaactggaagcattccctttgaaaaccagcacaagacaaggatgccctctctcaccactcctattcaacatagtgttggaagttctggccagggcaatcaggcaagagaaataaagggtattcaaataggaagaaaggaagtcagattgtctctgtttgcagatgacatgatggattgtatattaagaaaaccccatcgtctcagcccaaaatctccttaagctgataagcaacttcagcaaagtctcaggatacaaaatcaatgtgcaaaaatcccaagcattcctatacaccaataacagacaaacagagagccaaatcatgagtcaactcccattcacaattgccactaagagaataaaatacctaggaatacaacttacaagggatgtgaaggacctcttcaaggagaactacaaaccactgctcaacaaaataaaaagaggacacaaacaaatggaagaacattccatgctcatggataggaagaatcaatatcgtgaaaatggccatactgctcaaggtaatctatagattcaatgccaaccccatcaagctaccaatgactttcttcacagaattggaaaaaacttactttaaacttcatatggaaccaaaaaggagcccatataaccaagacagtcctgggcaagaagaacaaagctggaggcatcacactacctgactttaaactttactgcaaggctgcggtaaccaaaacagcatggtactggtaccaaaacagatatgtagaccagtggaatagaacagagccctcagaaataacaccacacatctaccaccatctgatctttgacaaacctgacaaaaacaagaaatggggaaaagattctgtatttaataaatggtgttgggaaaactggctcgccatatgcagaaaactgaacctggaccccttccttacaccttaaacaaaaaatcaactcaagatggaccaaagacttaaatgtaagacctaggaccataaaaatcctagaagaaaacctgggcaataccattcaggacataggcatgggcaaggactttatgtctaaaacaccaaaatcgatggcaacaaaagccaaaattgacaaatggaatctaattaagctaaagagcttctgcacagcaaaagaaactatcatcagagtgaacaggcaacctagaggatgggagaaactttttgcaatctacccatctgacaaagggctaatatccagaatctacaaaggacttacacaaatttacaagaaaaaaacaaccccatgaaaaagtgagtgaagggtatgaacagacacttcttaaaagaagacatttatgcagccaacaaacatatgaaaaatgctcattttcactggtcattagagaaatgcaaatcaatcaaaaccactatgagataccatctcatgccagtgagaatggcgatcattggaaagccaggaaacaacagatgctggagagaatgtggagaaataggaacgcttttacattgttggtgggagcgtaaactagttcaaccattgtggaagacagtgtggcgattcctcaaggatctagaaccagaaataccatttgacccagcaatcccattactgggtatataccgaaataattttaaatcactctactataaagacaccatgcatacgtatgtttattgcggcactgttcacaatagcaaagactgggaaccaacccaaatgcccatcagtgatggactggataaagaaaatgtggcacatatacaccatggaatactatgcagccataaaaaagaatgagctcatgttctttgcagggacatggatgaagctggaagctatcattctcagcaaactaacacaggaacagaaaaccaaacaccacatgttctcactcataaatgggagttgaacaatgagaacacatggacacagggaggggaacatcacacaccagggcctgtccagggggtcgggggctaagggagggatagcattaggagaaatgcctaatgtagatgacgggttgacgggtccagtaaaccatcatggcacatgtatacctatgtaagaagcttccacgttctgcacatgtaccccagaatttaaagtataataaaaaaaaaaatacaaaaattagctgggcgtggcggtgtgcacctgtaatcccaggtacttgggaggctgaggcaggagaatcgcttgaacccaggaggtggaggttgcagtgagccaagattgcgccattgcactccagcctgggtgacggagcgagactccatgtcaaaccaaacaaacaaacaaaaaacttgggttttagagtctatatcttggcatgtgcttctgtggataccacaggagtagaaaagacatacgaggatatgtgcactggccgttagtgtagcatcttaaattgttcttaaggctcttaaaacttctgtcaggttttaaagcttctgccaggaagtaacatatattacttctgcttctgctcacacttcattggccagaacaagccatatcgccatgcccaacttcaaaggagatggagaagtgtacttcagtcctaggcccagactagggtgaagcgagcaaggcactcaggggcagactactaacttctcatcaccatcctcaataatgggtggctgactcattttattgatttgaatgagtatggttaaatttgagaaggactatttcaaacattaaattcattgaatgaatacactggtcgattcctgggcacatatacgattctcttgatttaaagcacttgtctggaaacctttctcacttactcaaattgtgaaattattcacattgataaaaccttctactctggggatcagaataatagatgttattacagatgacggttttatttgatcttctaaaactgtttgtcatccattggttctaaaattgttcctcagtataatttggagcagttaaaacagcagaaaatacataattggaatgaaagctcatttgttgggatgcttttctcttctaggtgaggtgcaattcctacagaccagaagctgcccgagaacaagtccaaattggtgctcacagtccccctcagtttaggtaaatgggcaaatgggtgacggcagtttttaactgtacatctccccccttcctcccccacccagccatccaagggctctaccagataggtgatctgaaaaaaatcccacattgtggacgtgtgatttccattttgcagccaaaaaatatctggccacacggaaactaaatatcttctttcattagtagtaagctggtttagtcagcactctctcacctgaatttctgctgatggtacctgtacatatctagtctagtgctacatcaagtgccagtgagactatacaagactccagaggtaattcggaatccgaatcatagctttagtattacatcccattatcttctagtttttgaaagagtctcagtaaactgcattattggacttactcaactgcttacttttttgtccaaaaaaatagcctttattgtcttaggaaaggatgagatttgatgtactctgccttaaaacacctagcgctctggtttattttgttttaaagaatatcccctttaatacctcttgttctttcacacagtcaaccagcaaacatgaatgaatggccactttctaaatagctctgaacacaaaggaggatacaaagtattattcagcaattataatttatatctagagttagagagtctacattttggctttcaggtgggatcatattttgaaacggtagcttatacaaaaaaggaaaaggattatgaattgcagtcttatttgtcagaatgtataaaacattaagtacaaataaaattaaaagttaatattactcaccctgtactcggtcgtacaggttgacagaaattttctatagtaccggaaagataagtatgatgagaaacccaaaaaccataataatttatatgtattcattctttgtttagggcattatatctggatatctttatatttaatgtttaaacagatccattagcatattgcaagaaagccatctaaaatttcttctatatgttaaaatcttattcttaagatcttgccttagaaatgcttcagaaattgactataaattacccactagcataaaaatctaatcactatgttggaaatttctcccccactgggctaaactgtcatgaaggctgacggtctcgaacgtactaaaatgtgttcccactgaccaatggtgcagatgaactcacacagtagattaattactcaacagataagttttcagaaacttatttcctttaactagttgcctgtaatgttgaattttacagtgcatgcttactaattatcaactgtattctatctttaacacttgcctagggtgaatcacactatgaaatatgcatccctacccatatattcagctaaaacaacaagaggttatgaggattttttggatacagtccattacatttatgcaaatgcccgtaggtaacaaagtcattagggaagaaatagtcagggactgagaatgctgagtctctagtcaaccctttgaacacggagttgagtaagaaatagaaggggggaagttttttgtgtgtgtgtgtgctggcttgttactgaggtctgcagtaactatagattttgagtgcagcagaaatcacacaatggcaataccacttccaaaaggcagctacaatcaaagtgctgagtaggaatccagtctttgctgtagttggaagcctgtaagaatgtgacatattggagctaactccagtgaagaattatcagtaataactagataccattcattaattgactgattgttgcattaatcaaattctgggcaactgtgagcttcccatacctaacactaattcagagaaaatgttttgcagattgaatgaattctttaaaaatagctggaaatgcaacaacatggatgactcttatagacattatattcagtgaaagaaatcaaagaccaaacagtacataccatggattccattcacatgaagttcaaaatcaggcaaagctatggcaatagaagtcagaatagtaggttatcttgggagatgctgttggtatggaacaggcaggagccttctgggtgctggaatgtcttgatctggcagatagtaatatgggcatatacacacaaaaactggcaagtcctacgtttaatattttgcatactttatgtcagttatactttccataaagtttttaaaaagttagaaaaactaatattggtgatgatacagttttaaaagaattttgaagactgttcgaagagtaataggggcatgtgcttggcattcaggagatgctggatctagtctgttaattttttctggaaatttacttaatcattttgggctttagttgtctccctgtaaacagattaaaagaatgccaaccttctttctagcaatattctgctacagttttatacagaacctgttgatgtgcaagaattatatgacatatgctttgacatatcgtttttcagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagctttgtgggaagcctaaattgatgtatcctttaaaagttcaatctattaaacttgtagcctctcaatgatgaagacatgtgcatgaatacctgggagggcttgctgctctgtggaatgcagtgcacgtttttatggacagtaattacacagcattcctcaactgtaaggtagttaaattagaaatatgtttgatctccattttacactttttgatgaagttcttgccttcagctttggagtctgttggaatgaaactgtgtctcacagcttgcatctgatgtagcagattgccctgttcaagtcagcatgaacaaagctcgcagaaaggctactaggtaacggatttgagtttattcagtagaaaaaaagggaatgaggacatatctttaggtcccagaagcagcaaaacctcctagttacataacagcagggaaactaggagatgaaatctccaaaattttgtccagtctgtatgagctgcagtgattgtctgtctgctagacacttttttttagcctaattcttgttcgtttcattaccttcatatgtgtgcattgtactggttttgaaatgagcagacattgagaaaacaattttctgattccccattaggaacatatgattttcatttcccttagaacaaacatcacattgaggagggagaagtgtacccttctttttcagcttaatgttacctctctttaaaaaaaaaacatttttgaaaaatttcttgactgatgacattctagaatttattgattcaatttaaaattccctgcatagtccaaataaacataatttttactcttcaagtcatctaaagagttgtgagaaagagcagtactatgtgttttatccttagagcattatccttctaagtgaactcctttcttattactgagcgtgtgtgtgtgtgtgtgtgtgtgtgtgtgtgtgtgtgtgtgtaggataaaattgtaatggccttaaagttgttacctggcatttttggtttcttaaaataggcatccccctactccctttacattattcattagacatgaggtgctgggttaagtgggccaataggaaaatctcaaaagcaaaatgacaaattcagattaaccacaggaagccattgtgtgtccctgtgatttgtgattcttttaaaaaaaaaaaaaatatatatatatatatatatatatatatatatgtatatctacctaagtgtgtgccatgtccttttgtagccatgggaacgtttgaatggagaaaaatggaggggcaccatcatgaggaaacaattatactgcattagtcagaggagagcgattttccctttgacttcttcctctctgaatggataaacttgtgaagggcagctaccttgtcctcctcttaacctggcttaatgtgaccttagtttgtatttccaaaaacaagcagtattaggttggaattgtatgtgtcttttctctggaggaagcattctgacttggtttagacatataagatactctgttttattcctggacttgggtgtttaaaatcagctgaggtttatcatgcttatatgaatagtgtttcccttctagatttcctttataaactccaaataaacacattcctgcaggtcagagaaagtgtttgataaaagcatagaattatggctttggaaa

SEQ ID NO: 17540 - DNA, 99370 bp, Human; identical to SEQ ID NO: 12816

SEQ ID NO: 17541 - DNA, 19112 bp, Human
tggatactgttgtgggtgtagggctattttgggagtagtcaaattctttgatttcttggctctactctggtgcacttaatttctgtaggctttatgttctaagatattgactgtaaataatgactaataaattaataccatgaagtatattagaattgaatacaaattcttgctaaaacttcctaggtgcttcctgtgattatacctacatgtttttgtatatatgtatgcatgtttgtatttatttttggttaacacacatttgttttagaaacatgagagaataaccttggtcgtcctttattacattacatcatgagtcttgtggactgaacctgcgaagcatagcagccgggtaggtggagggagatgagtctggaaagataaatgggagtcagatcatgaagggccccacctgccatgctaaggaccctttactttattgtgaccaagggctccctgatggattcttcataatgggactgccgtaacagtttcatttgtaaaagatcctataggtagtaatgtgaaaaaactgacaatgggcctggagtagattgaagaggcaggaaaggggtgtatcaattgaatgtggaagatggaaaaagagaggagcttctgggtggtttggatttttgggcaaatgtaggtatgattggctgtttggcattgcaaatatgggaagagattcaggggacacagtgaattcccttttggacaagttgatattgagtttccaatggggtattcaagtgtagtttcctagtagttgatggttaagtgggctggagctcaagagaaaggcctgggttgggcagacaggtcttgaagtggagggaaaaacccagagggagaatgttcagtagaagaggcttagagtcctggcaaacaccaacttttagggcaaaatgtagtgtttcacagcacagtctttggcgttaacctattactagcagggtaacctggggcaagttatttgacttcagtgtcttaattgcaaaataagcactataccatctacctgagttagaaaagcatttgcaatttttagttccttgagagatctgtgggctgggcgcagtggctcacgcctgtaatcctagcactttgggaggtggaggtgggtggattacctgaggttaggagttcaaaaccagcctgaccaatatggtgaaaccccatctctactaaaaatacaaagtagccaggcgtggtggcacatgcctgtaatcccagctacctgggaggctgaggcaggagaattgcttgaacccaggaggcagaggttgcagtgagctgagattgcaccactgcactccagcctgggcaacaagagtgaaactccatctcaaaaacaaaaacaaaaacaaaaaacagatctgtgaataaagaggagtccaagaaggtgcagagggaactatgaggaggtggagctctagaatatattgagaaaagagaatttcaaagaagccaacaatgtcaaatcctccaacaggactgtaacataagtctgtaaagtgtccaacttttagcaattagtgaccttaccaagggcaatttctatggaatgagatgagccatattgtagaggttcgaagagtggatagtggtcaacacggatacatcgtttcctcccctcacggcatctgtctctcccactagacttttcctttaaaggcagtgacttatgaatattattccactgttttcaatcaattccatccaccagtgagatatattgcatcaggttacctttcattccaccgcatttgtgccttgcacttagtaggcgatcgataaaataactgatgataaaggggcttctgcagactccccaattcatttggtaaagaccgctcagcatcatggtcgggccctgattgctttcacaaccgcttcgaggagtgtcattcccatcacggccacaaggtggagcccacctccctgctctgggacctcaggtcgcgaccccggaagcacatccttcatcctctaccttccttctagcagaaatggcggctgcggcggctcgagtggtgttgtcatccgcggcgcggcggcggctctggggtttcagcgagagtcttctaatccgaggcgctgcgggacgggtgagcttccctccaggccggtcctgtcctcgagatctcgccagacccggcgcagcgcacctgagagtcggcgccacagatccgaacagtgggtcgggcagggcctcctcgacccggacccgccgggcgccaggcggcctggggctgctgaactggccgggggtgactggcttgtggccacccgccaggagacctgctagtgacgtgtgggatgaccctggttttcggctcctcccgccagctactgaggagtgcatgtttgaccactaaaaacgtagtgcttgcaaattggggaaaactaaaaagtgaaatgggtaccgctccagagttctatttttgcctaagactgaacttcgtcctcagctgggcttcccgcgaacctggacatcaatgaagtaaaattttttatgtatttgcatttttctcatgagagagcctctgactttaagcaaagggatgtgagacttttgtataagggcaaagaaaaactgctgaaaggcgaatagtttctggccgaaaagccagtcatttgcattttgaacatcgacccatcttcctatcctctctctctttttttttttaaccatttccaaaccctgttgcttttcttgaacaatgaaaacccgagtgtcagttttgtcttgtgtgtaggtagttttacatagtttccctctctttttttttttcctgcttgttttctccataatgaatataaaacatttctaggagaggtagtgaaataaagtcaatttctctctgggtaatgataataattgctcatcttccctgagggaagggcatgtttataaacacgttgctggctttaggacagtggctggtgacagatgtttctaggccaggcagagatctcagtggaaccaaaattcaagaagaaagattcttttatagagacagcctatttaaaatagatttggttttaaaagcaacatttaatatcagattagtaatgtgttttgctttgtctcttccacttcctacccccaaccagtcattatattttggagagaacagattaagaagtacacaggctgctacccaagttgttctgaatgttcctgaaacaagagtaacatgtttagaaagtggactcagagtagcttcggaagactctgggctctcaacatgcacagtaagtgactcaggcaaccttctctaagtgacccttcatttagcgtagcaaattgttgattttaatctttagctttttcgttggctggtggttcaaaaagggtgacagttattttgccttgacagatttccatgagttgtgaaccttttcttccagtggtacttagttacagggtgcatatgtatcctgttgcattgtctgcatcttgttcttgtagcttattattgattatttattttcagtagtattgataataatgaaagaaatatgtttgcagggctactctgccaagtgtttttactgatgtcttatttgataaaaagcaattgtttgtagtgggcatcctcacacctgttttatagttaaggaagtgagagaagttaaatggttttgttcaggtaactcagctaatacatgacagagccaggatttcaaccgaagttttctgacagtctctgatgttcttgatactacagttattaattggctggattaatgagttgggcaaagaatcctcattgaaggtggcaggtagatacttgtagcacccagcagtatcctgatcgaaatttttaaatctcatagttcacaggaatgaactatcaattcactcaggtcaagaaaatcttagtgttaagaccagaaagcatttgtcagaaaaaggaaggagactgttccccccaacctcaaataaataaaatgaatttatttaattgttctttgattgcattaaggttggactctggattgatgctggaagtagatacgaaaatgagaagaacaatggaacagcacactttctggagcatatggctttcaaggcaagttgtaagactttacaaaaatgcactctctttaagagataataagcacaaagtctcattctttagaggcagggagagctctttcagtagtataacatgttttatgtttatttttccaggacagtatctaaaataagtagtgataattgctttgtaaagctgaaatgaaaactttctcttgggatgcaggagttatctgaacgtataccatttctgaagcctgatgtaccttatttttttttatttaattttttttgagataggatctggctctgttgcctaggctggagtgcggtgacgcaatctgcttactgcaacctccgcctcctaggctcaagccatcctcccacatttacttctggagtagctgggagtatctatatatatatatatgtttgtttgttttttcatagagatagggttttgccatgttggcctcgatctcttgggctcaatctgcctgcctcagcttctcaaagtgctggggttacaggtgtgagccatcgtaccatacctgatgtactttagaaaccaaatttgaccctgcatgaaactaacttatgtcctccatattcattatctgaagtagaatagatgaagtataaagggagtttgcataatttgtttttcctcttttatttcaagggcaccaagaagagatcccagttagatctggaacttgagattgaaaatatgggtgctcatctcaatgcctatacctccagagagcagactgtatactatgccaaagcattctctaaagacttgccaagaggtactgttattatttatacagcagataatgtaattttcatgagaatcaggaattatttagtactatttttattatgtctgttgtaaaagagtaagttccagaaatgtgaaaaagcgaaactgaattctgggtgagggtacagctgatcttattttttttctaaatatgacaaatagtaaattatggatgatggtttttcttaatatgtagcaataaaatagagattatttggtgggaataaaatattttgtcaggacagcagtttgttagttaccatgtttgtagactgttttgactctcttaaaagttattacacaaaacatttcccagtggaagaattaacaacaaaatttagcagttttagagctaattggtaaactcattatttttgtttagagagatagtctcgctctgtcacctaggctggagtgcagtggtgtgatctcggctcgctgcaacctctgcctcctgggttcaagtgattctcctgcctcagcctcctgagtagctgggattataggctcctgccaccatagctggctagtttttatatttttagtagagatgggttctaccatgttggccaggctggacttaaactcctgacctcaagtgacccacctgcctcggcctcccaaagtgctgggattataggcgtgagccactgtgcacggccattagtgaaatttttaacctttaaggtccttctgtagttgtagttactactttgcaattttggattcctaatagactttcattaataatgtttaaatggcacttaacacaagtacttttgtgtatatattatccatttgatgtgcataggtgtttccaccttgcagttgtggaaattgaagctcagactctgacttgcccaggattgcatagctatcaggtggcttactgtggactcaagtgcgtgtcttcttaccagattcatttgctttgtcaaaacaataaaataagaaacctatcacttgtaaataactaaaatacttaatatgataccctaacttttgcattaaaacaaaaatgacagcaacgatggagggtatgttggtttgaataacaaaaccaatagagacagtttttgtcccaggactaattagggaccaagaacatatggctaggccaaggttctttaaagagttgttcattccagcctagttccttcctttatttacacagaacaacagggaaggcaaaaaggagaaacagaaaaaggaaggatgaaattaaacgacttttttcccccttttctcctggcatctagctgggaacgacagagcttctgctagtgggagtggaaaaacaggggctttccctgaggaatgcaaaatggaagtgctctctgaagcagctccaactttggggatttacttggggtttttcacccttcaccctgggtgtgaagcctggtatatgaagtaataattagatgtttagactaatggtctccaggtttttatgatcacttattctttttttttaatttttattttttattattatactttaagttctagggtacatgtgtacaacgtgcaggtttgttacatatgtattcatgtgccgtgttggtgtgctgcacccgttaactcgtcatttacattaggtatatctcctaacgctatccctccctgctcccaccaccccacgacaggctccggtgtgtgatgttcccacctcgtgtccaagtgttctcattgttcaattcccacctataagtgagaacatgcggtgtttggttttttgtccttgtgatagtttgctcagaatgatggtttccagcttcatccatgtccctacaaaggacatgaactcatccttttttatggatgcatagtattccatggtgtatatgtgccacattttcttaatccagtctatcattgatggacatttgggttggttccaagtctttgctattgtgaatagtgctgcagtaaacatacgtgtgcatgatgatcacttactcttattggtaagaaagttgatcatatatccttaatgtatgtatacttgtaagttaaatacatgtgctactatactaacatatattaaatacacatttaaaaaaaagattcagattaaaacagactgggaaataggagcccccctccctgcctttggaaactaccagggtagaccaccaatcccacataaaggaggattttcacacaggaattcttgtccttccatttgtctatgggctctttctcacccattttactggactctgttctcttatctggacagatgggttttatttggttttacagataattttttccttttggtcatgatctcagccacagcttactataatagtttgttctgtcatgttcttagtatttgaacataatcagttctgagacagtgccccttaaagtgaacttaattaaaacaagcaacaacagtttgtagtagagtaaaaaatgaaacctaaaccagacacggtagtacatgcctttagtcttggctacttggaggaagctgaggcaggaggattgtttgagcccaggaattttgagtccagtctgggcagcataatgagaccttgtctcttaggggaaaaaaaagaaacttaagattgtaagtttattttataacattaatcgtattaatgaaatttagatttatgattgcaactatgtactaattcttcaagaatgaagcacagttttttttttggagaggtatgcgctttttctgataaaattgcttaatggcctaatataacatgttccacttcacttttggctttttgcaaattagggtttgagaacacacaattctgtgattcatttggggcatattttagattgtaaggattcttttctctgttgcccaggcgagagtgcagtggtgcaatcgcagctcactgcaatctttgcctcccgagctccacccatcctcccatctcagcctcccgagtagcagggactacgggcacatgccaccacacgaagctaatttttgtattttttgtagagacaggattttggcatgttccccaggttggtctggaactcctgggctgaagcccatattagcctcccaaagtgctgggattatataggtgtgagccacggtgcctgaccagttctttgcttcttaacatagcactgtcattgctgtgggaacttgcatagtaaatacttgggtgatacaaaccctctgtacattgctagctaggtattttcagactaatatatataactttgtaattttcatatagaacaatctatattaatatgcaaatttccatagcattttttaagtaggtagagtcattacaaggtgatggcaaatttatactttttccccaaggaaaaaatcttttgtactataggggtttatatgttaaattttaattttgtcctgttaagtatatctgatgtttttctcctaggctaatcatttagtattgagtgatgggtcagtgtcatgatttctgattttggtttaatagattttaatagtgaaagttaagattgctggcacgttttcttatattttattttcaattagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaagtaggtataacagaatttcttggtgtataagggaatttatgaatgttgaaaataaacatttacaaattttcaaaaagtatgtttcagaaagtaattttccccctggtaatctaagtgaaactgtagttagctacattttagtcccacctagctcccaagcacgtgagttcataggtacttcgggaataaaccagtaatggtgtattttttctttgatgtaaaaaaggtgaagttctttgatgtgttgcctgtatcctatttctgactgcattttaggatacagttatggtccaatttgatttcaggtatattatgtgaagatctgttttttttttggtttcctttaaaaattgttttacttcatttacagatctataagtcgtaaggacttagtggattatataaccacacattataaggggccaagaatagtgcttgctgctgctggaggttagtcaatttaaatttctacaaatgttttaaacacagttgttggagtggtatgcttattagtttgatcctgttgggagataccctaagaattttcatttacatagcaaataactgatagtgtgtaaggggaatgtggagcactggaatcagaatttccctctattttttttaaagtaggtttcatttaggccaggcatggtgactcacacctgtaatcccagcactttgggaggccgaggtgggcggatcacgaggtcaggagttcaagaccagcctgactaatatggtgaaaccccatgtctactaaaaatacaaagtagctgggcgtggtgacatgcgcctgtagtcccagctactcgggaggctgaggtaggagaattgcttgaacccaggaggcggaggttacagtgagccaagattgcaccactgcactccagcgtgggcgacagagtgagactgtctcaaaaaaaaaaaagaaaagtaggttttatttatagaaagacttaatgaactgttcaatacataagcgtacatagtagaacgtgcaagaaaagggcaaaggagtgaactgggagagagtcggaagatggtgttctgtactttgagaattttttgagattttaaattatttcttgagaaccaacttcgtccttgttcaagcatggaacgggtatgttcattctttgatttgttcaatcattcatttaatagatctaatttttgggaaggagaagcacatagggagccataagaatgttgaatgggaatccaaacatgcaggtgacttcagaaggtttccttgaggtcatgtttgaagccagtgaatgaaaaaaaaaattgacaacagatattgccagatttcctggcagtctgaatctagacagcagtacattttaattggtttccagttttttatttttttctttttaaaatacatttatagaaatagagatggattcttaactatgttgcccaggctggtttcaatctcctgagctcaagttatccttccaccttgacctcccaaaacttggggattacaggcgtgacccaccgcacctggtctccagttttcatttctttgtattttttaatattagagcaaagcgaagtgttctttcgtgttgtaaatttttctctttttagagatcataatttaaaaattctagttgctctggattgatttctgagctaagtacctggcgggtaatggagaagatgaaaacattaaatatcaaacatgttattcattgtagctaccttcattgtacatggcaggaagtgcactctgaaattctcttgagtaacattgtttctaaattggctcttgcagacttgggcttaagtgtttgaaactgccttggaaatgggacaagagacttgttagatgggtcctcaacaaccaagctttctgggacctctctgccattgttggtggcatgtggacaaaatgagttttactttggttcatgggttcattttgacatagctaaaattgagatatctttagtttaatggcttatagattaattagtattcattttaaatactacataagtgatgtgccttataaatgattgcatcttaaattcaatgaaataggccagttttaagtttctgctgacctctgaattatgtcttggctaccatttatctcttctaggctaatcatcaggatgtatagcttttatttgccaaatagttttttgtatcctagcttcatttattataaaattataatttaacattttaattgtaaattaagttaaagaatcttaatttgggtctcaagtaagggatatagagtctaagtaattcctgagtttttgcatttggatacctattgatgtattcagaaatttagatgacactattttgttcctgagttctttttttttttttttttgagatggagttttgctcttattgcccaggctggagtacaatggcatcatcttggctcaccgcaaactccgccttccggattcaactgattgtcttgccttagcctcccgagtagctgggattacaggcatttgccatcacacctgactaattttgtatttttagtagggatggggtttctccatgttgatcaggctggtctacctctacctctgacctcaggtgatccgcctgcctcagcctccgaaagtgttgggattacaggcgtgagccaccacaccaggccctgttcctgagttctgatagcagagcatggagaataaagtttatctgtgtatccagctttcttttatttatttaattttatttattttagagacagagtcttgctctgtcacccaagttggagtgcagtggtgtgatctcagctcactgcaaactccacctcctagattcaagcagttctcctgcctcagcctcctgaatagctgggattattacaggcgcctgctaccatgcccagctaatttttgtatttttagtagagacagggttttaccatattggccaggctggtcttgaactcctgatctcaagtgacctgcccaccttgacttcccaaagtgccgggattacaggtgtgagccatggcacccggcttttaaaatttattttattgagacagagtcttgctatgttgtccaggctggtcttgaactcctgaactcaaatgatcctcccacctcagcctcctaaagaactgggattataggcgtgagccaccatgcccagctccagctttttaaaaattagatagagcccatatttgtattttccactaaaaaattttttttttgaaaattggcattttttgctagtttggatcccagaggtttttataatttaatagaaaatgattttgtaaaacgtggagttttcaagttgtcttattcttagctgtgaatccattggtctgttgatgaaaactgtcatttgctctacaaaatgagaaagctgtgcaacctcaagctttgcaacaccaaggaaataggtgtgctatgtgagcttactcttaaataatggcttttagtgagtgtagatagttcatgtgtaatgtacatcacattataccacctagggtttattgtaaactatattgctgctagatacatgtgaaaatattttctttcaattcaggtgtttcccatgatgaattgcttgacttagcaaagtttcatttcggtgactctttatgcacacacaaaggagaaataccagctctgcctccctgcaaattcacaggaagtgaggtagggcaagccttccagctagtatttagccttttggattccttgtgttgtatttacacataagtaaacaaaatgtgcatatttccagtaggaaaagaatggaataataggaaaagggaagaggatgtactcatttgcttacattccttcctcttccgtattctttaaccacctatttttcttcctaaggaagcaaggttttttttgttttgtttttaaatttctccattctagtctgaaaggaagcaaagtttttaagagcagtttataatttggtctttttgtgctttttctttggcactatgccaatttacatattgtaatatctggaagtaatcttttaaaccccgtattttgactttcacttcaggtttactcttggctcagttttgcccacagtatgttttgggagggggtagtaactgttagagccagaacttgcaggggatctactagttatcaactagctttaagccccactagctgcttagtttgccatgttgaggatgatgctcaaagtagtatctggaaaatgccctgatattggcagctgcctagaactgtagcattggcagtacaaaaataaacctgtaacgtcaatatgacatttcaatagaaaagttcagattgaggccgggtgcggtggcttacgcctgtaatcccagcacttggagaggctgaggcgagtgtgtcacttgaggttaggagtttgagaccagcctcaccaacatggtgaaactccgtctctactaaaaatacaaaaattagctgggcgtggtggtgcatgcctgtagtcccagctactcgggaggctgaggcaaaattgcttgaacatgggaggccgaggttgcggtgagccgagatggtgccactgcactccaggctgggcgacagagtgagactctgtctcaaaaaaaaagaaagaaaaagacaaattcagattgacaaacacaaaggattgatttctaccagtgaaatgatgcaacccttttgaccaggtaaaccatgtggtgcctgtctgtagtaaaatgctttgggaaaagtaatttttccctaatttagtcttaattcttctagattaaactcaacaatgtaatgaggcctgatagttaaaaaatcaaaatagagtcctggtgtgcattttaactttgcagttaatgggactggtgattttttccttgttaataagcatgttatataatgttaatcttaactagaggtcctcctgctttatcttaactagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatggtaagtgattttaaaagaaattttccataacagatggaagattatcatgttttcttaaatataagttctttgtaagaatccttttttaaagtggcagaatagagtcttgtactgtgaattctgacttaaaaatataaactgatcctggattgcatgtgggccagaaaaagtttctttttttctttgccacaaagtttattagtggcaaaatttgaataaggacagaattagctagaagtactatgtcaatgttaatatcctaattttaatagtcagtaggccctctatatctgtgggttccatatccgtggattcaaccaaccataggtggaaaattttggggaacaaatggatggttgcatctgtactaaacatgtatggactttttttttggtcacttcctaaacaatatagtataacaactatttacatagcatttacatggattgggtatttatctagagatgatttaaagtatacaggagaatgtgcttatatgcaaatattacatataccatattacatgagggctctagcatctgtggattttggtatccacagggatctgggaaccaattctccacagatactgaggaactataccaaggtgatgtaagaacattaatttccttgtttttcacaagtacatactaaagtatttggggcaagaagcatcacatctaaaactcagttgaaaaaacttgtataaagagaataaagcaaacatggtaaaataacagggaatctagataaatgaaattctctgtactgtttttgcaacttttttgtaagttggaattatttcaaaacacattgtatagatttgtctttactcatagatttctccaaaatacatttcatctaaataatcttaagcttcatatgcaatataactttgaatctttaagcgtatgtagccaagagtcctagaaattgggttgataatagccatctagttttagaagtaggtatagctactacattaattataaggactcattgcttttataacatgaatttctccagggggtgcactgggtaagtgagataataaacacaattcttagtcatactgaattttaactctactactgagatgttgaataaaactaggaaacagcctctaaggatattcactattttccacacactccatttttctttctgtattttggacatgtataattaaaattctcttggaatttttttttccttgcagaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggtgagaaaaatagctttaagtaatttaaattttgcctttaattcgttttaaactagttttttatttatactttatggtgatttatggtaattttaccttttaattaagagacctagataaacagtagttgccatgttttcaaaggttgcagttggtttttcctaagtctcaagatgtgaagctgatttatactatagaatttttttttttttttttttttgagatgaggtcttgctctgttgcccaggctggagtgtagttgtgccatctcggctcactgcagcctccgcctcccaggttcaagccattctcccacctcagcctcccgaatagctgggattacaggcgcaccaccatgcccacgatgcctggctaattttttgtattttttagtagagatggggtttcaccatgttgaccaggctagtcctgaactcctgacctcaggagatccacccttctcagcctcccaaagtgctgggattacaggcgtgagccaccacacctggctgaaagttttaatctttcagaagcaggttaattcagaaagatgatcctaaaagtttaaaagccaactagaagttgtttggaaaatatctctgaaagtaatctggttgaagggaaagtaaatctgaagttgccactgctaaaagaaaacaaagtatattgagtcgatagatgggcagaaaggctcgcagcttcttggaaaacatttagctctggttcctttcctccactattcttaattggtttacatctttctaaatctagtcaactaggatgtaattattgttaaaaattagatttaagttagactctactcattgttttcagaaaccaatgaatgacccactgacttaacccatagcatatcagactccaacagatgaggactcatgaagtctcaagatgcttatagcatttctgaaaatgtgatcagcccatttgtataaagcctttgtctgctaatgtgtaattaggcatgtttatgtatcatttttgagaaattaatactggggaaaataatcattttagcttttgcttagcattggaattaaattgtaatcacctgtatgttttgtgtagaagatggcatcatcattcttaggtcattaactcatgaaatacaacattttccaactactactgtttttccacgttttttaggatgcgactctgtacaagtgtcacagaaagtgaggttgcacgagccagaaatcttctgaaaacaaacatgttgttgcagcttgatggtaaaaataaagatataggttctgttttcatatggttgatctgtattccaatagttaatttttccttctctttaaacaggttcaactccaatttgtgaagatattggtaggcaaatgttatgctataatagaaggattcccatccctgagcttgaagcaagaattgatgtaagtagtcctgagttactattgggtcatgtgtaaaaagatccttgttacaaaagctgagaatatgtatctttcatcttgctttagttttaaaaagttccaggtatagactttgtttttactacaaacagctgaatgacagtgtcttccatatttcaggctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagatacatatagccctctgagtgttaataagagaaaaaatttcagatagctcacatcccagaaaataaaatctcaaaggcttttaaaacacaatagtaaagatctaccttgtactgtttatctcttaaaaatcaatgtaatacactcaccagactggtaaaaagccatatttaaatttatagtactgttggactcttggactcaaaaacacaaccacaattcattaagagttctgataaatctacttccttacagaataggtaaaagagcttcctcacagttaaacttttgctggatagaaaccctggaaatcattcttgttttacactgaaggaaacaaacctagcaaaattaagccaagtgcccaaggtaccagtgctggagaggcaagctgagattagattgtgttgtagtgtggtgttctcttcgtcacatctgctaaaatcttgggagccgatgctgaacacttccaataactgctattgtggttcttcaactaaaccttgtatatttcagaaaacatctaagatgtgtgtcagaaacaaatatgtttcttaaggatgttaagtattacacagtccacttgtgtaggtaaaagtagaatgttaagtggtagaaagctgatttggttaagttaatggacttctggcaatttagttatttcagactatgcagtgacaacacagactaatactaccagtagcctgactactactagaaactgcggcctgtgagatctgttaaaagttaagcctagaaaccaaagttccttcccaattaaagaaggaaaaacaaaacaaaacaaaacaaaaccaccacctattcaaaacaaagcagagaatttgtataatatttgatggtacctaaggtgcctaagaagcttttttgaaggtagcttttaagttctaggaagtcttttgttgaatttccttgtattggtttaaagccctaaataccatagattttatttcctctcttggaaaaaagatggaagtgacatggcagtatttcctgctgttctccagttacttcacaataccaaaataaattaaacgtactgttgcaaaactcctatgagaaatcactattcaaaaaatggtgccagcttgctgtttaatggtacaactgaagaggaaggagccttcccatttccataaaagaggcaaaggagtcatacccacatagcactactgccagtcactcttgccttcacagggtcacctctcctcacagaaagcagactggacaaatatcagggcccacctccctccaacatggaaacaagtccccctaagaaagagctgagactagtgtgctaatacc

SEQ ID NO: 17542 - DNA, 24167 bp, Human
  misc_feature (1)...(24167): n = A,T,C or G
cactatgttgcccaaggtggtcttgaactcctggcctcaagggatcctcctgcctcagtctcccaaaactctgggattagaggcgtgagtcactgtgccaggccaattaaatacatttaattggtctgtatatctgctgcatgataaaattgtcacttcaaaactgacttttcaaaaattgaactaagggaggctgaggtgggaagatcgttgaggccgggaggtggaggttgcagtgagctgagatcacaccattgcgctccagcctgggtaacagtgagaccccgtctttaaaaaaaaaaaaattgaactaatcttctgccccaaaacctcttcctgatccctactaatgcaaccactgttaaaacatgctccaaggtgcaaagtaacctgactccactttcttcatattaatatatttttttcctcacacctcctcccattcaattttaccattaactctaacatgggtttttgtttttttgttgttttcttttctgagacagaggcttgctctgtcgcccaggctggagtgcagtggcctgatttcggctcactgcaatctctgcctcccaggttcaagcgattctcctgcctcagcctcccgagtagctgggattacaggtgcgtgccaccacgcccagctaatttctgtatttgtagtagagacggggtttagccatgttggccaggctggtctccaactcctgacctcatgatctgcctgcttcagcctcccaaagtgctggaattacaggggtgagccacggtgcccggtcgggggttttgttttttaaaaaaattgtgctaaaacacacataacatgaaatttacgatcttcaccgtttttaagtttacagtaatgttaagtacattcacattattgtgtaaccaccctacaaaactatttttatcttacaaaactgaaactctatacccatttaatctcttacaaaactgaaactatgccagtggaaaaaactgtccactggaaaccatccttctactttgtctttaggaatttgacacctctaggtacttcatatttgtggaatcatatagtatttgtcttttttgtgactgacttattcacttagcataatgtcttcaaggttcatctgtgttgtagcttatactagaatttcattcctttttaaggctgaataatgtgtgtgtgtgtgtgtgtgtgtgtgtgagcgcgcatgcgtgtatcacattttgtttatccattcatatgtagatggacacttgggttgcttccaccttatgggtatcatgactaatgctgcttatggacatggatgtacaaatatctctttgagatcctgttttcagttcttttggatacacatccagaaatcgaattgctaggtggcatggtaattatttttaatttcctgaggaatcaatcatactgtttcccacagcagttgcaccattttatcattttacatttacatcaacagtgcaccaggattccattttatccagcagcacatgcaagggttggctggacccaagggtcatcctttccaacacttattttctgttttgtttttgcttgttttttaataatagctatcttaataggtatgtggtggcatccaactgtggttttgatttgcatttcctaacagtgatgttgtccatttgtatatcttctttggagcaatgtttattcaggttatttgcccacttaaaaaatcaggttgttttcttgtgtggtaggagttctttatatattctggatattaactctttaccagaaatagattaccttcactatatttgtagatgtggccactacttattgtgtctaatatgccaggcgttttacaaacactgtaaagtttccttctcacaggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgaggtcagttgacatgggccggagctcggagctggggcgggactggagcggagctgccttggcactggagaggagctggattcccgctcctggctctgtgctctggcccttttgtgcccctagtaatttagtctggacaccggccggattaacttgcctgccttctcagtctccctcatccactacaagttctgtattatctgctgatggaaatttttattcattctcagctctcgggtcttgaagaagtcacgcaccctgcttggcctaataggccttgaaaagttctgcctggcggtgctcggtcacctgatcctctttcctctcctcctccttccccctgtgacagccgggagctgtcactgtgtagccacaattctgagacataattttcttaaaaaaattatttgaccagataatacattcacagggttcacaattcaagaggcagaaaagatatctttgaaaagcctcgcatccttggccccagccaccaacttctccacagaggcaactaatgttgctattttgcatatctttttagacatattctatacatatacaagcaagtgtgcttatctattccttttttttaacacaaatgtagcatgctgtacatacttcaacatcttgatttttaaaaaattaatatatattagagatactttcctatcatgtagtcacttcctctgcatctgcatagtatcctgtattatgcgtatacagtaatgtatttattattgatggacgtgtagatttttccaatttgttgctgttataaaacaatgagtaccttttacctcgttgcactctgagaccaagatgggtcaccagaagctatgctggagccacccgcgaaaattcggccagggttctcgctcttgtcgcgtctgttcaaaccggcacggtctgatccggaaatatggcctcaatatgtgccgccagtgtttttgtcagtatgggaaggatattggtttcattaagttggactaagtgatcttccttcaaaggattatccaaggcatctacccaatggaaaaccatgatagttctttgtacataaaataaacatttaaaaaaatgaataatcttgtttatgtaacttttaccaagtgcacaagtacaaattgtaggataaattctagaagtggagttctgattttgtaagtgccaaactacactccatggagattgtaccagttgacactttaacttacagtgcatgagatatgcacaccagttttggatataacttcttcccagtagtcccgtttgtagtctcatctttatgccgtttctccttttgttccttaagctatttttaaatgttcttttggtatttcttatgtttcttcttacttttccctttcttaacaacttcaacttttcctagcacccttctccatttacactgtcccccaaaagaaagcatttcctttctaccttcatctcattctgctgtttcttttaaaaatattttaggacactgaaaatgtcagatatactcagtatttattggaaaacttagacacagagatttatcatttgatctgtgcacagtgatctgtgtgtttctctgggtttgttcttctgtaaaaatattaatacatttattccttggatacagttatgactaacatgtatataggatcttatgcgtttattcatacataccctttttttttttgagatggagtcttgctcttgtcacccaggctggagtgcagagatgtgatctcagctcactgcaatcgctgcctcctgggttcaagggattctcctgcctcaacctcccaagtagctgggattacaggcacccccccaccacacccaactaatttttgcatttttagcagagaccgggtttcacaatgttggccaggctggtcttgaactcctgacctcaggtgatccgcccaccttggcctcccaaaatgctgggattacaggcgtgagccaccgcgtctagcctgattaagttactttcaatttaagctttccgatctcaacttggtcctaattgcagttaactttttgtgaatctcctattgactcactttgtttgagtggttatttcaagccttttacatgtttttcaggtcctcagttcagtctctttcttcatgactgatgacttttttctctcctgagacgattgagaatccacttaagagttctcttaacttctctgacattttccattttctgttttaatcctgccttagaggaagtggtatcaatttttgttatgtgcaaccttccccatttctgtttttgaccttatgccttcctcctctggactttgtttcttcagtcactacctcttctatttgttgtcctatggaatttttcccttttgttcttataagcatgctaatatccattttatcttaaaaacatagttgagaaaatcttcctgctctcctaagttacaagtcattttcttttttttctttcacggcctgaaagtggcagaaaggacaggcttaggagttaggaagacctaggtttgaatcttggctttgagttttgtctaataaattctgtgaaactgtttttcctatctgtaatgtagaaataattgtatttacttcacaggtttatatagaattagataatatcaatatgtatctctaatcacggtgtctcatacagtgatcatctcaatttatagcagctattactattctcccacagtacatttctttactatttatatatttatttttagagacagtcttgcactgtcgctcaagctggagtgcagtggcatgatcatagtcactgcaggctgggaactcctgggctaaaaccattctcctgcctcagcctccctagtagttaggacaacaggcgtgcaccaccatgccatgctcatttaaaacttattttttttttttgtagagacagggtcttgttatgttgcctagactggtttcaaattcctgggctcaagtgatcctcccaccttggccacccaaagtactggcatttcaggggtgagctaccatgccaggctcttattttatttttaaacttcttgcactttagtttctatctatataaatcagttgaaactgagcagtagtttcttaattcccagatctttagtatttctcaatcctaatccttgtgtttttgacattgttgagcctttgagcttcccttggtttctcttgctgaaccttcccgtttatccgcctgcttcttttctttccttcattgtgtcctcacatggcttctctaaagttttgtttctattaatttcatccattctggtcttggactgtatgtgcttccctagtcaacctttttaacctcaagctagcatctgacctctagagccagatttatctccgccttttagaatgctgcatcaggatatgccggtgtgttggatagtcttcatgcctaccctcaggctcagtaatttgctaagagcattcataagactcagcatgtagtcatactcatggctatgatgtattttagtgaaaggatacaaagcaaaatcagcaaagagaaaagacacatggggccaagtccaggagaaaccaggcacaagcttccaagggtcctcttccagtggagtcacacaggatgtacttaattcccccagcaacaggtagtgacaatatgtgtaaaatgttgctaaccagagtagctcgttagagatttggcacccagggtttttattatgggttggtaatgtaggcatctctgcctagaacataccaaaattctagactccctgaaggaagataagtgttctgcataaaccctgtagtttgtataaacattttaagcacagtgaaccacctttttcagttctgggaatggtaggaaccctctgaaattgttctcagacaagagccaagaaccaaccttataagcaggcctttcaaaggatagcagttaactcttctgtgcagataacagtaccacaaacttaataaaatttaaactgaacttcgtatctccctctgctaaccactttctattgtgacttctgttgtgtggtacctaggtccaaagcctgggcatcatgtttgatcctctcccgtcagcttctcacatttagtcatttgccatgtgctgtagattcttcctctgagggtttttttttaatccaactcttcctttctcttttcattgctaccatttttatttaggttcttatgacttccgagtggcctcactccaatttgttcttcatatctcagcgagctaattcttcctaaggcacagttcctataatgtcaactgtagtggccctgattacctcattctagaatttatggtctacttcactagagccccaaacctccatctacttaatttcctattaccgcctaatgtgtatactatgtttcagcttacctggtctagctgctgttacctaagcatgctttttcctacctctactcatacttagttaaaaaaaaaaaaaaaaaaaaaaaaaaaaaaagacctgccgtttttttccttaaaatatgtacgattgtatgattggttcttgtttttcatgatagatatattctataaagttgctgtgaatggtcagttgggaagtactgaacatttgatcctaggagaaatatatatatacatctcacatagattataatcttttttttttttttttttttgagacagggtctcactttgttacctaggtggaagtgcagtggcacaatctcagcttgctgtggctgtcacttcctgggctcaagcgatcctcctgcctcagccccccaagtagctgggactacaagtgcataccaccatgctaatttttgcattttttgtagagacatggtttcgccatgtggtccaggctgctcttgaacgcctggactcaagcaatccgcctgtctcggcctgggattacaagtgtgagccacagcatccggctgattataatcttaaatcctaaaaacaactcatcctggtagattcattttttctttatttcacaaaagagaaaacaaagttcagaagtgttaagtgacttggctgaggtcaccccactaacagattccagagctggcattcaaaccctgtccacctggccccaaagcctgaactgcttggattacacggcatttcccctacggtctccatcttctggtcatctctgtatgaaagctgaaacaagagggtagagtgacttgttcttagttgtgaacttaaattttttaccactctgtctatttgcaaatgaccatgaaagcacatgagtattgatttggggattacaaataaatttgagcagctaagcaaattcagaaatgcagaatttgtgaatagaaaagattaactgtaaatcacttgaaatcccagataaccaccgtagaacaccatttcaggttactctccacatgtgttttaagtgatttttatataaaaacaaaatatatgcacattatatccttttttttaaacctacctgattcactgaatagcatttgttggattgctttctatgtctatgttctgttatcattttaaattgctgcattgtatttccttttctttttctttttgagatggagtctctctcggtcacccaggctggagtgcggtgatgtgatttgggctcactgcaacctccgcctcctgggttcaagcaattctccagcttcagcctcctgagtagctgggactacagacatgcgccaccatgccaggccaatttttgtatttttggtagagacggggtttcgccaggttggctaggctggtctcaaactcctgacctcaggtgatctgcctgcctgggcctcccaaagtactgggattataggcaggagccaccgcacggggcctgcattgtatttcattgtatgactatggtataatttaaccaagatccttaatggatgtgttttatgtatgtactatataaaataggtcatcacgtatattatgtacttttaaaaacctattttcctcccagttagataaaaattccttgagtccaggaactatttgattgaatatgtatcatcataatcttgcttgatttttgacactcacttaaaacaatttgaatcgaacagaaaaaaagctctagtttcttttttaaaaattttaattctagtttctttttgaatctcacgtattgtctctcttctttcagctctggatgagggggatattgccttgttgaaaacttatgtaagtcctttcagtgtctacaaactatagatgttttatgttgaaataaaaactgttttggtattgtccttccaaaataattagaagaagttaagaaaccaaaaattaaaaaaccaaacaaaaaataaaataaaaagaaacaattagaaaagaatgtctggcagcttctagtaatcttcactaaatgaagttacctacctaaagtttatagaatagatcaaagtatttggcatgtctcagtttatgtattattttaatactattcgtgattaaaatgtgatgctatattgaaagatatttgaaatcatttacacaagtttactatatttaacaagtattactgaattagttctgaaatgaagttttaatgcatagaaatcgatagttttgcataatttcacacacgattttttttttttttttttttgaaacggagtgttgctcttgtcacccaggctggagtgcaatggcgcgatcttggttcactgcaacctccgcctcctgggttcaagcgattctcctgcctcagcctcctgagtagctgggattatgagcgcccaccaccacgtctggctaattttttgtatttttggtagagacagggtttcatcatgttggccaggctggtcttgaattattgacctcaggtgatccacccgcctccgccccctaaagtgcagggattataggcatgagccaccatgcctggccatgattttcatttgttatcttgcataatagtggattgtgtatttagggggaaatattgggtcaggaatacctctctacttcacaagctttgggataatgatagctattgaaattgtaacttaaaaataatttttacctgtagttttaataaatggttgatatcctgatattctaactaaactgaccttcatcacctagggtcagagcacttactctaggcagatcaagcaagttgaagatgacattcagcaacttctcaagaaaattaatgagctcactggtatgtatttttaaattcccatttccttcctttaaatgtaatgtgtgaataatatcaagagtttaaatacagattttactccttcatgattacagatttaaaaaaaatcattattcttcctttctgttaagaaattagatctcatttaaccatatctttcactgctttttacaaccaggtttaatgcttatgcagttaagaaataagaaatagtaccatcttctaagccagtaatatttctgttggtcaaaacccagttcagtaaacttcagttaacaagtcaaaaaacttttttggataaaaataagatctcacaacatagttttgcttcaagtaattgggctctttcctggaactttttggggggaacttgaatgatgaagttttataatatttgacctacacaaaaatgtcaaatgtggcattatatttttggcttgacaattactttagggcagggtgtagttttcagctggggtgattttgccccaccctcccaacccctcccagaggacactgggcaatgtctggagacatccttgattgtcatgactttgagagagggtggtgctgctggcgtctagtggtgagaggccagggatgctactaaacagtctataatgcacatgatagtcctcacaatgaatgattcagtgcaaaatatcagtagtgctgaggtttagaaagcttattatagggtgatgcattacattttagtaaattttgtcatctttctctatgtaggtattaaagaatctgacactggcctggccccaccagcactctgggatttggctgcagataagcagacactccagagtgaacagcctttacaggttgccaggtatgcacgggtgctctgtggcaacttacctttgtctgtattttcaagcacttaatgttagagtctcagggataatgcaatagttcataaataattttgattccaaattccaagtaaataaagctttctacaaaactggggttaaaattttatgccttaaacaattcttcaaaaatatatgaaggcataatcatttaaaagatttaaatgatataaaaagatgtagagcaagaaatgaaaaactcccttctcatacttgctttcccgttgccctttcctcaaacgtaactactgaaatagtttggccctcgtaatcctctgtgtatcttcctgtatttgcatgcaaagaaacatatcctgatttttttttttttagatataactacatgttttgggaatctttgtctttaatataggtatacttatttcttttttcttgtgtttttaaaaaattgcaaaaattgcataatgtgtagatgttaggctgtaacaatttctgttactatacacagtgctgtagtgaatattcgtgttaaatgtttctcagtgtatgtgcatacatttctgtaggctagcttactacaagtggaattctaggggtcaaagatattatagttttaaaatcctgtgaaaattactttggccagtttatacttttaccaagaggctttgaggcaaatgtccatttgtctgatcaatgtaagatacgcagttttcaatttttacacttttgccatttgagggaaaataattttaatttgtactgtgttgattactagtatgatagctacttcttttgtttactaaacatctgtatttctttgactactcatgttttgttcttgggttgtttcttgttaattttagaaacagttcatatattgtacatattgtcttttcttaagtatgctacaagtatttttccctagtcacttttaacttcttggtaccttttgttgtactaatgttttacatttttaggagataaaatataccaatatttccattataccttttgggtgttaatgttgcttagaaaaacctagcccaattcaaggctataaacatattctcctctgtttataatccttttaaaaattttgtttttatttttagttcctaaaagctaaagattatttttatttcccatctactcaccctccctacttcacaatttccatcttttctcacttttatttattcactcactttttagttttatcatggtttttgaagggttaaatagttcaggctgggcacggcagctcacgcctgtaatcccagcactttgggaggcccaggcaggcagatgacttgaggtcaggagttcaagaccagcctggtcaacatagtgaaaccccgtctctactaaaaatacaaaaattaactgggtgtggtggcgggcgcttgtaatcccagctactggagaggctgaggcaggagaatcgcttgaacctgggaggcagaggttgcagtaagctgagattgtgccactgcacttcagcctggggtgacagagtgatactctgtctcaaaaaaaaaaaaaaaagaaaagagttaaacagttaaataataacaactgtatttcccaatttctcttccctaatgacactcattttcaccttttttagctgattattttggttttcgtcttcatggttctaatggatattgctatatcttgtgtattatagattcctacttcttgattttttagttttaggtattatcttttggctttccatcatggaagatgaggattttgttttgtttcctctgccttcaccttgaaggcacacctttcctatcccctcatccttcctatgtaattctgttataattttggttagatcagtattcagtgtttatatgattatggctatgtaaacactattcacaaagagccaagtggtaagctgtgattgcttttcctttcttgtaccacttcttttagtggtggttgttataacgtcttgttttttcatttgcctggttttctgtgcatatattatgaactcaacctcccactttctcttgattgtctaaactgctcttcagatgcattagatctgttcgttttctctcagttataccttagttgcatctggtgttctctcggtttcattttccttaagtttttcccagcaccttctgacctgctttggtttggaccagttgtcctttatgcctgtttaatgacaattgttgtctgacttctctaccctggagattgccctttacctctctcctgttgcttggtctaatacatcctctggtagcttcttggaaaagggtcagttgggaggtaatattttgagactgcatatgtctgaaagtgtcttagctgagtatacagttcttttcccttcaaaattttgaaggcgtcgttctgttgtcctttgcctcccagtgttactctgaagccattctgatcctcagtcctgtatatgtggcctaatttttctctgaaaattgtagagtcttctcttgttctattttgaaatttcatggtgatgtgccttggtgttggtctgttttcatccattgtcctgggctctcttgtcctttagtaaggcaaatcttcttgaaactatttgttaatttctttccttccgttttcttggacccttattcctgaattctcttatttggatatggggcctccaggattgctcctctaatttgctaatctttccttcctgtttttcttctttttgcctttttactttactttctatgagcttttctttatctttgaatttttctgttgatgtttttttcctcccatttttcttctcgtaggtttttaatttctcaggtaaaaaaactcaggttttttatttcaaggctcttatctttattctttcatttttgtgtgtgtgttgaatgttctgctcttatatcatggttgtaatatgttcttatctctctatggtaaattaaaaaatctaggtacatttttctaggccgtatgaggggaattttcttttttctgtaaagcagttagagggaaacttttcatatagatttttcataacagacagactagctaaagagccctatacccctacaagatcccaggccttaaagaaagcaaagattattttgaaaaagtttccattgattttagtctcatactctttgcttaaaactcttgataaaatttgtgtatgtgtaatttttagcttgtgaatttttttttttttttgagacaaggtctcactttgttaccaaggctggagtgcagtaacatgatctcagctcgctgcagcctctgcttcctgggctcccacctcagcctcccaagtggctgggaccacaggtgcataccaccccatgtctggctttttttttttttttttttttttttttttttttaatttttagtagagacagggtcttgccatgttgcctgggctgctcttgaactcctaggctcaagccatctgcccaccttggcctcccaaagttctgggattacaggtgtgagccaccgtgcccagccagcttatgaatttttttaataacaatcttactgatataaaattcagatatcatgaggttcactcttttaaagtatacaatttagtgatttttagaatatctagaaaattgtgcattgatcatcactatctaattccagaatagaatatttttgtcaccccaaaaacaaacccaatacccattagcagtcttcattcccgtctctttccagcccctggcaaccatttatctactttctgtttctatgaatttgtctatcctggacatatcatctaaatggaatcatatagtacatggcttccttcacttagcatatttcaaggttcatccgtattctaaaatagatggaacttttatggccaaataatattccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctaggcatggtggtgcatgcctgtaatcccagctactcgggaggctgaggcaggagaattgcatgaacccaagaggtggaggttgcagtgagccaagatcacaccattgtgtttcagcctgggcaacaagagtgaaactccatctcaaaaaaaaaaaaaaaaaaaaaaagaaaaacggatttaaagtataaactcaggaaaagaatgaaaacccatttattactgaatttggtgtaagacaagatgaccatctttttgtagggaaaataaaaacgagagcaacttaagatatacaggagcatcactaataataaaggaatacaaactatggaaatcaagaaatcagagaacttcttaatgatgagatatttgggtttaattttccaggagaatgtatttgaaaattttatgacttggctaaagtcgaatggacctttggagttgggtatagaaaaggatctttaacagtgtcccagtttctgtagttctagtttatacctgtatattgcacactcaggatataatctagttagttgaattcattattagtggcttaggttccttattctaatcaagctttttgctgtgttaggtgtacaaagataatcaatgctgattcggaggacccaaaatacattatcaacgtaaagcagtttgccaagtttgtggtggaccttagtgatcaggtggcacctactgacattgaagaagggatgagagtggggtaagatttctatttacaataaatacttttctttcactaaggatactgtctcacattcatatccttggctttgtagtgaataaatggactgagttccttggaataccaaaggatgatctagtaatgtactatagttgaaaattctgtcttctgcatctgcttcctaacttcccatcggcttcgctgactcccctactcccactgttgtttattatgaatggcttcaaatttcagagttgaggttaccagtccatttaaggtaacatggtataggttgggggagtacttgctttaggatagttgtgatgctaagtgtgttaatgtctatagaatacataacaactcacttagtaaattaaaaaaaaatctcccctccctcctcaaaggtttgattgctgttggataggttgtttgcgacattagacatgtagtttagtatcctcagatttcatgctctctttatttctctttatataattagggactctgtctctctcttgttttcttaaagtatggttttggggataaaggactaaacataaaagcactttgaaagcttaaagaatgtattaatgactatcttttttacttccttagcgtggatagaaataaatatcaaattcacattccattgcctcctaagattgacccaacagttaccatgatgcaggtaagaaactatgggagggaaaaggaaggctatgtctttttttttttttttttttgaggcggagtttcactcttgtccaggctggagtagaatggtgtgatcttggctcactgcaacctctgcctcccgggttcaagcaattctcctgcctcagcctcccgagtagctgggattacaggcacccgccaccacgcccagctaatttttgtatttttagtagagacggtgtttcaccatgttggccagactggtttcgaactcatgacctcaagtgtttggcctgcctcagcctcccaaagtgctgggattccaggcgtgagccactgagcccggcagtattttatatatatattttttgagacagagtctcagcctgtctttattttactagtttgtttttcattcattagtgtcataacaagttaatacagcaagtagttccagggcactgggcaatgtattcaatttttattaaaattctcacttgtgagtttttcttttaaggtattaggtctattctattgaatttggacagtatccaaaaagcctgtgactgtatgttgtacatttctgtccctctcttaggtggaagagaaacctgatgtcacatacagtgatgttggtggctgtaaggaacagattgagaaactgcgagaagtagttgaaaccccattacttcatgtaagtagctgagtgttgtatttaaatttctttgtataaagatgtcttttgtgtattgagcactaaaattgcttgtatattagatggcttttaatattttccctaatgagagttttttgagagggtggagagaggaggtgtggagagttggtaagttctaggggagagcaagcaaaaaggattgagtggtcaggtatatttaaaaaagaaagatctgctgtttacagtgacagaggaggcacagtgtaacctttagcaatatgttaaatatgttacaggctattatagaagaaactggttcttcaaaagacatcgagaagaaaggggcttaaattgaagcaggttaaacttgggaggataatggaaaactaggatactgaataccagataattttgttccttaaacaccataattttttttaaattaggaaaatattttaagactggataatggaagtgctttttaaaagccatttagtcttatgtattgatagaagtccagtttagaacttatgtcttagaataagtaaaatttcttatttagttcaagtatgtatattgtggacttaataattttgatttaaatattaaagtatggttttcaggataaaatactaaacataaaagcactttgttgatttagaagtagtctgatttttgttatacagaagtggtaagtgtgaaaattgtgtctctatcacagccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgaggtaaagtaaatttatcaaagaatatatagccttgtgaaagattttacagtatgaatgaaattaaaaatggcacttctgcattgagggatccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatagatcagatgctcttatttactcatagtttactaattagaatggttcctttatttaactattaatttgacctcttcagatctgaaacctattgctattcaatagatacagaatcatgaaaatgacttaatattttaaggctggcaagattaatttggtggactggggagcaaacttcagtcttttttaaaaaaagtttagataggccaggcacggtggctcatgcctgtaatcctagcactttgggaggcagaggcaggcggatcacctaaggtcaggagttggaaaccagcctgaccaacatggagaaaccccgtctccattgaaaatagaaaaagccaggtgtggtggcgcatgtctgtaatcccagctcctcgggaggccgaggcatgagaatcgcttgaacccagaaggcgaaggttgcactgagccaagatcgtgccattgcacaccagcctgggcaacaagagtgaaactctgtctcaaaaaataaaattaaaatagctgcgcgcagtggctcacgtctgtaatcccagcactttgggaggctgagacgggtggaacatgaggtcaggagttcaatgccagcctggccaagatgctgaaaccccgtctctactaaaaatacaaaaattagcggggtgtggtgacacatgcctgtaatcccagctacccgggaggctgaggtaggggaatcgcttgaacccaggcggcagaggttgcagtgagccgagctcgcaccactgcactccagcctgggcgacagaggaagactccatctcaaaaaaataaaaaaataaaaaacgtttaggtaataatgggtgagaatactgttaggaataaatattgaaaagtttgaagcataactttttacttattttaaaatattttgaaaccaattttgaattaataaatcatttttctcattagggggctcgaatggttcgtgaactctttgaaatggccagaacaaaaaaagcctgccttatcttctttgatgaaattgatgctattggaggtgagaatgatacgttagagaactgctttaggattcagtttcatgaaagctgtaaagtgatatgtcgtgatatgttaatcttgtacagaattttaactccaactcttctatgagctctgaaacagtggcgccacagatctaataagtagtagtgctaaactataaaggcaagaagacacattatataccattgtcattttttcaaagcctttatttttgtgctatgggttgaatatcccttagccgaaatgtttgagaagtgttttggaattcacatattttggattttggcttttgaagtacttgcattatactgattgagtatcccaaatctgaaaacctgaaatctaaagtgctccaatgagtattgcttttgtcatgttggtgctcaaactttcaaattttgaagcattttggattttgcatttgcaaatttgggatgctcagtctatatctgatttcattcatacaacacctatttccatactttaaacaactcgtaaattgagaagtatcatctaatgtcataagaaagcactggggcataatttaattgatggtggtttttcttagtgcacataaaataatgttcttgttggcttcacagatttgatgaaatacagtattagccatgaaatctagacttttttttttgttttaagaaacagtctcactctgttgctcaggttggagttcagtggcatgatcttggctcactgcaacctctgcctcctgggttcaagcaattctcatgtctcagcctcctgagtagctgcaattacagatgcctaccaccatgcctggctaatttttgtatttttagtagagacgtggtttcaccatgttggccaggctggtctcgaactcctgaggacaagttattttaactaatctctgagcctcagtttgctcatcttataaagggaataattgttgtcttgtgtacttcatgagtttttgagaggtccaaattaagtaataaatgtggtagactttgaaaacactaaactgccccataggcagtttaaaaaacgttaagtaaatctgtgatgaatacttttgaaagcaaagattcactttctaattagttttatataaagcaagctgttcttacaggatttgcttcaaagtgggatgtcacttgtgcctgaggacatgatttgagctgagatttttggtactttcaggtcatgcatagtgctactcttgagtggacttgaagagcttatctttccttttgtcttctcaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagaggtaagaaaaccatttcattttaggaaagggatttttgaagttttttcttcctgtgatttttttccattttaatatttgtcaattttctcatttttagggtcggacccacatatttaagattcacgctcgttcaatgagtgttgaaagagatatcagatttgaactgttagcacgactgtgtccaaatagcactggtaagtagaaagttcttgcttatatttgctggtctgtctgctcaggctgctttaattaagcccgtttattttctttttgtttgaaaggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttattaggcagaaaagcttgttagaatatattttgactatttttttgacccacacccgtttaaggatttcacatcatacaaagcgcttgcttagatggcttctatcctaggcatatgctggccgggtgctctacatataaattctcattgtatcctcccatctgtccactgaggaagattatcaaatggatcttcatccaatggatgcataaactttcctacttacttgtagtggcaaagctggctttcaagtacaagtttgttggctccattacctatgctcctattatccgcttctgtcccgcaacaaagtagctcacttaggcgtatgaccacatgcattatgatagtttcccaccaccatattgaataataaaagctttggccaaagcttttttaaagtaggagaaacattggatgtatatgttttgcattgccatttgatttcaaattaatcaggaagaattagtgattttaatgagcagtaaagtggtgcaataaagcagaaagaaaaatgttcagccagaagtgaaagactagtaaaaaaagaaaaaaaaatatttgtacatatgatctaatttagaaagtccagaattggcttcatacagaaaagtgattactttcattttacaaattactttaaaattttggtaaagtttctgttaggcttctggtctacagtgaggtattttaaaaataaaggttatattagaatcctcaacagatctctttaaaattacctcctgtgtaaccaccaccaaatcctatcttctaccacaattaccccttcccccannnnnnnnnnnnnnnnnnnnnnnnnnnnnnnnnnnnnnnnnnnnnnnnnnnnnnnnnnnnnnnnnnnntgctttgcactgaaatacttaaaattatgaaagttttcaagtaaagtaaattaaagccttttataaaatccaaccaacattcttgatttttcatttttatgaacttgatcagaaaaattcatcttttttaaccctgccctaatttttcttgaggaattaaatagagcaaactattttcaggttatgcttacaataaaatatacttaagaaaatgactgaagatgtatgtttttgaatgttttgattaaataaatgtacacatttagaacacactctgaagtctttccactttgtcatggccacgtgctcatatataccaattaaagacaactcgaattagataatgttgagcacactctgttctaacgatacagagtgactatcgtgataatttaggtccataaggaaaatctaatcggccacacatcaaatgtaaaatcaactactttaaaaatttgggtttttctgtcaaggcatatttatgcaggtagcatcaacattgcctaggtcagcatgtttgtactcaaagagatgaaacagacatttaccagtaacttcctccacctaaaatagatgtgtctatatacatgtgtgtagatgcacatatatatatatacatgtgtcagggtgctgataagttagaatacaaaggatttatgactttagaaaaatataccgtagaatcctgtttaaaaacttcttagtgttaaaaatgtgattaggtgtattaaaaaactccgttttcatgatgcttctgaggtttatctgttacgtaaagtgaaatgcaatacaccagtataatgaaaagcctggtacagctttctcaaaggccaggtggagttttaagatgctcaaacttgataaaatctaagtcactaagcaggcacgttacctggtgtggtgctaacttttaccgttgtgttgctgggattggaggggtttcaaaaccattgcatgcattttggttagctgtatgtttgaagaattcagtaatacttttatagttctcaaacttttatgagcattcaaaacagtaagaatctaaacatcgtgaatcctaaaggcactcctgaaaggtaaggt

SEQ ID NO: 17543 - DNA, 36546 bp, Human
cacacacacacacacacattattcagccttaaaaaggaatgaaattctagtataagctacaacacagatgaaccttgaagacattatgctaagtgaataagtcagtcacaaaaaagacaaatactatatgattccacaaatatgaagtacctagaggtgtcaaattcctaaagacaaagtagaaggatggtttccagtggacagttttttccactggcatagtttcagttttgtaagagattaaatgggtatagagtttcagttttgtaagataaaaatagttttgtagggtggttacacaataatgtgaatgtacttaacattactgtaaacttaaaaacggtgaagatcgtaaatttcatgttatgtgtgttttagcacaatttttttaaaaaacaaaacccccgaccgggcaccgtggctcacccctgtaattccagcactttgggaggctgaagcaggcagatcatgaggtcaggagttggagaccagcctggccaacatggctaaaccccgtctctactacaaatacagaaattagctgggcgtggtggcacgcacctgtaatcccagctactcgggaggctgaggcaggagaatcgcttgaacctgggaggcagagattgcagtgagccgaaatcaggccactgcactccagcctgggcgacagagcaagcctctgtctcagaaaagaaaacaacaaaaaaacaaaaacccatgttagagttaatggtaaaattgaatgggaggaggtgtgaggaaaaaaatatattaatatgaagaaagtggagtcaggttactttgcaccttggagcatgttttaacagtggttgcattagtagggatcaggaagaggttttggggcagaagattagttcaatttttttttttttaaagacggggtctcactgttacccaggctggagcgcaatggtgtgatctcagctcactgcaacctccacctcccggcctcaacgatcttcccacctcagcctcccttagttcaatttttgaaaagtcagttttgaagtgacaattttatcatgcagcagatatacagaccaattaaatgtatttaattggcctggcacagtgactcacgcctctaatcccagagttttgggagactgaggcaggaggatcccttgaggccaggagttcaagaccaccttgggcaacatagtgagaccctgtctctacaaaaaaaaatatacatatatatatatataatatatttaaaaactttaattgtgaaaatataatgaaattagtaagttattttctaatttactaatttctggtggtccttgctaaagagtggcatatcaagtttattttattgaacctgtttcagatactgctgttgggggtgagcctttacccactgtttgtttttgctagtttttgcttttgactgcagtcttagaaggaagcatatagtaggaatacaattgattttattatacattaaaaaattaagtcccagagtcctataattgggaatatcttgaataaaaacttcattagaacaaggtaaaaatattgctggccttggaatacaatctaacacactagagagaggtttcttctccaagcgagtattaaaagatataatgcaggtaaattagtaatagcacgacaaatattagctgctattatcatcatcaagttaaacacaaatgtatcacaaatacacgtacgtaattctccgcaaatgtatatactagtcgtcgatactggttcatacaggtattttcattttttacttaaaagtatagcgctcctgggaaaatcactgattaggttcagattaatacataaagcagtaagaacttaaagataatataaaaagaactgcttttaaaggttatgttctatgtattgcactgggacgtggaatataatcctttttacaggaaaactgatgcgcctaggaaccattctctcgtgcgacttggtctccagccggatctcagtcagtatagaactaggttaccgcacacgttggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctggtaagtgcccacccaacctcggttccttctcacctcagctgcccctgcctcagtcctccgcctcggcaaccctgggctctctctacccttgaccctggcgactagccccggggccgtatggggccgtgacgagtgcctttttgctccgtgttttaaagtaatcctaccctagattagaaggaaggagggtgaggggtgccttccttttgctcctaccgttgcttcctcctctcgccgctgctgactcatggattgggctgagcatttcgggacggaaccccccagcaccccagaaaggttctcataagcatctccttgcctacggtggaaagactacgcgcagcgagcaccccacgtgcctggggtcgtacaaagctttgctactggcgctctcttaaacaactttctccctctctacgtttgctccggccttgttttttaaatgtcacaactcagacaccgctcctcatactcggtgttcaaagactgtgctgctgaaaagatccgcgtagactttgaaaggcagttattacaagtgaaacttgtcctgctgctgtaggttttagttttatggcccaggacagtcatgagtattgtaaacttaagagtcttcaggtccagtgatctacagtaattcccatagccagtcacataggcgcttgttgaatgtgattttgaacataacccatggcacgtgttgcatttatgtgtctccgtgtgcctcttacaactagagcaaaaggcttaaaaggcagtgttcttaaaagccacacacccatactacacaggtagtacctttttgacagtgttttaatcctctcctgtgtaaggtggaggaaatcttaaaataagttgttcagggattttccttttttgaattgctagtatacacatgtacagtgatttacccccacttcccaggaatagatgatacctttactacaagtttgtaatttcagagagtttctgtggtctcattcaagcttcctaggaactgaatgagataaataggtattgttcccattttacaggtgaagacatcctgattcatttcaggtcacatagccactgtcagacctagtctaaaacccagagtgtctggtttcagattgagagcttgttccactacagcttagctgcattagtaaattcccatttgctgcttggaaaattgctttcaggacaaattcttgttagtgaattcttaaaatttttaagagctatattcaagattttaataattaagacagtttgagttgtctgggtgcggtggctcacgtctataatcccagcactttgggaggccgaggcaggtggatcacctgaggtcagcagttcgagaccagcctggctaacagggtgaaaccctgtctctactaaaaatacaaaaaagtagctgggcgtggtggcgggcgcctataatcccagcaacttgggaggctgaggcagaagaatcgtttgaacccgggaggcggaggttgcagtgagccgagattgcgctattgcactacagcctggacaacaagagcaaaactccgtctcaaaaaataaaaagatagtttgagttgtttttagattttttatttttggtgaggctagctcttcgtgacaatttatcactatttattactttattaaaattatttgtctaggccgggcgcggtggctcacgcctgtaatcccagcattttggcaggccgaggtgggtggatcacgaggtcaggagatcaagaccatcctggctaatatggtgaaaccccgtctttactaaaaatgcaaaaaattagccgggggtggtggcgggtgcctgtagtcccagctactcgggaggctgaggcaggagaatcgcttgaacccgggaggcggagctttcagtgagccaagatcgcgccattgcactccagcctgggtgacagagcaagactccgtcccaaaaaaaaaaaaaaaattgtccaggtgggtgcagtggctcacgcctgtaatgcaaacactttgggaggccgaggcaggcagatcacctgaggtcgggagttcgagaccaggctgaccaacatggagaaaccccatctctactaaaaatacaaaattagctgggcatggtggcgcatgcctgtaatcccagctgcttggaaggctgaggcacaagaatcacttgaacccgggaggtggagacggcattgagccgagatctcgccattgcattccagcctgggcagtaagagcaaaacttcatctcaaaaaaaaaaaaaagtaaaaaaataaataatttgtctaaaagtaaagtagtttgcaacatttcttcctgttcctcaccttactcatatccccaaaaaagtactgatttatcattgacattactgagttttttttgttttgtcagataactggaagaggttgattaaatactctttaatactaggaaaggataatttcttgctaaccctcatgtaaactggatgactgcaattattttcgtagtcggtggttttaaaagtatatgctggtatcactgttttgattttatttcctgaaaaaattaattgccttgaaacatatttattccatgcgatacactgaagcctctcttaacactttcaatcacagcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaaggtatttaatatctgaatattttgttcagtcagatgctttgttagacatagacaattttcttatgagttttccattaataaacatgttttaagatgattcagcaagataactatgatttagcatctgtttattactaagtcttgagagcattagcactagccatgagatactgtctctgctggagaaatccaggaagagttcacagaaaagataatgtttgcaccggtcttaaaaggacaggcagcaattagtgaagcagagaagtgagaaaagtattctgggcagaaggagtaagatatacaaagacacaaaggagtaaaagaatatgtagtgcctcttgaggaattgataagtcgtatagggtacatgcggtatggtgatgagaaatctagtgtctttaaaaggacactagaccaaactctgttgtgtcctttttataccatgctaaagaaggaattaaaatttatttttgggacagtaagataccatcaaaagtttcttagctaattttagaaaagtaattcccttggcagtacaggaaattgcttgaaagggggcaagggactggaggggaagtgaatagtttactgttatagggctagtgcactaaggcagacctgtgactgaatccttgaacttactatgtggctgggttttgaggaagaggggtcagatttgccttttttggaggtagcattaacaggctttggtgaccctggctgtgtggcacaagacaaagagaagtattcagaggtccttcccagcattagcgcttgagtgacctgctagagtgtgtggtcagtaaccaatgctgggatgaggataagaatgtttgtgggaggtgctgtttgtgtccaagtttgactatgtgaagactgaggttttggtaccatagtggtgaagctgtctagtagatggttagaaattggtctatgactccaaaaagaggttacagccaaagactttttgaagtcattggcacatagtggtggttgctgtgaggaattgaatgacaacagcaagggacaaaagtataaacaaatagataatgctttagtaggtacttgtataatagttaaatgcgtatgctgtggaattggagtgcctgaattcaaatctggttctgccatttggtgcacttcgaccttgggaaagttcccagatatgtgtgtacctcatttcccttgttgctacagtgagattgttaacagctcaaaggtttaccttgaggattaataaaaggatgcttataaagcacttaagttagtacttgctgcatgataaatgccaaacaaataatggataataagagttcctatgtcattggttgtttagaggactaaataagctaaagcatatgtataaaacatttagaaaagtaagcactcagaaagtgttagctgattctcccaccacctcatccattttaaaagaaaaagacaacattggggagcatggatatttaaggggtaggaagaggaggaaaaacagcagaagatactaagaagggtgacagaagtagaaagaaaacaaagaaaaagacactttgttatttgaagaaatacttcctaaacatcaggcagcgtattcttccagaaactaagggaggagcaagagggaaaaagaggcagggtgcagtggctcatgcctgtaatcccagcactttgggaggctgaggcgggcagatcacccgaggtcaggagttcgagaccagcctgaccaacatggtgaaaccccatctctactaaaaatacaaaattagccaggcgtggtggcacatgcctgtaatcgcagctacttgggaggctgaggcaggagaatcacttcaactcaggaggtggaggttgctgtgagccgagatcatacaattgcactccagcctgggcaacaagagcaaaactctatctcaaaaaaaggggcgtgggaagagtcacctgtgtcactgcttcagaaagaggtcaatcacataacatgaaaaattattttaaaaaacactggaccgggcatggtggcacatgcttataatcccagctactcaggaggctgaaacaggagaatcgcttgaacctgggaggtggagattgcggtaagctgagatcgtgccactgcactccagcctgggcaacaagagtgaaactccatctcaaaaaaaaaaaaaaccattggatttggcaaactaaaagtttcggtgtcctcattgaaagcagtttgagtaaaatgatcgggaaggcaagagattacagtgaatgaagagtgattaggaagtgatgaagtaggatcaaagtgtaaagtactctttcaaagctgggtagtaaagaaaatgagagaagatagtaacttcaggagaaggcagagtcgggaaaagacagaactggggagtgttgagatctataagagggagaaggtctttggtatagaaagaagtagattgtatcagagtaaggtagcagagttcattcacttgttcagtttattttcattcatcaaatatggatcaaacaccatgtcagatactgttctaggtgtcaaggatactgtactgaacaagacagtattactgcttacacacagcttatattccagtgacataataagtaaacaagaacatgtagccataagttccataggatggccataagctatcaacaggtgctaagagaaaaaaggggtctttggtcaagtaagtttggaaaatgctaggttttacaggtttctgtttgtttattttttaaatctaattacaggacttctcagagcctttcttaggcctttgtgcatacaaatcatcaaggaggctgtataatagtccacatttacctcttttttaaatttattttttattttattttattttggagacggagtctcactctgttgcccaggctggagtgcagtggcgcagtcttggcccactgcaacctccgcctcccaggttcaagcaattatcttgcctcagcctcccgagtagctgggattacaggtgggcgccaccacgcccggctaatttttgtatttttagtagagacagggtttcaccatgttagccaggctggtctcaaactcctgacctcatgatccacccacctcagcctcccaaagcactgggattacaggcgtaagctggcatgcccagcctgtctcttcttttttttaaagacagggtcttggccgggtgcagtggctcacacctgtaatcccttggccctttgggaggccaaggcaggtatatcacctgaggtcaggagttcgagaccagcctgaccaacaaggtgaaaccctgtctctactaaaaatacacaaattagccaggcgtggtggtgtgcacctgtaatcccagcaacttggaaggctgaggcaggagaattgcttgaacccgggaggcggaggttgcagtgagccaagatggcaccactgcactccagcctgggcaacagagcaagactccgtctcaaaaaaataaaataaaatcttaaaatcattaaaaaaaaaaaaaaaaagacagggtcttgctctgtcgcctatcctggagtgcagtggcatgatcacagctcactgcagcctctacttactagactcaagtaatcctgctacttctgcctcctgagtagctggaactacaggtgcacaccaccacacccagctaatttttaaaaatttttttgtagagacagagatcttactttgttgcccaggctggcctcatattcctgggctcaagcaatcctccacctgggcctcccaaagtgctaggattacaggcatgaaccatggcacccagcctaatccacatttctcaaccttacctgaccatagaccctggtttatacagaacctcttactggactcctgatgaaatgtcactttgggaaatgcttattaaggtaccagaacacaagggatggaatatattggcttcatttcaaatttgactcccttttgtgttttttttccagaaccaagatcattatgcagttcttggacttggccatgtgagatacaaggctacacagagacagatcaaagcagctcgtaagtacttagttattttgaaataatcaaatatcttgtataggaacaggctggctatgctttttaaaagatatacagtatcatagtctgcagccataactacatttaacagcatgtgttatattgtcataacaagcaaaaaaccacggtctcccctgccttcagaatcagaagaaagcaatccattttacatatagactttcccattagggataagaaattaggatgggtgtgtgtgtgtggatacaaaatactcctccaatggcaagcttttaaaaaataatacttcacctctctttagaagtatagcagctgcacttagtggatactgcctttttattgttttttggtttttggtttttttttttacgttattttgtaatcttaggtcacacctttgtagatatcaccctgtcttctgtccaagaaaagttgtctgatgttttattgttgttttcattgacaaggttataatttggcatgggagagggtaatgttgggaccccagtcttcatatgccttataaaacaccatcccttaatgctcctaaatgtcctatgctttgcaatcctgtggacataatttcttatacacgtgatcagttcaactgattaataaagtttagtgaaagaggtaagaggtgaaggtgatcagttttctatcttaggagaatgttctgccctccactctagagaatggatattgaggtcagagagggtaagattgtggccacatggaaaaggagcagggagtcagggcctgtcaagaagaggaagtattatatgtggaggaagatgactgaataagaatgcctgtggtaaaaattattagtcaatacttagcatagtagatgaactcaaaatcgtccccattactgcttacatttaggaaaatcacaggaaatattttttaacaaagtgaaggaatttatcagattattttaaactggatttgtttaaaggctggcatgagtctagacaaagcatatggtaatgcatgtgaatagttattccagtataaataaatgccagaaaagtccatttgccacgtacaagtgtttgcaaagttttactatacgaaagaatagcattggccgggcgtggtggctcacgcctataatcccaacactttgggaggccgagacgggttgatcacctgaggtgaggaatatgagaccagcctggccaacgtggagaaacaccgtctctactaaaaatacaaaaaaattagctgggtgtggtggtgggcacctgtattcccagctacttgggaggctgaggcaggagaattgcttgaacccaggaggcagaggttgcagtgagccgaggtcgcaccattgcgctccagcctgggcaacaagagcgacactctgtttccgaaaaaatagaatagcatacaaataccaaatatgtcttagtacagataaatttgttaattagaattgataatagaactgtgagaatagtttgtgttttaaggtgaaagaattctttctcagaagattaaaaatgtgcaataaattgtaaaagaagcattcatatgcttctgttaaatccactgtctttttttgagacagaatttcgtacttgttgcgcaggctggagtgcaatggcaccatcttggctcaccacaacctccgcctcccaggttcaagcgattctcctgcctcagcctcttgagtagctgggattagaggcatgtgccaccacgcccggctaattttgtatttttcatagagacgggatttcaccatgttggtcaggctggtctcgaactcccgacctcaggtgatccacccacatcggcctcccagaatgctgggattacaggcgtgagccaccgcacccagcctaaatccactctttttattggccttgtagaaattgatttttagccaggcacagtgggtcacacctgtaatcccaacactttggaagaccaaggcaggcagattacttgaggctggagttcaatactagcccggccaatgtggtgaaaccccatctctactaaaaatacaaaaattagccaggtgcggtggcgcatgcctgtaagcccaactacttgggaggctgaggcatgagaatcgcttgaacctgggaggcggaagttgcagtgagcgaagattgtaccactgcagtccaacctgagcaacagagtgagagagtgagactctgtctcattaaaaaaaaaaaaaagaaagaaagaaagaaaagaaattcagcttttgaatatgtattctctagccaaaaattttgcagcaccagtgtagagattgttaacaataagggtaattctaacttactctctaccacccttgtggaatattccgtcagtctttatttagaaagaaactgtcattctctcacctctgtcactgtaaaacacagttgctactcattgctttctgaaaatctatctaaaagttaaaatgcaaagttactgtttgcaaatctataattattagcacaaacctaataaaaatgtaaatctggtaccatttgatgtcctttgaatgcttgcttcatattacaagcaaagttttatttttgttgagtatattttgaatgtcagtaatgaaaattaattaagtgtgaagtaggagccgggtgcggtggctcacacttgtaatcctagcactttgggaggctggggcaggtggatcacctgaggtcaggagttcgagaccagcctggccaacatggcgaaaccccgtctctactaaaaatataaaaattaggcgggcatggagacgcatgcctgtaatcccagctacttgggcggctgcggcacgagaaccgcttgaaactgggaggcagaggttgcagccagccgagattgcaccattgcactccagcctgggtgacagagggaaactgcctcaaaaaatgcccaaaaaaataccaaaaatatttgtcactgtttctgaacccttgcagtatatgttgaaataaataattttattatgctcatgaaaagatttctataggccaagcatggtggctcatccctgttaatcctagcactgtgggagactaaggctggaggatcacttgagctcaggagttcaagaccaacctggacaacatagcaagaccttgtctctcttttttttttttaattaaaaaaattttttttcaagatttcttttctttttttttttaagacggagtctaactgttatccagggtggagtgcagtcgcgtgatcttggctcactgcaacctccatctccagggttcaagtggttctcctgcctcattcttctgcctcagcctcctaagtagctgggattacaggcacctgccaacatgtctgactaattttcgtattttttagtagagactgggtttcaccacgttgaccaggctggtctcgaactcctgagttcaagtgatccacctgcctcagtctcccaaagtgctgggattacaggcatgagccaccgtgcccagccaaaagatttctgcaaaaacgttcacaacaggccgggcacagtggctcacacctgtaatcccagcactttgggaggccaaggcaggcggatcacgaggtcaggagatcgagaccatcctggctaacacggtgaaaccccatctctactaaaaatacaaaaatatcagctgggcgtggtggcgggtacctgtagtcgcagctactcgcgtggctgaggcagcagaatggcgtgaacccgggaggtggagcttgcagtgagctgagatcacgccactgcactccagcctgggcaacagagcgagactccgtctcaaaaaaaaaaaaaaaaatgttcacaacagcctattcacaatgtccagaaactggaaatcacccaaatatttaataacatggaaatagataagcaaactgctatatattttggtgcagtggaatactaatcagcaatttttaaaagaacaaattgccaatacacagaaaaacatggatgaatctcaaaccatgagtaaaagaagccagacataggcatactgtaagttacatctacttgaagctcaagaacatgcaaaagtggtgacaggcatcagaaaacggttgcctcagctggtagaggatgggagcccagtggaaaagggtacaagggaactttttggatgatggaaacggcctatattttcctttggatagtagttacataagtgtatatgattgtcagaactcactgaacttaatgaatgcttaaaatctgggcatttattttatctacgttttatctccgctgaatcagacagatatgattaaacaaaccaaaaataccagtcacttggaaattaaatatattcttttgagcctagacagaaataaaaattatgctaatagactttttttccacaaaagtaagattactgctttatcaaaacttaaggactggcagctaaatctgtaccttaagtaaattcattgccttaacctattctgttacttttttcaaaagagggaaaagataaggtggaaattcaattcagaggtttaaaagaatagcacaaaggaagatgtaggaagaaaataaataagacagtatcccaaactgggttttataagaagaataaacaaatacaagttgagcatccctaatccaaaactccaaagtccaaaatgctccaaattctgagtgccagcatgacacttcaaaggaaatgttcactggaggattttggcttttcagatttggaatggatgctcacccagtaagtataatgcagatattccaaaatctaaaaaaatttgaaatcccgaacacttttggtcccaagcatttcagatacaggatactcaaaacgtagtgaaatacagaaagagctaatcatggtggctcatgcctttgatcccagcactttagaaggctgaggtgggtggattgtttgagctctgtagttcaagactagcctgggcaacatggcagaaccccatttctacaaaaaatacaaaaattagctgggcatagtggtgcgtgcctgtggtcccagctgctcagaaggctgagatagtgcttgagcccaggaggtcaaggctgcagtgagccgtgatcacaccactgcactccaccctgagcaatagtaagaccctgtccccatcccctcccccgcaaaaaaaaaaggatgaaaaacattaaagttaccaaagaatttactcctaaaaacaatttttaggcccagataatttttcaggtgaattgtttcaagtgttaaagaattaaaaattctaatgctgaatataaacttggtgttttattttgtaattggagaatcggttaatcataaactgttttggaataattcattttgttaagttgtaaagtttaatgtaatctgagtatgcaaaacctagcaaagagagcccaaaaaatcctacaaacaattcctattaatataatgaaaaagaaaaaccagttaaaatgttaaaaataatagcaaattcgctgggtgcagtggctcacgcctataatccgagcactttgggaggccaaggcgggcggatcatgaggtcaggagatcgagaccatcctggctaacacggtgaaaccccgtctctactaaaaatacaaaaaaattaggcaggcgtggtggcgggtgcctgtagtcccagctactcgggaggctgaggcaggagaatggcatgaacccgagaggcagagcatgcagtgagccaagactgcaccactgcactccaacctgggtgacagagcaagactccgcctcaaaaaaaaaaaaaatagcaaatttaagaaaagggaatttttatacactgttggtaggaatctaaattagcatagccactgtgcaaattagtatggagatttctcaaaaaattaaaaatagaattaacatatagcccagcgttcccactactggatatttatccaaaggaaaagaaaacagtatgtcaaaggggtacctgcactcccatgtttttattgtggctctgtttataataacaaagataaggaatcaacctaagtgtccatcagcagactagttgataaagaaaagtatatgtatacaatgggataccactcagccataaaaaagaatgaaacgtctgcagaaatatagatggaactggaggtcattatgttgagtgaaataagctaggcacagaaaggcaaatattgcatgttctcactcttgagaacagtgggagcttaaaaagttgatctcgtggaggtagtagatagaatgatagataccagaggctgagaagggtattgggaggagagggataaagagaggttggtcaatggatacaaacatacaattagaaggaataagtcccagtgttctgtagcagagtagggtgatgatagttaacaatgatgtattgtatatttcaaaatagctagaagacagaacttgaaatgttcacaatacatagaaataataaacactcaagttgatagatacccaaataccctgacttgatcattacgtggtttatgcatgtatcatgaattatgcacaaaatgagccaggcacagtggctcacgcctgtaatcccagcgctttgggaggccgaggcaggcggatcacttgaggtcaggagttcaagaccaagcctggccaacatggcaaaaccctgtctctactaaaaatacaaaaattagctgagcgtggtggcaggtgcctgtaatcccagatactccagaggctgacaggagaatcgctggaacccaggaggtggaggttgcagtgagccaagattgtgccattgcatgccagcctggccaacagagtgagactccatctcaaaaaaaaaaaatggattttgttcatgtattatgaacaaaataatcacatgcaccccataagtgtgtacagatacttgtatcatgaaaaaatagtggtcaggcgtggtggcgcaggcctgtaattctagcactttgggaggccagggtgggaggatcgcttgagcccaggagttcaagaccagcctggccaacatgacgaaacccctcccctacaaaaaaaaaaaagagctgggtgtgatagctcacacctgtaatcccagcactttgggaggctgaggtgggcagatcacgaggtcaggagttcgagaccagcctggccaacatggtgaaaccctgtctctactaaaaatataaaaattagccgggcgtagtggcacatggctgtaatcccagctactcaggaggctgaggcaggaaatctcttgaacccaggaggcggaggtttcagtgagctgagactgtgccactgcactccagcctgggcaacaagagcaaaactccatctcaataaataaataaagttagcaaggcatggtggagagcacctgtaatcccagccacttgggaggctgaggtgggaggatcacctgagccggggaggttaagactacagtgagctgagattgggtgccactgtgctccagcctgagcaacagagtgagaccctgtctcaaaaaaaaaaataaaataacaaatgcaatttaatagtacactaaaagaataatagtgttcatgaacacatagagtttctctcaggaatccaacttaggaagtatattaatatagcaaaattatagctcagataatattaaatccatgtgatttcctgagtaggtagtgaaagcacatagaatacagtttaacacccattccgttttgataagaattttgaaaagaaatgtagttaattccctactttgataactgtttcaggcccacagctagcaaacttttagctatgtggcattaatgctattacctaaaatccaggggtgaagcagcctgctttttattttttatgctattttgggagtttgggtcagtgagttaagttattaaataagagacaactattggaaagaaggaaataaatatattatttgtagataatataggatctgcctagaaaagcaaaagagagttaagtgactagatgcaagacaaataagcaaaaattacacagtttttggaagttacgatcaaatatattagaaagctgtggtcagtttaaagataaccccagggcaagaataagtaaccaaaacaagcccttgtaaaatttactattatagtgtcacaaatcagtggaaaagggaaggattattaaatgacagtaagattttgaaaaatgagaagtttagatactttcttgactatattaaaattccaaaaagattaaaaaattttttcagtctataggaaatgttaatgaaactagaactattgtaagtactagaagaaattacaaaagaaatgatcagtcaatgtaaataaagatgactgtttttgaaacataagtgttaacaaaacggggaaaaattattaataaacataatgaattaggagaggcagcatacagacgcaggctgaggagtcaggctgtctggactagagccgacttggccggaagtttgagcaagttgcagtggtagtggctacataacgtctcctctgtgcctcattttcctcatctatgaaatggagacagcaatagcactttcctcataggatcatggagaagattaactggtaaacaggcctggcacatgtcaactgctatgtagatgttaacagctagcattattaattgtaagtgacacacagagtcagaagaaaaactgagacagcccctcctttttccagttaaaggatgaaaaacaaaaaaattgttgaccaccagcgataatcacaaattttaaataattagacgtactgtggctgaggctgtggtaaaaggatgttcacgtaggagtatgaaatagtttgccttttggaaaataacttgttccatttccattcatgaagttcacttctgtgattatatcctaagaagaaagaatcctaaataaggaaaaacacttacatttaaaattattcaaattggcattatttataataatgcaaaattggaaatggcacaaatgtccaacagtagagaaatgcctaaattataacaaatctacttgaaatactgtattaagcagtcatttgaaagaaaaatttgaagagtttgcaaggaaaaaaccatggaaaatgcaaacgctataatgtgaagctgaagaaagcagaatataaattagtacatacgattacatctgaattgtttttttcttcttcttctttttgacacagagtctcactctgtcacccaggctggaatgcagtggcgccatctcagctcactgcagcctccacctcatgggttcaagcgattcttatgtctgagccacctgagtagctgggaccacaggcatgcaccaccacgcccagctagtttttgtatttttagtagaaaccaggttttgccatattggccaggctagtcttgaactcctgacctcaagtgatcctcccagctcggcctcccaaagtgctgggattacaagcatgagccaccatgcccagcctacacctgaattttttaaagcatatgcttaagaaaacaaaaatgtctatgcagaaatacaccaaaatgttaagagtcattgtcgttggttaggggcactttggctaattcttaaaataattacttcaagccgggctcagtggctcacacctgtaatcccagcactttcggaggccgaggcgggtggatcacctgaggtcaagagtttgagaccagcctggccaacatagtgaaaccttgtttctactaaaaatacaaaaaaatagctgggcatggtggcgggcacctgtaaccccagttactccagaggctgaggcaggagaatcgcttgaacccgggaggcggaggttgcagtgagccgagatcgtgccattacactccagcctgggcaacaagagcaaaactctgtctcaaaaaataataagaagaaataaatcagtttctctataattttcacattgaataagcatatattttactgtgggagaaaagattctaatattagccttatgattttagaaatggtctacatgtagctcatctttatttttggtgcttaaagtgacaaattatctcaatctgactggttttgtagataaagcaatggttttaaaacatcacccagacaaacggaaagcagctggtgaaccaataaaagaaggagataatgactacttcacttgcataactaaaggtaagaaaatgctttagagtcaggaatttctaatagtaattgttatttattaattgctgggattgggtttcttatgcatactgtagttcattcaactatcctttgacattttaaaacattttagttatatcaagttctttctaatcatcaccccagagcctcacgacacaaagtgaggtgtccccagccagcagcatcagcaacacctggcagcttattagaaatgcagtctcaggccctgccccaaacctactgattaaaatctgcattttaacaggatccccaggtgattcttatcagaagctcatcctacagttaattcatgtaagtgttctatttaatgatgagaatactaagatttttttttttttcgtttcagatgctttatgggactaaactgttccttagatgttttgctagcctagtttaaatcaagaagttgattatatcctagtacagaccctacagttacttattgctatttacatacacatcactaagcaaattaatgtaggttaccaccatttctaaatgtttccttaaatgtgattttacactttgatgctaatttttgaacagttgtatgcacaccgttcatatttactctttgccagttctcttacacagtgctccagaagcctaagatccttcgatcttttacaaccttgggatctaacaattaacttactagctatttctttttccccagagtcatcttttctcttgaggggtgggtgatatttattgttttgtcacttgtctactagaaaaataaagaaggagttaagtccagttatatccagtagtgctaaagctgttgttacctaaattaaatcctccccaacctgcaaacaaaattttcaaatatgaaaattaatgacttctatgttttaaggagggaaatacttgttttcttgcaggaaaaaataggtaaagttatggtgatgtgatcttaacaatttttttctcagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccaggtaagttaaggcatcccttttgatcatagtgccctgttggcttgtttattgtagtcttccaggtttctgctctttccctctgataatagtttcatttatagattatttccactgtctcttcctcctcctcctccttctctgcaatattcagcccttctggtgaacttactgttctcatttatattgctttctaaacagaagttctacatttccatagtaaaatttctgtacaatttatgggaagtttctcttttaaatttacttgggctgggcacagtggttcacacctgtaatcccagcactttggaaggccgaggtggacggatcacctgaggtcaggagttcaagaccagcctggccaacatggtgaaaccctgtctctactaaaatacaaaaattagctggccgtggaggtgcatgcctgtaatcccagctcctcgggaggcggagacgggagttttgcttgaacccaggagacagtggttgcagtgagccgaggtcatgccactacactgagcaagactccatctcaaaaaaaaaaaattttgctttgagagaaataacagtatctgacttttatagtgtgattcttacacttaggtgacagtaattttccattctttgatttcctctttatcaatcggtatactactctctgactcattgtcagttgagaaatcctttgttctttatttgatcatctgattatcataaggcttctttgacaaaacattatttatagttacgattaaagcatacgtattttatttcattaaagtttgttttaaaatagttatgtaccaatattattttacatcttttttttccatctgcattggcaggttcccttaaagcacatcttggctgcacattggaattacctggagaacaggaagaactcctgatgcctgagttccacctggaaagattctgatttattggtttgaatttctgtggggatttttaaggctcccaggtgattcttctgtgcagccaaatttgagaaccactttgattagcggtttggcgccacctagtatttccgccatcctttctcccttggatttcacctgttttttggtttttttttttttccttttttattttgagacagtatcttgctctcttgccaaggctggagtgcagtggcacaatctcggctcaccgcaacctctgcctcccaggttcaagcaattctcctgcctcagcctcctgagtagctgggactacaggcatctgccaccactaatttgtgtatttttagtagagacggggtttcaccatattggccagactggtctcaaactcctggcctcaggtgatccgctggcctcggcctcccaaagtgctgggattacaggcatgagccaccgcgcctggccacgtttgttttatagcagtgctgaggtggtaaaaagtagtagtatatttttctgtgtaatgatttcacagagtagaaaacatggatcagtagctgcttcaggatccttttcaccagtgatcaatgaagtgctgagccgagaaatctggctctaaggggaaggtggtggtggtgatgaggtggaaattagttccctctgtgaatattaacatttttaaagggctaggcctacaggttgttgttgtgctgactatttagggacaggagcttggcaaaaggggctagctgccattttttctagcctgcctagcagctgctatggcattgtattttatagaactgaagataacctgtgattagaagtctgtcccgttgtttctctcctcaccccagtctatctttggcctcacttttcgcacacctgcattgtttcatgccccactgctgaccttccagctccatcttcgagttgtagagtttgtagggaagggaaatcagaggaattagtaaaaattattgtttttaataaattaaattgtttgttgaactgttgtacataatttttgaagaattgtaagaatatttcctttgatatttcagatggtcaaataaaaaaaatgttcctaaacttggtgatatgaattcatcatttgaagatgtagatatattttattctttctggtaagtgaatatactgtttgtatgatgctgtcattttttaaaaggaaaagtattcaataagtacttgattgtttataaattaattcagatggacaaattgcagaaccttcactgaacaaaagcactctgttacctatgtgatatttacacttttaagattttctattaatgagatttctagatatcaagcacatgatagtagtaaaaaatgaaaattggggagtcatttgaataaaaataagtacatttttatttagttacttcctactaaaagtacttgagttcatgaggaaggagacagtgctatttgtctctgtaactaattcactaatttttaatatgcgcaatagttagtggccattttatatgtgctacattttctcatcaaatgtctagtaaatacaaaaacataaaatcacatagaacaaaaataacaagatttagttctatcagttgtaattgcttttaccttcagaggatacaaactggagatgagataaccactactagggttaccttcagacttgacagactagcgaaattgaaggcaaggaaaacttaaaaataggtcttggtcaagcgaaaaacctaacaaagaagagatagcagggcggtgtggttttgattatggagtgatatgtgcattttagattttcataccaaatgcaatgtccttaaaaaaggagaaagacttgaccttagttcaatactagaagggaaggaaaggtatccattaaaacaaattcattcacttgcattaaaaagaattttttttcatttattctgtcttgatcatgtattatttctgtctatattaggtataattttgattcttggagagaattttcttatttagatgaagaagaaaaagaaaaagcagaatggtatgtatgcaaatcattaataatggaaggtatttatttggttctctggtatttgtgatgatgtaaaaattgtcacgtaaattttctttcatattttctctttgtacatcttttttaaacaattttttaatattttgaaatcctttctcacaagttaaactaggtgggcccagatcaataattggttaggatatgcttaagaaattgccaaggaatataatgtcagatagctcagttcagcaaaatctttttcttctggttgcttaacctaggttttattaattttttttttgtatgtgtgcagaaatgcttttgacatgaatgtgcaaaaaataaccaaaattaatattaaatagaaccactgtttaggccgggcgtgctggctcattcctgtaatcctagcactttgggaggctgaggcgggcagatcacctgaggtcaggagtgcgagaccagcctggccaacatggcgaaaccctgtctctactaaaaatagaaaaagtagccaggcatggtgacaggcacctgtaattccagctactccggaggctgaggcaggagactcacttgaacctgggaggtagaggttgcaatgagccaaaatcacgccattgcactccagcctgggcgacaagagcaaaagtctgtctcaaaaaaaaaaaaatcattgtttaatgttagtaatgacacagcattttaacctctaggatgttatgtacatataaatattttataaaatattgcattttccagtcatagcatctataagcagtagtttgtttccaatattttctattttatagtcgtgatgagaggagatggattgaaaagcagaacagagcaacaagagcacaaagaaaaaaagaagaaatgaacagaataagaacattagttggtaagtagaattgatttaagtcccctaaatgttagaaattcaaaatgagattaactttttcttttgctagacaatgcatacagctgtgatccaaggataaaaaagttcaaggaagaagaaaaagccaagaaagaagcagaaaagaaagcaaaagcagaagctaaacggaaggagcaagaagctaaagaaaaagtaagacaacatttaatgaaggtggactttaaatgtttatgaaatctttaatcttcactttaatcttcacatctttttttaaaaaaaactataattcgaaagcagagaattgggtgctactgtgaatgaatcatgaccagttggtataattgagagatcttccttaccagcacgtttttattgagcaaaaaattgtgtcataagttcctttaatattatgcttatttctaatatgtcaattttacattttctaataaatgtttatagatctttaccagctgtctttccgagttcatccttcagttttcaataagtttatgttgccttttttcctaatataatttattaaaagtttaaatttttaaaattataaaacatttaggaattttactgtacctattaaaatgattttactccctttttttaaagcaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaaggtatatcagactgaacaaacactaggcacaagtaaatcaagttgcttattaagcaaaaatacttctttttgtttgtttgttttttagatggggtctcgctctgtcgcccaggctggagtgcagtggcgcgatctcagttcaccgcaatttccgcctccgggttcgagcgattctcctgcctcagcctcccgagtagctgggattacaggcgtgtgccaccacgcctggctaattttttgtatttttagtagagacagggtttcgccatgttggcaaagctggtcttgtactcctgacctcaagtgatctccccgccttggcctcccaaagtgctgggactacaggcatgagccactgcacccagccaaaatatttcttgaaaaaaaaaaattatttttatttatttatttatttgagatggagtctcgcactgtcacctggtctggagtgcaatggcacgattttggctcactgcaacccccgcctcctgggttcaagcaactctcctgcctcagcctcctgagtagatgggattacaggtgcctgccaccacgcctggctaattttttgtatttttagttgagacagagtttcactgtgttggccaggctggtcttgaactcctgacctcatgatccacccatctcagccttccaaagtgttgggattacaggcatgagccacctgtgcccagccaaaaaaactttttctaattaagtttttgttattgttgttgttgaggcagggtctcagtcactcaggctggagtgcagtggcgccatctcagctcactgcaaccttcacctcccaagttcaagccattctcatgccttggccacccaagtagctgggattacaggtgcataccaccacacccagctaatttttgtatttttagtagagacggggtttcaccatgttggccaggctggtctcaaactcctggcctcaagtgatccccctgccttggactcccaaagtgctaggattataggcatgagccactgcacctggccaagcataaatgtatttcttttctttactatgcaaatgtaactaaacaagacagagtctccatctcaaaaaaaaaaaaaaaaaaaagacatgctgagataactgaagatatgaatatagacacagtttcagaatatatatatatatatatatatgtgtatatatatatattttgtgacagagtcttgctctgtcgcccaggctggagtacagtggcgcaatctccgctcactgcaagctccgcctcctgggttcacgccatgctcctgcctcagcctcccgagtagctgggaccacgcccggctaattttttggatttttagtagagacggggtttcactgtgttagccaggatggtctcgatctcctgacctcacgatccgcctgcctcggcctcccaaagtgctgggacagttttagaatattaacttgttttttggtttgataatggtaagatgattatgtttagaaaaaaactatcagggttgaaaactgaaatatgtacacctgaaatttagaaaaagttaaaaacagccgggcgcggtggctcacacctgtaaccagcactttgggaggctgaggcgggtggatcacaaggtcaggagttcaagaccagcctggccaaaatggtgaaaccccgtctctactaaatatagaaaaaattagccaggtgtggtggcaggcgcctgtaattccagctactcaggagactgaggcagaagaatagcttgaacccgggaggtggaggttgcagtgagccgatttcgtgccactggactccagcctgggcgacagtgagactccgtctcaaagaaaagaaaaagttaaaaacatttacactgagataaaattatacctgttcagttgtcattgtctgtttttttgagatggagtcttgctctgttgtccaggctggagtgcagtggcgtgatctcagtttgctgcaatttccgcctccaggttcaagcgattctcctgcctcagcctcccgagtagctgggattacagctttgtaattatgttgatggatgtatttttgagtgtagatactatttttgtgtttgtgcttttagacctggaatcatttttctgataatgaggcagagcgggttaaaatgatggaagaagtggaaaaactttgtgatcggcttgaactggcaaggtatacctatggaactgctattgaagtcttcacttgagcttaggataaagtttcatttcttctttttttttctttagcttacagtgcttgaatgaaacactcacatcatgcacaaaagaagtaggaaaggctgctttggaaaaacaggtaatagaggaacacatcactcctacctatatgtagcatttaattctgctttgacctgtttcttcacctaatatataagtcaccaagtgcagggagtatctgatttctctttatgtttcccactgttttgttgttgttgttttatgtgttcggttttttggttttttgttttgagacagagtcttgctctgttgcccaggctggagtgcagtggcacgatcttggctcactacaacctccgcctcccgggttcaagtgattctcctgcctcagcctcctgagtaactgggattataggcgcacaacaccacacctggctaatttttgtatttttggtagagacagggtttcaccatgttggtcaggctggtcttgaattcttgacctcatgatctgcccatgtaggcttctcaaagtgctgggattataggtgtgaaccaccacgcccagcctgtttttgtttttgtttttgagatggagtctctctctgtcacccaggctggagtgcgggtgggattacaggtgtgtgccaccatgcccggctgatttttgtatttttactagagacagggtttcgctgtgttggccaggctggtctcaaactccttacctcaagtgatccgtccgcattggcctcccaaaggattataggcatgagccaccatgcccagtctgcattttgtttatgtagtaaggtgctgttgttgatttaagttggattagatgtttatggtttttaccatacttagtgtttgatttgtggtatctatcacaatcatagcttttgcaaaatcatattagaaaaaaataattgttttgattattccttgagtattttcatagggtaataacagttagaaccaaaagagatctttgttctgtctagtctataccttttattttacagataagaaaacaggcccagaaattcaattcaattcaacaagtattagtacctactatatatagcactatgcctaggttcttttggagaaatgcctaatgctgttgcaccacaaaggacatgctgagaagaacctgagaagaaccttaaggaccaaaagatggagagcccatagtaaatgaggtgtaggataggaagggccacaagttttagtgaccagggaaggctcagtgtagtttgaaccagcctgaaaggaaggacagagttaaaatgaaggtcagaagaataccacaaactataaaatagaagtagaagtataaagtatggttcagcctgggcaacataaacaaaatctctaccgaaaatacaaaaattaactggcatggtgtcgtgtacctgtagtcccaacttctcaggaggctgaggttagaggattacctgagcctgggaggtcacagctgcagtgagctatgatcatgtcggtgcactccaacctgggcaacagagcgagactttgtctcaaaaaaaacagacaaaaaaaaaatgttatggggaaatggagtgggaaacaaaatcagttaggaaaagcagaaccaatgatcaggtttttaataccttgttgactagtttccattactgcaaatctttgattaacagaaggttcaacattgtactactaatctgacgtttgtggataaggtgcatcagatagatgtaactagttacaagaatcttatttaagaatctgcactatgagcgtggtggctcatgcctataatccgagcactttgggaggccaaggcagacagatcccctgaggtcaggagtttgagactagcctggccaacatgatgaaaccccatctctgctaaaaatacaaaaattagctgggcatggtggcaggcatctgtaatcccagctacttgggaggctgaggcaggagaatcacttcaacctaggaggcggaggttgcagtaagcagaaatcacaccactgcactccagcctgggcgacagagtgagactctgcctcaaaagtaagaaagaaagaaaaagaacctgcactatgaatgtgatgatgggaatcaaaaaaatttttcaaggttagcattattgggactttactggttctaagggattgaaggggagaaatgagccaaagctgactcttaagatagcagctgacagaagcaacaagggcaaataaaggttctttttttacttgtgcatgtttgaaggtagtctagaaggaacaatgtaaatggtagagcttcaaaataaaagaggccattttgctatgccttcaccttttggtagagaataaatgagattgtctgcagaaagggtgaatatgagtttgaagagaggtttgaaatggccttgtggatgaataactcagtgacccacagacttgtcaattagtgtccaaggctaatggaagtcacatgacatgagtactgggaaaatcaggcaggctgtgggcagttcttggtccctcaggcagacctatgcagactggaagccagagtgaaaagctggtgcttctttttgggttggcctgagaggagtatggggtcagagtgagaatgacattgagagttgaggaccacaaagccctagccaggaagagagtgtagaatagcaatacagtatacttctaagtccctgacttatgatatttgtgcagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaaggtactggttttaatgaaacttttcttcaactcacactggagcctggagataatgtagacagactccaaatagcagcacttgttatcacagaaacttgcagagataaattctgtgccacagtagaaaagtgtgaaaagtgaggtgcattttgaagctgtcagtcttacccattgcatcagtacacatgcacatatacatatgacagaatacttgtttctcaggaaattgaagatcatgagacaagtcttgatttatgttggcttactctgtcatggcttgtgctagggattaggttttctgtagtttttcttttacagtcttgctctttgttttttcccacctcaagctggagcttgagtttaactgcaagaaagccctagagatccagcgtccctaattctatagatgaaaccgaggctgttttcagaatgattgatcttctgaagaaatgtattaaactggcagtatacacaaataagtggttttatttatgttgatttgtacaccaaatctgtaagatgtatggacttaaaaccaagattatcgttgatttaaacacatgaaaagcaaaaaccgtagtccaggcaacaggaatttatagtagcagcataattagaccaccaatctgagctcattctgtacatactataacctttctgcagtaaaaatctaatggtttttgtcgtttcattttgtttttccttactactattcatattattgtataatatatcctatcagatgggaagttattgctaattacatgaacatacattcttcctctggagtcaaaagaactgccaaagatgttattggcaaagcaaagagtctccaaaaacttggtgagttttgagaagtccatttgttactttaaacacctatttttaaaataacttatgcaatttaatgaaagattaaatgatgatctgttaagtattaaatttttttcatttctcagaccctcatcaaaaagatgacataaataaaaaggcatttgataagttcaaaaaagaacatggagtggtacctcaagcagacaacgcaacgccttcagaacgatttgaaggtaaattttgcttttctaaacgtagaaaatgctagccatgtatctgtgctgcttggacgtacaagacttagggtctatgttcagaatgatagggaaataaaatgtttagcagactggaagctgtaagcaaacatttccagggcaaagatttacttcacctaaccattaaaaatggagaattgcagttgttccatttcagatgccattagagaagggggctgtttgttttgcttaccaggttttacaaaacagtgttagaggatattattgggactaaagaatagtgttatatcgggataattgcttgattttgagaaatgtactgtaattatataagaaaatgtccttatgtttaaggaaaaacacagaagtgttaaggaataaagaggcatcatgtctgtaacttatggttcaaagtatgtctgtacatataggtaaaaataattagcaaatatgaaaatgttcacatttggggaatgtaggcagagtatacagggattctttctactcctctaaaattatttcaaaataaaatgttaaaaattgttagggttcaaaaccaggaaacatagtaagactcaaaaaaaaaaaaatgttagggtttgatattatcttgggtgttgtgattactctagaccaatgcttttcatgttacaaatcatgacccatcactgggtcatgaagtcaatttagtgtgttgaatagaaaatgagtgttacacccattatatgggtgggtatacttgtgaaactcttgatcacgtgtgtctttgtttaggatgtgatataaatttttttcttgctatgacaaggtttgaaagcagtttatgtggaaaaagttctttcacttcatgttttgtgagccaccaatcctttcttaaactaatcgcagaaagatgcttttggattaatagacttgactatacataagctgtttctttcttctaagagtcccagttttacctatattctttaatcttgcttattatcccaaaatttcaacttaaagatatgagacttacagtgttaatataggggaggaaaatcattgcaaaaatcagcagtgacttgtttggctgagttaggcattatttcggttcttttaataaaggtaagtaacaaggcagggtttcagaacacctgaaagacacttctttataaaggagtttattctcctgcacctttatctccacaaaatacaacaggtattagcacactagtctcagctctttcttagggggacttgtttccatgttggagggaggtgggccctgatatttgtccagtctgctttctgtgaggagaggtgaccctgtgaaggcaagagtgactggcagtagtgctatgtgggtatgactcctttgcctcttttatggaaatgggaaggctccttcctcttcagttgtaccattaaacagcaagctggcaccattttttgaatagtgatttctcataggagttttgcaacagtacgtttaatttattttggtattgtgaagtaactggagaacagcaggaaatactgccatgtcacttccatcttttttccaagagaggaaataaaatctatggtatttagggctttaaaccaatacaaggaaattcaacaaaagacttcctagaacttaaaagctaccttcaaaaaagcttcttaggcaccttaggtaccatcaaatattatacaaattctctgctttgttttgaataggtggtggttttgttttgttttgttttgtttttccttctttaattgggaaggaactttggtttctaggcttaacttttaacagatctcacaggccgcagtttctagtagtagtcaggctactggtagtattagtctgtgttgtcactgcatagtctgaaataactaaattgccagaagtccattaacttaaccaaatcagctttctaccacttaacattctacttttacctacacaagtggactgtgtaatacttaacatccttaagaaacatatttgtttctgacacacatcttagatgttttctgaaatatacaaggtttagttgaagaaccacaatagcagttattggaagtgttcagcatcggctcccaagattttagcagatgtgacgaagagaacaccacactacaacacaatctaatctcagcttgcctctccagcactggtaccttgggcacttggcttaattttgctaggtttgtttccttcagtgtaaaacaagaatgatttccagggtttctatccagcaaaagtttaactgtgaggaagctcttttacctattctgtaaggaagtagatttatcagaactcttaatgaattgtggttgtgtttttgagtccaagagtccaacagtactataaatttaaatatggctttttaccagtctggtgagtgtattacattgatttttaagagataaacagtacaaggtagatctttactattgtgttttaaaagcctttgagattttattttctgggatgtgagctatctgaaattttttctcttattaacactcagagggctatatgtatctctcatctctacaagtttattttcaaaatgacacatcccagattgaaatgggcacttagcgaatacttgtggaccacaagacttgtctgagaacatgttcaaagacagttttcaaataaaaatttttcttaatcaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggttgcagacttaagcgtttatagattgttgtattttaaattgtagcttgggtgatatagctcatattttatgtctattaagtggttaataatatagtgcttatttcaaaaccagtagttatggggtcaatattatgaggaagaaatgagcaaccttagaaactttctaggccctggcagataatgaaatcagtatatttagtactatctatcttagttgcttgaattctttacaccaaacactagattaaaatgtctgtttttaaatcgcaacttcttaaatcacacctttctcccttcctaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtatgctgcttccaacataatttctcagagaacaaagactgaccattaatacaaaacaaccttcagaggggtagtctttttatcctttgaaagtatgatacagtatttaattcaaatttccaaatgtatatacatgttcatttttatttttctctagctctgttttataaatacatgtgttcaaacaatcttgattaggagcattttaatcacgaagccaacacatgttactgcgtatctgtttaaaatctggtagttgcttaatgggacctaaggattaaaaagaagagttaattaaaagtacttggccaactttttgcatagaagaaaagaagccaggcttaccaacagcagcaatagctggactcctattataaatgtatttggtacatacttctcgaattgtctcagcattcacagcctgaaatatggaagacactgtcattcagctgtttgtagtaaaaacaaagtctatacctggaactttttaaaactaaagcaagatgaaagatacatattctcagcttttgtaacaaggatctttttacacatgacccaatagtaactcaggactacttacatcaattcttgcttcaagctcagggatgggaatccttctattatagcataacatttgcctaccaatatcttcacaaattggagttgaacctgtttaaagagaaggaaaaattaactattggaatacagatcaaccatatgaaaacagaacctatatctttatttttaccatcaagctgcaacaacatgtttgttttcagaagatttctggctcgtgcaacctcactttctgtgacacttgtacagagtcgcatcctaaaaaacgtggaaaaacagtagtagttggaaaatgttgtatttcatgagttaatgacctaagaatgatgatgccatcttctacacaaaacatacaggtgattacaatttaattccaatgctaagcaaaagctaaaatgattattttccccagtattaatttctcaaaaatgatacataaacatgcctaattacacattagcagacaaaggctttatacaaatgggctgatcacattttcagaaatgctataagcatcttgagacttcatgagtcctcatctgttggagtctgatatgctatgggttaagtcagtgggtcattcattggtttctgaaaacaatgagtagagtctaacttaaatctaatttttaacaataattacatcctagttgactagatttagaaagatgtaaaccaattaagaatagtggaggaaaggaaccagagctaaatgttttccaagaagctgcgagcctttctgcccatctatcgactcaatatactttgttttcttttagcagtggcaacttcagatttactttcccttcaaccagattactttcagagatattttccaaacaacttctagttggcttttaaacttttaggatcatctttctgaattaacctgcttctgaaagattaaaactttcagccaggtgtggtggctcacgcctgtaatcccagcactttgggaggctgagaagggtggatctcctgaggtcaggagttcaggactagcctggtcaacatggtgaaaccccatctctactaaaaaatacaaaaaattagccaggcatcgtgggcatggtggtgcgcctgtaatcccagctattcgggaggctgaggtgggagaatggcttgaacctgggaggcggaggctgcagtgagccgagatggcacaactacactccagcctgggcaacagagcaagacctcatctcaaaaaaaaaaaaaaaaaaaaattctatagtataaatcagcttcacatcttgagacttaggaaaaaccaactgcaacctttgaaaacatggcaactactgtttatctaggtctcttaattaaaaggtaaaattaccataaatcaccataaagtataaataaaaaactagtttaaaacgaattaaaggcaaaatttaaattacttaaagctatttttctcaccattctttttgaacaacatgtagcatgtctgcaacagtggatgattcacaaaccatatacagtccccataatcctgtatctgtgtaggaagtgttgaaagactgaaagctatggcaaagattgccatgacaagtgagctgggccagcttgctagataaattctgcaaggaaaaaaaaattccaagaga

SEQ ID NO: 17544 - DNA, 13203 bp, Human
  misc_feature (1)...(13203): n = A,T,C or G
tacccttttcacatttttttttttttctgagacagagtctggctctgttgcccaggctggagtgcagtggcatgatcacggcttactgcagcctcaacctcccaggctcaagtgatcctcctgcttcagcctcctgagtagctgggactacaggtgcacgccactatgcctggctaattctttcattttttatagagacaggacctcgctatgttgcccaggctggttccaactcctgaactcaagtgatccacctgccttgggctcccaaaatctcgggattacaggcgtatagtgctaggccttcacattcttatatacccttctgtttccttagctgtgaaatggagataatgacatagccttaattcacgtgggatgcttagcacagtgtctggcacttgatagatttttttctttctacttgaaatttatttttgagctgggcacggtggctcacacctgtaatcccagcacttgggaaaaccaaggcaggcagattacctgaggtgaggagttcaagaccagcctggcaaacatggtgaaaccccgtctctactaaaagtacaaaaattacctgggtgtggtggcacacacctgtaatcccagctactccagaggctgaggcacgataatcacttgaactcggcagatggaggttgcagtgagctgagactgagccactgcactccagcctgggtgataaagcgagactgtctaaaaaaaaattatttttaactaatataaaactctctgaacccttctttttctgagctgcttctccacttgagtccatcccacatcattgaacatttaattacacagaattgtgtaccatcttccttgacccccagatctttagccttctatagtaccctgtctctttttgtcgtactagtcacagttgcactttttttttttttttttttgagacagagtctcattctgtcacccaggctgcagtgcagtagcacaatctcagctcactgcaacctccgcctcccgggttcaagcaattctcctgcctcagcctcctaagtagctgggattacatgcgcgcaccaccacgccaggctaatttttgtatttttagtagagacgaggtttcaccatgttgtcaggctggtctagaactcctgaccttgtgatcagcccacttcagcctcccaaagtactgggattacaggcatgagccactgcacccggccatagttgctattttatttgtgtgattgattaccgtatgacgcttttattgaagtgcagtgaaggcaggaaacatgaccggtttttacaatattttcaacacttatcaccataggtggtacatagtagggccttaataaatatttgtaaaatgaacaaagttaatgagtgtttatgtttgtagttttaattgctctgaagtaaatatctgattttccaatttccaccagagtgctctgcacatagtaggtctaattatttttccctctttactaatcacccatgccttgtaagaattcagttagttgactttttgtactttataagcgtgatgattgggtgttcccgtgtgagatgcgccaccctcgaaccttgttacgacgtcggcacattgcgcgtctgacatgaagaaaaaaaaaattcagttagtccaccaggcacagtggctaaggcctgtaatccctgcactttgagaggccaaggcaggaggatcacttgaacccaggagttcgagaccagcctaggcaacatagcgagactccgtttcaaacaacaaataaaaataattagtcgggcatggtggtgcgcgcctacagtaccaactactcgggaggctgaggcgagacgatcgcttgagccagggaggtcaaggctgcagtgagccaagctcgcgccactgcactccagcccgggcgacagagtgagaccctgtctcaaaaaaaaaaaaaaaacaccaaaccttagaggggcgaaaaaaaattttatagtggaaatacagtaacgagttggcctagcctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtacgggcccggcgcttaggcccgacccagcagggacgatagcacggtctgaagcccctctaccgccccggggtccattttgcagacggggaactgaggccccttgaggcaggacacatccagggtgacgctgctcgtaagcgtcagagcattcttttttttttttttttttttctgagacggagtctcgctctgtcgcccaggctggagtgcagtggcgcgatctcgactcactgcagcctccgcctcccgggttcaagcgattctcctgcctcagcctcctgagtagctgggattacaggcgtgcgccaccgcgcccggctgatttttatatttttagtagagacggggtttcaccatgttggtcaggctggtctcgaactactgacctcgtgatccgcccgcctcggcctcccaaagtgctgggcttatgggcatgagcctccgcgcccggcccagagcattctttataaggccgaatagtttgcatttgaaggtggctccccccagtcccccaccccacgtgtattttcccctcaaagaaaagctgcatccttaacaccccatctgttcagtcctcatgactccagtgggccagttctgcgtagtccctgccctcgtggagaacacattcctcctggggagactgacagatgcaaagacaggaacaagccagggtcatgttggcgccggaagagccgaccgtgtgtggcgtgggaaattgacttacctgcctgctgggagatggaggggttgcggttgtgtggtttcagttaaggagcacttcccggagaaggaagagagcaggatggagtaggaactagccaaccctaggtaagaggttctagacatgcgtgcgttgagacctggagtcttgggagaggatgcttaaaaggtgattttacccctaggaatatgggggcactgaaatttttttttttttttgagacgggagtcttgctctgcaagctggagtgcagtggcccacgctagaatgcagtggcgcgattgcggctcattgcaacatctgccacctggggtcaagtggttctcttgcctcagcctcccgaggagcggggattacaggcgtgcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagccctttgaaagtttttcagtatttatgtatatatatttttgagttggagtctggatctgtcgccagactggagtgctgttgcacaatcttggctcactgcaatctccgactccctggttcaagcgattctcctgcctcagcctcccaagtaactgggattacaggcacgcactaccattcccagctaattttttgtattcttagtagagacagggtttcaccatgttggccaggatggtctccgtctcctgcgctcgtgatctgcctgcttcggcctcccaaagtgctgggattacaggcgtgctgggatttcggccacaacgtccgaccgaaagtttttaagcagggacatgacattgtcagatttatatactgaaaagctcacccaggttgccaagtggtttggaggggaaagactgctgtcgaggaagcagttaggtagttgtgaaaacccaggtgaggaataactaggccttacctaaggtgcaggcagtaatcttgccatggcctttaagcagagaagtagtcctagtgtcacttaatctttacaaaggatttttgcaaggatcccgatctttcttccttgagggtggtgtacttaatacacttttacaccagacttctaatgttagatgaagaacacagtatttccagggatcaacatttctgtaggctcctattttatataggaaattgtatgaattttgtattttactccaaaatttttctgtgcccgatttaatataaaaatttactgagcctgggtgcagtggctcatgcctgtgatctcagcactttgggaggctgaggcaggaggatttcttgagcccaggagctggagaccagcctgtgcaacatagtgagaccctgtctgtatttaaaaaaaaaaaaaaattcttgaaaaattagcagggcacattcctgcctttagtcccagctacttgggaagctgaggcaggaagatcacccgaacccaggagttggaggctacagtgaactatgatggtgcctctgaatagttgctgtactctagtctggtaacacagcaagaccctgtctctctatcttgtctttttttttttttttttttgagacaggatgtcctgctgttgcctgggctggagtgtggaggctggagtttggtggcatgatcacggctcattgcacccttaacctgggctcaagcagtcctcccagagcttcagcttcccaaagtagctgggactataggcatgctccactatgtctggctaatttctttttttatttttatttttagtagagatgaggtcttgctatgttgcccaggctgagacctcatctcttttttatttttttaaaattttttattatactttaagttctagggtacatgtgcacaacgtgcaggtttgttacatatgtatacatgtgccatgttggtgtgctgcacccatagagacctcgtcttaaaaaaagaaaataacattacttttgaaggtacttaatgcactgaattgtacatttaaaaatggttaaaatggtaaatgtttgaggcaggtagatccacctgaggtcaggagttcaagaccagcctgaccaatatggtggaaccctgtctctgctaaaaatacaaaagttagctgcatgtggtggcatgcgcctgtttagtcccagctactcgggaggctgaggcaggagaattgcttgaacctgggaggcggaggtggcagtgagccaagatcacaccactacactccagcctgggcaacagagcaagactccatctctaaataataaataaaatggtaacttttatgtatattttaccaaaatttaaaaaattacaagtttacatttcttaaaatttcccatcaaatctgtaagtaaatttatgccccgaggaacaagtgctatatttattctaagacaacctcctccttccttaaacagaatcttagggctggaggattgcttcctgccctcttttgtttgtgatgtatgcattttgaaaattctgggccgggcgcagtggctcactcctgtaatcccagcactttgggaggccgaggcgggcggatcacaagatcaggagattgagaccatcctggctaatacggtgaaaccctgtctctactgaaaataacaaaaaattagccgggcgtggtggcgggcacctgtggtcccagctatttgggaggctgtggcaggagaatggcataaacctgggaggcggagcttgcagtgagccgagatcgtgccactgcactccagcctgggcgacagagcaagactgcatctcaaaaaaaaaaaaaagaaaaagaaaagaaaattctggtataatttacatacagtaaaatgcacagatcttagggtttgatgagttttctctcgacatgtttttgcacttccttgtttttgagaagcactgatttgagaagtcagtggctttttctctttagtttgcagggtttgctgtgatttgtaatcacgtacttgacctaggcttcccttttccaccatggtagcagaaagggcatgggatttagagctttaagtacgcgctctttgcttactgtcttataccttgagcatgtcacttctcctctcagacttgttttctcatctgtaaatggatctgttgtgaggactgactgagataatgttactagaagggctttgtataatatttaagcagagtgagaggtaagctttttgtgtaggtcaggggaaatggagaaaataggtgccctgactcagaccagtctggctctttttttttttttttttggagacggagtcttgctctgtcacccaggctggagtgcagtggcgcgatctcggctcacggcaagctccacctcctgggttcacaccattctcctgcctcagcctcccgagtagctgggactacaggcgctcgccacacacctggctaatttttttgtatttttagtagagacgaggtttcaccacgttagccaggacggtcttgatctcctgacctcatgatccgcctgcctcggcctcccaaagtgctgggattacaggtgtgggccaccgtgcccagccaccggtgtggctctttaacaacctttgcttgtcccgataggtcacctttggctcttcagagatgcagggacacacgatgggcttctggttaaccaaactgaattatttgtgccatctctcaatgttgacggacagcctatttttgccaatatcacactgccaggtactgacgttttactttttaaaaagataaggttgttgtggtaagtacaggatagaccacttgaaaaattaagcccagttctcaatttttgcctgatgtcaggcacggtatccaatctttttgtatcctattctctaccataaataaaatggaagtgatgtatttgtacgttatgtgttaaaggtgttatggtgtctcaaaagcactttgggctcttaagagacaagcgaaattaaagtatcatatcataggttagttttgtagaattgtagaattacgaatgccttttgtttccctggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttttttttttttttttgagacggagtctcgctctgtcgcccaggctgggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctagattttctaagtacacattgttttggttatgtgttttgtgactaccaccccaaaactaataaccaccttttttttttttttgagacagagtctcactgtgtcacccaggctggagtgcagtggcgtgtgatcttggctcactgcaacctctgcctctcgggttcaagtgattctcctgcttcagcagctgggactacaggtgtgcaccaccaagcctggctaattttttgcattttagtggagacgggggtttcaccatgttgaccaggctgatcttgaactcttgagctcaggcagtctgcctgcctcagcctcctaaagtgctaggattacaggcgtgagccactgcgcccagcccaccgttttatttgttcataattctgtagtccaggctgggctcagctaggcagttactctgctggtggtagtcgttggtgtggctgccttttgctggcagctgggggctgggcctgtccctcttttttttttttctcttttcttttttcttttttttcaagatagggtctcactctgtcacccaggttggagtgcagtggcatgatcttagctcactgcaacctctgcctccagggctcaagtgatcctcccacctcagcctccccagtcgctgggaccacaggcatgtgccaccatgcctggctaattttttgtgtattttgtagagacggggtttcgccatgttgccaggctggtctcgaactcctgagctcaggcgatctactgacgttggcctcccaaagtgttgggatcacaggcatgaaccaccatgcctggccagggcctgttcctctttatgtggtctctctagcagggtagctcagggctttcaaaagtataaaagcagaagtcagcaggcctttttaaggcttcggcctagaattgccagtgtcgcttcatcgacattcagttagttaaagcaatcacaagcccagcccatttcaaggtgaaattactacagaggcatgaacaccatgaggtgtccatagggggccatcagcataacacactgccacatacatgcactcactttttttctttaacctaaagtgagatccatcagtagtacaggtagttgttggcaaagcctcttgttcgttccttgtactgagaccctagtctgccactgaggatttggtttttgcccttccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggcgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaaaaaaaatcaggccgggcatggtggctcacgcctgtaatcccagcactttgggaggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgaacccaggaggcgaagattgcagtgagctgatatcgcaccattgtactccagcctgtgtgacagagcaatactcttgtctcaaaaaaaaaaaaaaattcaaatcagagtgaagtgaatgagacactccagttttccttctactccgaatttcaactgattttagctcctcctttcaacattcaacaaatagtctttttttttttttttttttttttgagatggagtctcactctgttgcccaggctggagtgcagtggtgcgatctctgctcactacaagctctgcctcccgagttcaagtgattctcctggctcaccctcctgagtagctgggattacaggcgcctgccaccatgcctggctaattttgtgtttttagtggagacggggtttcaccatgttgtccaggatggtcttgatctcctgaccttgtgatccacccacctcagcctcccaaagccctgggattacaggtgtgagccaccgcgtccagccagctttattattttctttaagctgtctttgtgtcaaaatgatagttcatgctcctcttgttaaaacctgcaggccgagcacagtggctcatgcctgtaatcccagcattttgggagaccaaggcggatggatcacctgaggt

SEQ ID NO: 17545 - DNA, 7296 bp, Human
ggccttattactttttttgagagggagtctcgctttgtcgcccaggctggagtgcagtggcccgatctcagctcactgctacctttgcctcccaggttcaagcgattctcctgcttcagcctcccaagtagttgggattgcaggcaggagccaccacacctggctactttttgtatttttagtagaggtggggtttcaccatgttgaccagactggtctcgaactcctgacttcaggtgatccgctcacctcggacttccaaaatgtttggattacaggcgtgagtcaccgcattcggcctgaatcaactttaattgtgaagagacctaagttacctgggctctggtcctagctctgacaataggcctagatatgtaaaatggacaataaaaaggttactatctcatgggacttttgtgagtattaaataaatatatgtaaatgattcctggtacagcacgcgttttttggtgaggcttaattaaggaggggaagaggtttccctcatatagcttatccactggtctgattgattaggtggggattttcagcgcctaatatcttcagtggtctgtctctggacatttataccaagatccaacgttaacagcaaaaatacttttaaaaaattagacctgtttatcgcgctctcagtgcaaactcggctcacaagttcacgctaacacagtcacaaaaggcgagttttgggaaactcgagcagggcgccaccgttctccaggggacaggtaacttgggtgaccgcaggggtgaggacacagctgcttctaccaagcggagagtaaatgcgggtgctgcggcgcatcggagtcacccacaaggctctccaagagccgcgcctcaggacaaagatgaattcagcggcattgagaccgtggtcgcagccgccgcagcctcttctcatcgaccctcccacctcaccttcagtcggcttttcgaactccctccgggttctaagcgcctcgattagttagaccgcagctcgcagcagaacagcaacacaacgccgcgaagcttaaaggcccgcagagggggaaaagaacacccccgccgtcattcttttttttccttctttgagacagagtctcactctgtcgcccaggctgagtgcagtggcgcgatcatggctcactgcagcctcgacctaccgagctcaagcgacctctccgcctcagcctccggcgtagctgggagtagctaggactactggagcgcgccaccacgcccggctaatttcttttttatttcttttttatttttttgtagagacaggggtggtctatgttgtccaggctggccttgagctggacgcaacagatcttcccgcctcaacctccgaaagtgctgggattaaaggtatgagcagccgcgtacggcccccgcagccattctagctagcggtaccaatagcaaccggcagctgccctccgcttttgctccgccccttctgcttgcgatctgtttccgcttccggtcccgcagttccggctctgccgtgaagagctttgcattgtgggaagtctttcctttctcgttccccggccatcttagcggctgctgttggtgagtgggctcctaccgaccgaggtttaggcagcgcggggagctttgcgggttgccatttgtaactccggatcctaaaattcctgtcctgttctctgtctcttctaggttgggggccgtcccgctcctaaggcaggaagatggtggccgcaaagaagacggtgagtgaggcgggccaggcccggaagacgattcacgtggagagatgttttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggtccgtatttaatgtttgctttgtagaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggtagcgattgtggtgtttggcccttcattcccgtctccccgacccacccccaaatcgtgtgctccccttctgtgagcttatttttggaggagaaatgtgtgtgtgtggcaggagtgaaaacagaacatcgaggtttaatggaaacacagacacattactgttttttccatgtattttgtgtcctgcttttttggttcttttagctttgaggtgctttaatgatgcttcattgtgtgaacttgttttagtgtcaaaaaactaggtaagaaaagttgaggctgggctatggagttgcaggctatcatagaatcacctagtttagcccgctaaatcagttctgagtcaagatttatgcttgactcactgttttgaaattgaacttagggggtgttgtaaataagccaaacaaacttggaccttgcagagtataagctatgtgagcaaattttctgtggtgatgcataagctgcttacagcattttatatagggtgtctgtagttaccgtcaaagcctggagggccctttctgtcttgtcccatgggttcggcttttccctaaccattctttgaaactttctttaaagcctgtcttctatagtagtgcttctgaaacatgactgtgcaaaggagtcacatgggtgatgttaaaatgcaagttctgatttcattggatctgggatggggcccgaggtgccatttattattttattttttttaagacagagttttgctcttgtcaccccggctggagtgcaatggcacaatctaagctcactgcaacctctgcctcccaggttcaagcaattctgcctcaccctcccgagtagatgggattacaggcacctgccaccatgcctggctaatttttgtatttttagtagagatggggtttcgccatgctggccaggctggtctcggactcctgaccttaggtgatccacccacctcggcctcccaaactgctgagattacaggtgtgagctaccgtgcccggcttgaggtgcttttttaactaatacattgtagcactattgctggtatgtggattcacataattgagtggcaagatagtataggactcctttccgattcctaaaaccattagtatctactaaattgacgctgaaattttgtatttttagtagagacaaggtttcaccatgttggccaggctggtctgacgctcctgacttcaagtgatccggcctcccaaagtgctgggattacacgcgtgaggccagaaattttaactctaaaacggtatcacttcccatctggaattctgggcactgaggggatggtgatagaaatggcttatcttttaaaggtttagattctggatcctccacttactattctgtggctcagtttcattagattaaaaaaaaaaaaaaaaagaatagggctgtgtgccgtggctcacacctgtaatcccagcactttgggaggctgaggcgggcggatcccttgaggtcaggagttcgagaccagcctggccaacatggtgaaaccccatctaccaaaaatataaaaaattagctgggtgtggtggtgcacgcctgtaatcccagctacttgagaggctgaggcaggagaatcacttgaactcgggaggtggaagttgcagtgagctgagatcgtgccactgcacgatccgcctgagcgacagaatgagattccatctcaaaaaaaaaagtacataatacctactttagagattgtcatggaaatataaagtatgtggtccttactaatgctagataatgctttgctttcttttatttgcatcttaccctcttccgtgagtattgatactgtcttaaacatagtaggggttgattagatatttgctggttgccccttcacttgcaagggatacatacaaatgttggtttgtattggataatgaatatgatgtttttaagagtaatatgtgattttgttactttttgaaggccttaacaacattaacactagtaaaagaagtagtaacatttagtctgtcagtcacttggtatcgcatttatttatttgcccattttggttcccaaaggaaatctgaaatagagtactatgctatgttggctaaaactggtgtccatcactacagtggcaataatattgaactgggcacagcatgcggaaaatactacagagtgtgcacactggctatcattgatccaggtatgctttttaaatcataaagtcttttttttttttttttgcctttctaatgtaatgtctggacaagtatttcttactacacaaatgtctttggttcctaaattcagatagaatatggatctagcaaggcatatcgtgtagttgtattttgtagagaattggtaatgaatgccaatacattataattggctttattataagttaaaatttttactgtcagataatgaatttcatttgatgaagtacctatgaaataatgacatagatttggtaaaaggtgaaattataaggagagaataatctggcaaaacagaagaaagtaattcttgcttcttgagaacagacatgtaaaattagcttgagaaaaaaaaaagtgccaaaaaatctacatcattctgttttccaattgtgaatctttgattcatagaatactgcgaatattctcgctgttctgattttgtaatagtcaggacaggctaaacattcgctatattaagaccatgcatgtgtccccaaacctagttctttccctaggtctggttttataaatgctggtgataaaccaattttattatatgatcattttatgtgattatataatggctgtgattctaggttatctttggtcaaccttaagaaaaatgacagtacagctaatgtgataacttttgcaaaaagtcagtgctaatttgcagaccattgtctacagaagggataaccaaaggtagagaaattttatggtaccagttgctattaaatgaattgtaaaattactgtttttttatttttattttttaggtgactctgacatcattagaagcatgccagaacagactggtgaaaagtaaaccttttcacctacaaaatttcacctgcaaaccttaaacctgcaaaattttcctttaataaaatttgcttgttttaaaaacattgtatctatttcagtatttttctctatttttgtttcaatacaatttcctgaaggttggattagagaggatgaggcagatgtggtggcaagacttttcagtaaagagttacacatcctgggccgggcgtggtggctcacgcctgtaattccagccctttgggaggccgaggcgggcggatcatgaggtcggaagatcgagaccatcctggctaacgcagtgaaaccccatctctactaaaagtacaaaaaaaattagccgggcgtggtggcgggttcctgcagtcccagctacagagcttgcaatgagccgagatcgtgccactgcactccagcctgggcgacagagcaagactccatctcaaaaaaaaaaaaaaaaagttacacatcctgatttctgttttccagggtttttttgttgttgttctttttttttggagacagtcttgctctgtcgcccagcttggagtgcagtggtgcaatcttggctcactgtagcctccgcctcccaggttcaagcgattctcctgcctcagtctcctgagtaacagggactacaggtgcgcaccaccacgcctggctaatttttttttttttttttgtatttttagtagagacggagtttcaccatgttggccaggatggtcacgatctcctgacctcgtgatcccccggcctcagcctctgaaagtgctgggattacaggcgtgagccactgctcctggcccagtttttgtaaagggactgcactgggttcctttctagtactagatgtttagaaagctcaagttttgtaattccattctcaggacattgtttgcattttatattctagtatgcttaggaggtaacaaggttaaatacccagaattgcaatttaccaaatttgagtagctaaaaaagattaactgaaatgtttccccatccaaaatgctgtcataggttaagaaaagttttactttaatgaataatctttcctaagttaagtggttggtgcacttggacgatttctgagtaatcccagatcatcaatagttaagtccatgtttgcccgagtatgttttatatcatacacctaaaagatgtactgtgaagtacgttaagtattcacatttttggaaactatactgcatcccccaagagtatgtcccagggaatccttcatatgttaatatcttttggaacattcgaaagaattaatttgaggggaaataatgatttagttagatactaatttacagagttgaatggtgctagtaaggtatgccctatgtagtcagctgggctttgagggagggaggccacagaagtgtcagaaaagacaatgtcttttggattttagactcaatctccttgctccttttctccctcccctctttcaggcaagttttgatggtagatgagtgagacagtaaatgaggatgccttctaaatagtatgcagaaaatcaagcatttactgcacttggagtcagaggaccccagctcttaatagctatataacagccctgggtgggtcatgttcccaatttgatagtcgggggttaggagtttttttcaagggaatagctcatgattttagtttgtgtccgaagttaatctgaggttgtggatatattaatactttggagagtctggtttttaatggttttaccagttcatttactcagtatttctcaatttgggagcactactgacattgtgtaatgggacagttctttgttgtggagggctgtggattctgcaggtatttttcattcttggttttccttccatgtcattgtaatcacccccaaatgtcaccacatttttaaactagcttctctcctggttaagagtcactgaatatatgaaagattttaagtgttctaaggtgttcatgtttacatatccagagacccgtgtggccaaagtgatataaaa

SEQ ID NO: 17546 - DNA, 38920 bp, Human
  misc_feature (1)...(38920): n = A,T,C or G
catattaacgtgttcaaattctaccccagtcagaaaactgcaccccttgagccctgatgctcccttggcccccaagattaccagcttcagggaacctcccagtttttgtccaccttatgacctccaagcaacccagtcctgagggcactttcctctctgcctctgcagccccgcactggcctggaaatgctccctttggtggccagagcccctacttctcccaggttctcccccacccccagggtccagcttccttcctcctgccctcaccttggttgcagttttcatggttatatttgtggcttttttctttttcttttctttttttttttgagatggagtctcactctgttgcccaggctggagtgcagaggcacaatctcggctcactgcaccctccacctcccaggttcaagcaattctcccacttcagcctctcgagtagctgggattacaggcacccgacaacatgcctgcctaatttttgtatttttgtagagatgggatttcaccatattggccaggctggtctcggactcctgacctcaggtgatccgcccgcctcggccacccgaagtgctgggattacagacgtgagccaccgtgcctggctcatttgtggctttttaaaaaatcttcctggaggacacatttttccctctatagcgccagccacccagatccacgcctttgcttaagttatttcctcaagacagggatgccctcccttcttcccctgggactgatatgtcctgccagctccttggagaactttctccccatctatcctctaattcacagccacccccggttacatgctctctttccgtgcctctttcgtgtctcatgaacctgtccattttgacacttaacacactcggtccaatcatcattgtacattctgtccccactagacccagacggccttgagggtaaggtaccaaggactccccatggccagtgcccaccggtgctgaaatgaatgggaacgatgcagtcccaagacctcaagagaaccttcccagtcctttctccttaattttttttgtgtgtgtatggtgttttttaattttttcctcacttgctttcttttcttttcctttctctctttctttctttctcctgcctccctcccttcctttctttctccttccttccctcctttctttctcctgcctcccttccttcctcctttctttctccttccttccttcctttccctccctttctttctctctctttctctctttctttctttcgctacaggacgtcgtgtgtttgcccaggctggagtgcagtggcacgatcatagttcactacagcctccacctcctgaactcaagcgatccttctgcctcagtctccagtgtagctggcatcacagacgtgctcctccatgcccggctaatttaaaaatgtttttgcacagtgagggctcgctatgttgcccaggttggtctcgaactcctggcctcaagagatctccggcctcagcctcccaaagtgctgggatgacaggcgtgagctattgcgtccggccccagaatgcacttgttaaagcgttgtggggctttttgaaatgacaatatattcatatactacaaaatttaaaagacattggcggggtggggtgggggtaaacccactgccactgccccgccccaggccctggattcccctaggcacagtgttactctttccttttggagttttccctgatcattgaagttatgcccttgtcccttctgcacccgcgcttctgggcaccgagctcctcccgctgaagtgatcggcttgcactgactgcgcttgggcttcgcgctttcccgcagcggccgggccttggcgcctggacgccccgccgacccccgcggccgcgcgccctgctccccctggcggccgcgccccgcactgcagtggccgcgttggggcccggccgggggaggggtcgcgcggcggcggcgtcagcggcggcgcccgggcggtgggagccgaggcgccgagcaagatggcggcgcgagtgctgcgcgcccgcggagcggcctgggccggcggcctcctgcagcgggcggccccctgcagcctcctgcccaggctccggtgagcagcgccgcccttcccgggaggtgccggggaggggccgccgcgaggcggagggcgcgggtttcccggcgccggtctccgccccggccctgtccccagcgcgggtggctgcccggcctcggggcagtggggccggagctggggtggggccggagctggggcggggtcggggcgtcctcgggctcaaggtcacggaggggacgggccgctctgcggctccaccctcgcccgggaaggcccccgaggcttggcccggaggccacatcctccccgcggcgctggcccggcctgcagggccctgaccggcgcgacccgtggccagggacagggacagcgcgcgcctgaggccgcaggccccggacgccgtctgctgggtcctcgccggaggctgttccaagcctgagtggctgcgtctgccgaggacgttggcgaccctggtctctgaggtgccgggagtagggaataaaagagtaaagcattgtcccgggccagctctccgcggagggtaggggaagttagagcttggaggaggtcaaatcacttaacgtcttggagttgaaatttaaagccggccgtggatctaaaagtacttagagttatcagcactaagttcaggcgtggggctcttgtttaaacttttttttttttctaacttcagtggattggacgtttggttgtccaaattcatcaccttgatatttgcatgtgctgttttccacattcaaacagcaaagcctatcctgccttacccagagttgctttctcgtattcattgctttgggtagtttaaattacctaaggaactgtgtgttaaactcgccatgggccagggaggtttcagtaacatggtttattattattattattgttgttgtttatttatttatatttttgagacggagttttgctctcgttgccccggctgaagtgcaacggcacgatcttgtctcactgcaacctccgcctcccgggttcaagtaattctcctgcctcatcctcccaagtagctgggattacaggcatgcaccaccacacccggctaatttttgtatttttagtagagacggggtttcaccatgttggtcaggctgatctcgaactcctgacctcaggtgatccacctgccgcggcctcccaaagtgcagggattacagtcgtgagtcaccaggcgcggcctgatctttttaaaaagatgagtctgacttgggagagggggcagaattaagggtagtggccagctgagtggaccctggcactgagagttgagagtttgcagagagctgttctgccaaaatgtgagtgcctaccacgtgccaggcactgttgactgttgagagacatcagtgaataaggcgtccaaggccatccggagcttaccagtaattcaggagggctggggaagaagaattcagagcagtttaggacctggtaaagtttgtgaaggctgtgtgctattcaagtggaaacgcaaacagacagttggcagtatgactcctcaaaggaggtgtctgggctacaggtaacatttaggagttgtcagtatataggaatgctaaatgttaatagacacatggatttcattatactgtttcgtatttgatttacgtttttcataataaagcctggacgcagtgactcacacttgtaatccctgcactttggaaggttgcggcaggaggattgcttgagcccaggagtttgagaccagcctgggcaacatagtggaactctgtccctaataataaataagtacataaataaaaatttgtataatgaaactttttttaaaccataggaagccgggtgcagtggctcaggctgtaatcccagcactttgggaggccgagctgggctgatcgcttgagctcaggagttcgagaccatcccaggcaacatgacaaaacacatctctacaaaaaatacaaaaattagcccggcatggtggcacacgcctgtagtcccagctacttggtaggctgaggtgggagtatggcttgaacctgggaggtggaggttgcagtgagccgagatcatgccactgcgttccagcctaggtgacagagccagaccctgtctccaaaataaaacaaacaaaaaaatataggaatgtgtgagattgcttgaggcgagagtgtggagagagaaggggctgcaaagcaagtcctgggatgtgcagcgtatataggctgaatgtaggagggggagctggcaagctcattgttatgtggcagtggccaggaggagggagggagtgccatccgctgccaaagtgttaggtaaaatgacagaagaaaacaggatttgctgaatcagtttcagcaagggagaagggcgtcctcctgggagcctcatccctgcctgtacattagccagcgtatttcacttagtgctgctcagcagcaagcttggaattcccagccgcttcctggacattgcataagtgtctcacaggtgcttaaaacactgctgtacccaggatttaactcctcttccttctgtgaagcctgcttttctttggttgttcttctccagtcatgaaacattttccatgtggtggcccaggccagacaccagatggtcttccccaagcccatccctctttttcccgccatctatcatttaccaaatctgtcagttctgcctctagtatgtcttgaatccaccctctccatcttcactgccctagctcaaccctcagcaatactcgtctggattcctacgaagagtgtgggctcgaacctgttagtgaaggggatgactaaagaatttttttttttccttggagatagtcttgccctgttgcccaggctggagtttaatggcatgaccacggctcactgcagccttgaccttccggacttaagggatcttcccacctcagcctcccaagtagctgggactacaggcccacaccaccatgcccagctattatttatttatttatttatttatttatttatttgagacagagtgtcactctgttgcccaggctggagttcagtggcgtgatctcggctccctgcaacctccacctcctgggttcaagcagttctcctgtctcagctacctgaacagctgggacttacaggcgtgcaccaccacgcctggataatttttgtatttttagtagagatggggtttctccatgttgcccaggctggtctcaaactcctggcctcaagtgatcctcccaccacggcctcccaaagtgctggcattacagggatgaatcaccacacccggctgctaatttttaatttttttgtagagaggggggtcttgctgtgttccccaggctagtctcaaactcctggcctcaagcagtcctcccaccctccgcctcccaaagttctaggattataggtgtgagccattgtgcccagccacacgtctaaagaattctaagcggacattttcctagtagaaagatctctatgacacaaaccttgactggttcctaatccctcctccctgtctgcccccattcccctacccacaagagcaatgaaagacattttggggagaactggggatattttaatagggagtggatattagatatgatggaataattgtttttctcagatgtgatgatagcattgtagttctgtcattgtgttttggaggtacatgctgaaggatttacgggagaagtatcattatgtccaaactctactttcttttttttttttttttcctgagacagagtctcgctctgtcacccaggccggagtgcagtggggtgatctcggctcgctgcaacctctgcctcccgggttcaagtgattctcctgtctcagcctcccgattagctgggactacaggcgtgcgccaccacaaccagctaatttttttgtatttttaatagagatggggtttcaccatttggccaggatggtctcgatctcctgacctcgtgatctgcccgccttggcctgctttggtctcccaaagtggtgggattataggcgtgagccactgcccccagcccaaaactctactttcaaatggttcagtagaaattaaaaagcaaatatagggccgggtgtggtggttcacacctgtaatcctagcactgtaggaggccaaggctcacggatcacatgaggccagaagctcaagaccagcgtggacaacatgatgaaaccctgtctctactaaaactacaacatttagcagggtaactacaacatttagcagggtgtggtggtgcagggctgtagtcccagctatacaggtggctgaagcaaggtaattgctcgagcgcaggaggtggaggctgaagtgagccgagatcgcgccactgccctccagctgacatgagagaacaaggccctgtctgaaaaaaaaaagaaaaaaagaaattaaaaagcaaatatatatagagaaaaacttttaatggtaaaatgttcatttttaaaatctagatgcagggcagaaaagtcttgtcatgtttaaactcctctgggtttgaagtttctggaaatgaaaggtgtgggaacaggtctctggagcagcagtgtggaagacggggtactggggctggatggagtgtggtggtggggaggggagtcagggagctgctgctttaaggcaggagtcttcttggcatgggtctgtcaacctcttctctcccccgggtctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggtgtagtgcacagtctgtaaataacagtgatcatattgccgggcgcggtggctcacgcctgtaatcccagaactttgggaggccaaggtgggcgaatcacgaggtcaggagatcgagaccatcctggctaacatggtgaaaccctgtctctactaaaaaatacaaaaaattagccgggcgtggtggtgggcgcctgtagtcccagctactcaggaggctgaggcaggagaatggcgtgaacccgggaggcggaacttgcagtgagccgagatcccaccactgcactaccagcctgggcgacggagcgagatctgtttcaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttctgcatgttggtcagtctggtttcccgacctcagtgatccacccgcctccttggcctcccaaatgctggggattacaagcatgagccactgtgcccagcccatgatattattaaacagatatccctaaatgtagtgtacgtaaaacacttcaaactaattgacaaaatgtgctttcatttttattggaatatggctgggtgtggtggttcacgcctataatcccaggactttgggaagctgaggcaggcaggtcacttgagctcagaaattcaagaccaacctgggcagcatggtgaaaccctgtctctacaaaaaaatacaaaaattagttggatgtggtgctgggcacctgtagtcccagctacttgggaggggttgagacaggaggatagcttgaacccgggaggtcgaggctacagtgagccaagatcacgccactgcactccagcctgagtgacaaagtgagaccctgtctcaaagaaaaaaaaaatacagaagagaaaagcacaatatagacattatatggagaaagctgtgtgtctttcccctctatccctttaaaccattttctcagggaaaccaccattaatgctttcttaatttttaggaatttttatatatagtaaacacaaattggaagcatcttcaacttacatctgcaaatgccacttaatactatatgtttttatctttcaagaaaaattgcatttactggtattgttattttgcttgtttaaagtgagtttgcttctttttaatctttgaaggatgtgaaaacgtgcttttatatttctttataattatttatagagcacattttatttttaatttattttattttattttattattattactttttttgagattgagtcttgctgtgtagcccaggctggagtgcagtggcacgacttggctcactgcaatctccacctcctgggttcaagcgattctcctacctcagcctcctgagtagctgggatcacaggcgtgtgccaccacacccagctatttttttttttttttgtagtgttagtagagacaagatttcaccatgttggccaggctggtcttgaactcctgacctcaggtgatccacctgcctcggcctcccagagagctgggatttagaagcgtgagccaccactcccggccaatatatttgtatttgtaagttcacatcattcaaaaatctttatatctggtttctacctatttgagacaatatcctatgaattggtttttaaattaaaagaacatcatattggggagaagattgctctgtaatgtttgttcaagaaagcagcaaactaggctgagtgcggcagctcacccttgcaatctcagcactctgggaggctgaggctggcggatcacttaaggccaggaattcgagaccaacctggccaacatgatgaaaccctgtccctactaaaaatacaaagattagccggatgtggtggcatgcacctgtagtcccagatagtcaggaggctgaggtgggagaattgctggaacctgggaggcagaggttgcagtgagccgagattgcactactgcactccagcaagtgcaatgagaccctgcctcaaaaataaataaataaagcagcaaactgattttttaagcaaaaaaaaaaagaaagaaagaaagaaaaaggctgccagtatcatgtgaaatttagagccctacttctaaaataccgttgctgcataagaataggaatttctattattgtagtatgaaatccatgtgttcatttcatgaagtactggggaatttgctctcatgagagtttttcttgtcccttgtttaaattcctggtccccctttttaatacctggagttgctctttcttttcctcttaatgtttacctggtggtatctgggtgcttaagcaagtctaccaagcagattagaaatactattgtagaaggctgggcgcagtggctcacgcctgtaatcccagcactttgggaggccgaggcaggcggatcatgaggtcaggagatcgagaccatcctggctaacacggtgaaaccccatctctactaaaaatacaaaaaattagccgggtgtggcggcgggcgcctgtagtctcagctactcaggagggtgaggcaggagaatggcgtgaacctgggaggcggagcttgcagtgagccaagatcatgccgctgtactccagcctgggcaacagagcgcgactctgtcttaaaaaaaaaaaaaaaaaaaagaaatactgttgtagaaaatcatctagtgtttctaaagagatccccaagaagaggttcacactggcccatcagcatctggacttttatgtccagaagcactaagattctggacatttatgctggccctttggaatcccagtacattactgatctaggaaaaggcagaaaagatctatgtgtaggtcagttggagagcaaaagtagctgggcatggtggctcatgctcgaaatctcaacacttcaggaggccaaggcaggaggatcgcttgaggccaggagttcaaggccagcctgggcaacctggcaaaacccattctctatagaaaatacaaaaattaaccaggcatggtggtgtgcatatgttgtcccagctaatctggaggctgaggtgggggaatcgtttgagctctgggggtcaaggctgcagtgagccgtgatcacaccagtgcactccagcctgggcaacagagtaagaccctgtctcaaaaataaaaagagaacaaaagtataaagggtatgctgtgatagacctggccagaggtaagatcaccaattataaaagggattgtgcagaaagaaggggcaggaattcagaaggctacccttctgtatgattccatacatacgatgttctagaaaaggcaaaactgagggacaaggaacacagcagtggttgctagagatggggagaggggttgattataaaaggattaacttcaaggggtgaagaagctgttgtgatgctggttacattactttaggcatttgtcaaaactcagtactgtctgccaaaaaagtacattttattgtacatagatgtgaaaaaccaagaagatgagggaaacgctgtttgtcatttgatcatggttacataaagttcagaagagggctgagcgcagtggctcacacctataatcccagcactttgggaggccgaggtgggcagatcacttgaggtcaggggttgaagaccagcctggctaacatggcaaaaccctgtttctactaaaaatacaaaaattagccgtgcacggtggcacaccacgtagtcccagctactcaggaggctgaggcgggagaatcgcttgaacctgggaggtggaggttgcagtcagctgaaatggtgccactgcactccagcctggcaacagagcgagattctctcaaaaaagtgtgtgtgtgtgtgtgtgtgtgtgtagaaattgttcagatagttcagaaggttatacaatgaaaagaaaaaacctttactcccaccccaggcccagtcatgttccccagatgtcatcaccctttaacagctcactctgtatgtgtatatatagtgctgttctgtgccggcttttttacagaatttatcttggagatgtcagcacatcagtgcacataaatctacctcattctttttatcgagtgcatattttctgacggggagtatttcctaatttacgtgaccagtctgcattaatggctattcaaatggcctatgccaggagataactggaaacaagacagcaatgaatatttgtatgcattcaactttgtgcacctgtctaaatatagctggccgtaggacataaccgcaagtgtcattattgggctgaagtcatacacagtttccattttgatatggatgatgccacactgccctcttgggaggtcaacaaatttgtattcctattagctggcatatgggagttcaacatgcacatagatatttgtgaagtagggccaattgcagtggcttacacctataatcccagcactttgagaggctgaagtgggagcattgcttgaggccaggagtttgagaacaacttgggcaacatagcaagaccccatctctacaaaaaatttaaaaaaattaaccatgcaagatgacgtatgcctctagtcccagcttctcaggaggctgaggtgggacgatcacttgagcccaggaatttgaggctacagtgaactacagtgagctatcgcaccaccacacaccagcctgggtgacagggcaagacccagtctcaaaaaaagaaagaaaaaatccatgagtaaagtatagtttgtgacttgagtcaaatttatcctcactttctgaaagcattcacaatagaaatttaattatgagatgaaaattagcaaattatgtgttaataaagttggtattctgaggtttgtgggggcagttaaaaaatttttgatttttaaagttaatttttacaaatcttgatttttttttggccaggctcggtagctcctgcctgtaatcctagcactttgggaggctgaggcaggtggattgcctgagctcaggagttcatgaccagcctgggcaacacagtgaaaccccatctctactaaaatacaaaaaattagctgggtgtggtggtgtgtgtctgtaatcccagttaccctagagggtgaggcaggagaatcgcttgaacctgggaggcggaggttgcagtgagcccagatcgtgccactgcactccagcttgggcgatagagcgagactccatctaaaaaaaaatttttttttgatttttaagttacttgaggggtaaattttttttaaagaaagaatgtatttcattttccttgtatttttaaaatatttttattgtggtaaaacatatatacataaaatttgccatttaaaccatcttaagtgcataattcagtggcattacttatattcacattgttgtacaatcatcaccactatctgtttccaaatcaaataatattttttaaattgtggcaaaatgtacgtaatgtaaaattcaccattttaaccattttaagcatacagttcagtggcattaagtagattcacattttggggaaacatcactaccattcatcttgagaatttcttcatcttcccaaactgaaactccttaccccaacctcccctttcctcacctcctggcaacctccgttctgctttctgtctctgtgggtttatctactctaggtatccatgtatattttttctgtgtcaaaaattgctttgaaaaacacatagtgcaaattgcaaagataaatgtgggctctcttataggagtgccacacattttacatttttctttgcttctgcttcttggagtgcatgctgttgtcatggaaagcaggcattctttggtagcccaggttctggaacggtgcctagaatagctgctcactgtgtttgccagattaactgatggatatatgaaaacagtatactgcgtgacaacacctttgttattccataggacatggacatcttccagcaacagatctcgagaagacagctggctaaaatccttatttgtccggaaagttgatccaagaaaagatgcccactccaatctcctagccaaaaaggaaacaagcaatctatacaaattacagtgtgagtgacaggtttgctatcttcatagttgactttttttcccctttgttcctaagtttatcgttgaattttcttttgtttcagttcacaatgttaaaccggaatgcctagaagcatacaacaaaatttggtgtgtataccaaactatcctttacttggggaaaaataatgactttatttgttagttaattccactaacacttgatagcatagagagagatctttcatccctctcttttgaagctgaacattcagaggctcttaaactgagcttcatgtgggattgccgaaggcgttttgattttaagcactcacacagctaaatcatcatataggctatcagactttagaatgttaccagactcttgtgtttggaggaactttgccaggctgtctagtccatctacttatccagtgctggagtcctttccacagaccttcctgactgcctgtcctgaagtaagttccatctctggacagctctgagtgttaggaataagaattcacatctctgagtccttcattgattcccctaagtaaaactgccctgtgagagtcctgtatgtatttgaacatagctgccatttcttcccaactcctctgttctccaggatccaagtcccttccgctgattctcctatgatttgcgatctaaacctgcttacagaatttgtaaactttaagacgaaaggggagaactaagcttaccagcttttaagttaacagaaatagtattttaatgacccatggtgagcaaatgtgaagaaaaaggtttttagtttagttttgtttttacctttaatatctactacgttcttaagaaagcaaacaattttgtccctataatcagcatactttttagaagaaaaaccttttgttttttattgttttgtttttgaagatagcttatgaaatgtaacaatagcattgaatttcttgctcattccagcacatttctctttattaaaaaatgcccttaaaacaaagcagatgtttatttctaagtcttttctcataaaaatggaatttttccctatgccgatgttgtcctggattaccttttttgtcctgtcttatcacttcgtctcctgtctcgggtttctggctgtctgttcctatttctatttgatgttgtgctctcacttcacacccagcatgtagaatcaccttgctcttccaacttccctgtctgtgccactcaccttgttttactcagcccgttccttagttctctgtggtgaatctgtcacctaagccgtgcattcttcatcggacatgtattttggttctcttgtttccttctccatctctctctccaagcctctcgagccccattcccaagtagctttttttctgactacctttctgggctccaagctatacctgtgtctccttcctgccctgcaatacattaccccaaagtttgtcagattgatctgcttgagttctgttttcttttttcatcacgttttttcttttctctgaaactttcagcagctccctgtttgcagaacataaagacttaactcctgcctggtttttaggggtcccaataatgggattctgcccaacccatccagttctgggtacaagtactgcctgccttacaatctccattcaggtaaggccagggctcctaagagcaggtttggggtccccagcaaagaggagtggctacaaatccatgcgtgactttgtgttggtgaaaaacctgggccccgttgccaggcccctttctggaccccacctgaatcatgtgtactgggcttcctcctgggcactgcctccaatgcagggttgtctattcctgctcatgtcatgcgacgaaaaggaaatgttggacatacatttccctagcagaatccctctttccctgtcctcgattttcattgatcccatgttatttctgaacattcatgagtcacgcatcagatacatttaatatcagatcctaatttaaaaagtaaatgctactcttccaaaagtacacatgatgtggtcactatactgggtcataaagatgtatgggttttcagttagttagacttagaccgttttggaacttttctctgttaaccatttatgtatccctggtcgtatggagctccagtggtgcagtcggttagcacatggtacttacatacccttggtcctgtagccccagcatctggtggtgatcactagctaaatatcagagtcagcaaatagtgtgaacaggttccatttcttgcccttgatccccttttgcatccattgttgaatctgtatgatactttttcatcataatttttctattcaaaaagtgtgcaggttttagcttttctcttggtgtaaaacagttacactcttccctttgcctttccctgtacattagaatctataccataggaaagcttccatggaaccaagctccactctgacacccctgttaaattcatacactgccgtgacctgtcatggctttgtccctgtccctgcacaatgcgcgggaatgaattggttggtgtgttcggtgcgagactacgtgacacccctcccatccccttggcccattgaattgagtagaacataatttatgcttcgcattgtatctttaatttttattcttctgccatgttgatgcccttggggagtattggaggttggagtcgcttccagactatgttgtgttccagctgtcttcttgctccttcctgaaggccagcttgttctctgctcctgttacctctgcctgctggtactgcttgtgttgtctgcctctgtcttgaacattactttcctccctttccatcttccttatttcttctgtgttcttttctactattccccgtctctcattcttctgtctttggaaccaacagaatgttttttggtgatgtcgttttttttcccctcaaatggaaaatagtagacccatagctcccaaaatcctgggacctttggtttttctttatcatcattatactgattgaacaactcttctagatagttggggtatcagaaacctaagcttctgatcagcagggtgttggaatacaacataattcagctaaaaggttaactccacatgccgttttatcatgatgttctaaggtcagttgttagaacacagagtaggtggtctttttcctgttactgatcaggtgctgtccacctggtcaaattttgctggttgtttaattagtgttgctgtttcttctctttaagtcaagaggtgttgccaaagattcacgaagataaacactacccttgtactttggtggggacttggaacacgtggtatggcgagcaggaccaagctggtaggaagcgaagtctttggaataaacacttcttccttaagccttatgtaacacttaagtaattttctaatttaatgcttgttcttatcatcaaagctttccaagtctcagtctaattttatgattaaagtagtttcttcaacaattcattgcgaaaatggttttaaaattgtttttaatgtttgaatctattattgaaccattatgatgtaactcataggccaaaacatggggcattacagtttttttgttttttgagacagagtcttgctctgttgcccaggctggagtgcagtgatgagtatctaggctcactgcgacctctgcctcccgggtttaagcgattcttctgctttagcctcccaagtagctggaaatacaggtgcccaccaccacacccaggtaatttttgtatttttagtagagacagggtttcaccatgttggccaggctggtctggaactcctgacctcaagtgatccgcctgtctcagcctcccaaagtgctgggattacaggcatgagccaccacacacccagcctacagttttgtgctgtgttaacgttatacctatctagaacattttcaagtagtagtatcatgaaattctaaacgtatactgtcttttaaaatgcatttcagtccacctctggaggtatgaaggaggctatccagccctcacagaagtcatgaataaactcagagaaaataaggtaatgatattgaaaaatgtttacttagactaatgatatatagatgttagtacagaattaaatgacttttctgtcttcagtttttgttaataaacttcatttttttgtaacagaaattttattgtttggactcctgaagttgtatttaaacataaacagttgtaatactattcaaacaacaattctgaccgggcgcggtggctcacgcctgtaatcccagcactttgggaggccaaggcaggcggatcacaaggtcaggagattgagaccatcctggcttacacagtgaaacactgtctctactaaaaaaaatacaaaaaaattagccgggcttggtggcaggcacctgtagtcccagctactcgggaggctgaagcaggagaatggcgtgaacccgggaggtggagcttgcagtgagctgagattgcgccactgtactccagcctgggcgacagagcaagactctgtctcaaaaaaaaaaaaaaattcttattgttcttattataaaagtcaattatgctttgaaactgataaggtggtactttgaaaccggtgactgggctgggtgcggtaactcatgcttgtaatcccagcactttgggaggccaaggcaggcatatcagttgaggccaggagtttgagaccagcgtggccaacatggcaaaacctcatctctactaaaaatacaaaaattagccgagcatggtggtgcacaactgtaatcccagccactcgggaggctgaggcacgagaattgcttgaacccagaaggcagaggttgcagtgtgccgagactacaccgctgcactacagcctgggcagcagagtgagactctgcctcaaaaaaacaacacaaaaaaaacccccaaaagactggtgactggtgtatcaatcagcatggcaggcacaattagctctggatgacctaaaactgtctaattcaggaactgtttgtcacacacatagagtttatcttgggctgactttgctttccaccctcccttcactagcaggtgtttgtcaatagggagaaatttaaaagccacacatcattaagaaagaaattcttttgtatagattcccagacaaatataaataggttttgaattatctgctcttttgtagtctgcatgctacttctattgatgtgccatcaaacactgttagaagaatctaaaaatatagcaaattaaatttgtttgcattgccacctaaataattaggatgaccaagtaatttgtcatctaaacctggacacttttgagaatgaaaaggaatgctgttaatgattatgcaagctcaacagatgtaaactgggactgtctcaggccaactgggacctgttgattaccctattatagtattctgtaggaacatcaatgttactgaaatgggcttatatgtaagtatcagaagatttcatgagcacatttttttcactcaaaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgagtaagtacagaaatataagttattccttttactcctctgtgaaaaagcacaagcattttgtaaggctgacaacagaacttgtgtgtacattctgtgatgtatgtctagcattatatgtatatatatgtatatatatgtatttttttaagactgggtctcactgtcaccaaggctaagctcttttgctttttatggccttacacataatgcttattatttgatatttttctaaataacatatttgtttttaagaagaaagacctaaagtgcaggataaggtacaatatgtaacatctgttgtggttaaaggagagcagctaataaacactgtgactgttgaacaaattatataacatgataagagtaaaaggcaataatataacactttctagaaattttcctactgaggactagaaagaaagccccacatagcagcattattaaagtggctaatgcctgtaatcccagcactttgggaggccaaggttggaggattgcttgagccaggaagcttgagaccagcctgaacaacatagtgagaccctgtctctattaaattaaaaagtaaagttttggctgggtgtggtggctcatgcctgtaatcccagctttttgggaagtcaaggcaggtgggtgacctgaggtcaggagtttgagaccagcttggccaacatggtgaaaccccatctcttactaaaaatataaaaaattagccaggcatggtggcgggcgccggtaatcccagctactcaggaggctgaggcaggagaattgcttgaacccaggaggcggaggtttcaggagctgagattgagccactgcactccagcctgggtgacggagcaagattctgtctcaaaaaaaaaaaaaaaaaaggttttttgaagttagttttgtcacttaatgttttttctactgctgtttgctatttctgtattttttttttcacagaagaactaacaaaccaaatctaaatctgttttcagccaggaaccatgattgaatggggcaattactggtgagtatattactgaatggtgattttttaagtcttgtgaatagattagtttaggccatagtgttaattctagggaaaaaaatctgaggatagtactgtgacttaacactgcactaatgtttcgtttgatgtttttattatgagatttttcaaacatacaaaactagagagaataatggggctccccttccacatccatctcttagcttcaataattaacacatggccaatcttgtttaggcctaactccttcaacccagattgtttggaattaaatcccagacagcattctatttcattcataaatatttcagtactatatatatttctaaaagataagcaccttttttttaaaagcaaaaccaatattgcataaggttagtttacatacttcttggatatcatcttttctgaaacgttacttttgtcatatatacacaccatgtcaataatggtttcttctttttttccttgctagtttgagtagaaaaataacaatttttccacaagttgatatgtagattcagcagaatccctatcaaactctcagcaggctttagaagtgcaaaagactagccaggtgcactgtggctcatgcctgtaatcccagcactttgggaagccaaggcaggagaatcactcaagtccaggagttcaagaccagcctgggcaacatagtaagacccccaacctctaccaaaataaataaataaataaaactagccaggtgtgatgccacatgcctgaggtcccaggtatttgagaggctgagtaagagaattgcttaagcccagaagatggagtttgcagtgagccaagattgcaccactgcactccagcctgggcaacagagtgagaccctgtctcaaaaaaaaaaaaaaaaaaagtccgggcatgttggctcacacctgtaatctcaacacattgggaggctgaggtgggcagatcacctgaagttaggagttcgagaccagcctcgctaacatggcaaaaccccatctctactgaaaatataaagattagccgagcgtggtggtgcactcctgtaatcccagctacttgggaggctgaggcaggagaattgcttgaacccaggaggcagaggttgcagtgagctgagatcacaccactgtgctctagcctaggtgacagagtgagactccttttcaaaaaaataaaataaaaataaaaataaagactgggcatgatggctcatgcctgtaattccagcactttggggaggctgaaggaggagaattgcttcagcccagacgtttgagactttgagaccagcctgggcaacatgacgaaaccccaactctacaaaaaaatacaaaaattaaccgggcatggtggcacacacttgtagtcccagctcctcgggaggctgaggtgggaggatcacctgagccttaaaggtggaggctgcagtgagccatgattgtactactattcagcctgggagagaataagaccctgtctcaaaaaaataaaaaattagggcggggatggtggctcacacctgttatcccagcactttgggaggccaaggtgggaagatcacttgaggtcaggagattgagaccagcctgaccaacttggtgaaaccctgtctctactaaaaatacaaaaattagccacgtatggcggtgtgcacctgtagttccagctactcaggaggctgaggcaggagaatcacttgaacctgggagacagaggttgtagtgagccaagatcaccccattgcactatagcctgggtgacagcagactgtttcaaaacaaaacaaaaaattgccttactttcagtgatactaaaaaaaaaaatttaattaaaaagacaagtcatatactggaataaaatatttgcaaatcatatgtctgataagcaaattgaattcagaatagataaataattcttacaactcaataataagaatacagataactcaattaaaaaatgggtaaagaatttgaaaagacagcagctgggtgtggtggctcacacccgtaatcctagcactttgggaggccaaggcaggaggatcgcttgatgctaggagttggtgaccagcctgggcaacatggtgaaaccctgtctctataaaaaaaaaaaaaaaaaaaaaaaaaaaaaacttgccaggcgtggtggtggcacatgcctgtagtctcagctattcaggaggctgaggtgggaggattgcttgagcctggggaggtggagactgcagtgagccatgatcatgccactgcactcccagtgagaccctgtctcacaaaaataaaaaataaattgaaaatggaattagtgtgattcagcagtcccacttctggatatatatccaacagaattcaaagcagatctcaaaaagattcgcatacccatgtttatcatagctttatttgcagtagccaagaggtagaaacaacccacatatccatcaatagataaatggataaagaaattgtgggctgggtgcggtggctcacacctgtaatcccagcactttgggaggccaaggcaggctggtcacccgagctcaggagtttgagaccagcctggccaacatggcaaaaccccgtctctactaaaaatacaaaaattagctgggcgtggtagcgtgcacctgtagccccagctactcagcaggctgaggcaggagaatcacttgaacccgggaggtggaggttgcagtgagctgagatcgcgccactgcactccagcctggcaacagagcgagacttcatcccccgcctccaaaaaagaaggaagtcttgtcttatactgcaatatggtgaacattgaggaggatgtaatgctaagtgaaataagaggacaaatagtgtatcattctccttatgtgaagtatccagtgttgccaaaatcatagaaacagaaagtggaaaggtggttgccgggagctgggcagagagggaatacggaattggtgtttattgagtatagagtttcagttttacaaaatgaaaatgttttggagatctgtggcataacagtgtaaatatactggacactgcataaaaatgggtaagatggtaaattcaatgttaacgtgttttttttaccacaataaaaaatacgtttaaaaaatgtttaggccaggtgcagtggctcacagctactttgggaggctaaggtgggcagatcacctgagatcaggagtttgagaccagcctgggcaacatggtgaaaccccatctctacaaaaaatacaaaaattaaccaggtgtggtagcacatgcctgtaatctcagctgcttgggaggctgaggcacgagaatcacttgaacctggaaggcagaggttgcagtgagctgagattgtgccactgcacttcagcctgggctacagaccctgtatcaaaaaaaaaatttttttttaaataaattttaaaactttttaacggacaaaggatttgaataggatttcaccaaagaaaatacatgaatgcccataagcttatggaaagggactcaaccttcttagtcattatggaaatgcaaagtgaaactataatgggataccagttcctgcacactgggacagctgtaacttaaaagagatagataataacgtgttagtgaggtgaggagaaagtggacccttccgatattgctgatgggaatgtaaaatggtgcagccactttggaaatagtctagtagtccctcagaaattacatgtgggctggacgcagtggttcacgcctgtaatcccagcacttaacgaggctgagggcgcggatcacctgaggtcaagaattcgagaccgacctggccaacgtgacaagaccccatctgtgctaaaaataaataccaaaaacgtagccgggcatgttggtgtgcacctgtaatcccagctactcaggaggctgaggcaggagaatcgcttgaacccaggaggtggaggttgcagtgagccaaggtcacgcctctgcactccagcctgggtgacagagcaagactccatctcaaaaaaaagaaaagaaaaattacatatgacccagcaatttcattcctgggtgtctacccaaaagataccatccatataaacacttatatatatgtgtataagtgtttcttatacaagaatctttcctccttggatcatcaaaggctaaataatgcaagttagaaagcaaacatccatgtaaacacttaagtgaccatagcagcatgttttataatagccaacaagtagaaacaacctaaatgcccatcagcagagggtgggattagccagagggccagtttactagccctgctttaaatgataaagctgtccacgtcctcccaggagctaccttaaattcaaaacacaagaaacacaagaagcatgctgattacaattgtaacaaaataccagctttcaccattatgatttaataccgtttttagaaatcctgactattataatatgagaaaagacagagacatacaaagcctcaataggccgggtgctatggctcacacctctaattccaacacttcgggcggctgaggtgggaggatcccttgagcccaggaggtcaagaccagccttggcaacatggtgaaacctcatctctacaaaaaatactaaattagccaggtgcagtggtgcacttgcctgtagtcccagctactctggaggctgagcaggaagatcacttgagcccttgctgttgaggctgcagcaagccatgatcatgccattccactccagcctgggcaacagagcaagatcctgtcccaaaaaagcctcaataattaagagggatgcaagaataaattattgaccattggttagctgaagtcagtgcctaggacaggaaatggaaagaaaaacactagtgacatttagggttctgtgatggtgagattgttggtgttttctttttaccagtctccatacttacttcattatgggatttctttggaagctaaaaatactgcctgggcatggtggctcacgcctgtaatcccagcactttgggaggctgaggcagacagatcacttgaggtcaggagtttgacaccagcctggccaacatggtgaaaccctgtctactaaaaatccaaaaaaaaaaaaaaaaaaattagctgggtgtggtggcgagcacctgtagtcccagctactcaggagatggaggctgcagtgagccaaaatggcactactgcactccagcctgggcgacagagtgagactccatctcagaatatatatataattttgaaacattgggatagtttcctaaaataatctgaagcatacatctatatctaattcaacaaaagatttatagcattttttttctttgaaacttaacatatttctgtaccttaatttttgtttcttttctttttttttttttttaagacggagtcttgctctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgcctagcctgttttttgtttttaggggaagatgtgtgtgtttatttctttgaagtaattatgttaactcttacttttctttggcagcttgctatttctgtttcctaagctggcatttcataactatttacccacaaagggggaggccacatggtgctgagaaaaagctttgggtttgagttacttgacagctctcaccttgaaaagagaacttgtacctttttgcctttttttttaacttcaacttatatcttttcttttttctttttcttttttttttttttgagacggagtcttgctctgttgcccaggctggagtgcagtggcgcagtctcggctcactccaatctctgcctcctgggttcaagcgattagcctgcctcagcctcccaagtagttgggattacaggcgtgcaccgccacacctggctaatatgttttgtatttttagtagagacagagtttcgccatgttggccaggctgatctcgaacttctgacttcaagtgatctgcctgcctcagcatcccaaagtgctgggattacaggtgtgagccaccgcgctcggccccagtttttctcttttttcggttatgaaatttcctgctgtgcatgaaataatttctaagatcccttctgtctccaacaaatagttctgtgatctttatttctaatgaacctttcctccttagatcatcaaaggctaaataatggaagttagaatttcttttcatttgaaaactaagaaatacatatttggttgtatgctactattatatacaatttttgttcttttgtttttggactattgttgttaatcatgtagctactcacggaataggattactcactagttcaatttttgcccattactgatcaagactcgctcgccgtggaatccacagggacatactggggttattcagttatttaaaaaattatttgaccaggcgcggtggctcacacctgtaatcccagcacattggaaggccaagatgggcagatcacctgaggtcagaagttcgagaccagcctgaccaacatggagaaaccctgtctgtactaaaaataacaaaaattagccaagtgtggtggtgcatgcctgtaatcccagctactcggaaggctgaggcaagagaattacttgaacccatgaggcagaggttgtggcaagccaagatcgcaccattgtactccaccgtgggcaacaagagtgaaactctgtctcaaaaaaaaaaaaaaaaaatatatatatatatataatttataaagccagtttagcattcaatttatattttggcacataggtaactaagatggtgaccacctcgtctgtacaggcttctgattgttaccaggctaaggcaagtatgttttgtttgcctaccataactaaattacaaaaattcagaatgaaatgaataatctggaatatttatcactatcaatgaaagccaggtttttttcttctgaatagagttagaatgcacattgaagtgatttgcttaatttcaataatcagatttataatttctgtgaagatattgatcacttaattctcaatgtaaagattaaagatgtcatcttatttgtggataatccatgggggcaatagcaagaagtccctttttcaccataaaggaacccaagcgcttgggtaaggttcccatcatggcactgagcccatggtggattagagcagaggtgtagagtgattttaaggagactggattgcttgagcccaggagttcgagaccagcccaagcaacatagcaaggccccatctcaacaacaacaaaaacataataaaaaataaaaaattggctgtgcttagtggtgcaagcctgtagttccagctactcaggaggccggggcaggaggctccctcgagcccaagagttccagactgcagtcagctaagatcatgccactgtactccggcctgggtgacagagtgagtctctgtcttaaaaaaggagattggcttagtcactcacaggaaatcactcttggatttttttcccccttttgagatgttatcattcagtatatatgaagtttgcctccaggaagagaatgctcagccaagccaactcaagcatcttgtgccttgagagtgacatctttcactgtcattgttagtaggttgctatccttgtttatatgctgccagctcttttgaatgaattagagtgaatctgtcttcccaagtcttgtcacctgtgggaccctgatatgactgagacttcaggccagagcctgggcagtgtggtatggatttactgggtaatgcatggtgtgtcatctcctgatagaccttaaccatgtgtcttctggtgacctccctatgtcatttgaagccccttccttttcacctttgattctagaagactgcttttgaaaaaatgggcacattttaaaacatttttaggaattcagatgcatcactaaatattttttttttaagtggtgcaagtatgaaaggaaagggctctgagccaggcgcagtggctcacacctgtaatccaagcacttagggaggctggggtggacagatcacttgaggtcaggagttcaagaccagcctggccaatgtggtgaaatcccatctctactaaaaatacaaaaattagccaggcgtggtggtgcacacctgtaatcccagctacacaggaagctgaggcaggagaatagcttaaacctgggaggcagaggttgcagtgagccgagatcccgccactgcactcctgagtggcagagtaagactccgtctaaaaaaaaaaaagggctgtaggctggcctggtggctcatgcctgtaatcccagcagtttgggaggccgaagcggggcagatcgagaccagcctggccaacatggcgaaacctcatgcctaccaaaaatacaaaaaattagccagacgtggtggtgggcgcctgtaatcccagctactcgggaggttgaggcaggaaaatcgcttgaacccagaaggtggaggttgcagtgagccaagatcgtaccattgcattccagcctgggcaacagcgagactccatctaaaaaaaaaaaaaaaaaagccgagcgtgatgtcatgtgcccataaccccaactactcaggaggctgagacacgagaataacttgaacccaggagatggagattgcagtaagctgagatcacgccgctgcactccagcctgggagacagaggaagactgtttcaaaaaaaattaaagagctgataccttttgcagtgggaaattcttaaagttttaagccaagtgcctatttttaactgatcatagtgtgatgtccacagaggcacaatgtatattagtactttcttccatatttggtacataatgaatgcctttggtactcattttctgaatggtttgctctagtaggaaagaaaaaaaaaaaaagcaagaggcagctttgcctgcactactgaggctgtaccaccagaaagcttcattcccatggttcctctgtatggcatccaagaagttgcagagtcccttgtgtagttcagagagcaggggtgtttctcaggatttcagagtcatcagctgctttgaaggtgtgcttccttcacctgtgttttaacgccctgccccaggggtggtccctgtctcccttgggtacagtgccctgtggcaccttgggtgctctagttccaggtttgcctcgcttcccctctgagggtgttctggagaagcagtgctttttaaattgacgggtcccatcctctgccagttctagactttatttcaagaatcaccagtgcaactatatatacatcttcaggttgctgtttttatttttaataattattaaatacattttctcaaaaaaattagtatagctacagaaaagtatgcttacatttcatatacattaaaatgacttttagaccaggtgtggtggctcacgcctataatcccagcactttgggaggctgaggcgggcggattacttgaggtcaggagtttgagacaagcctggccaacatagggaaatcttgtctctactaaaaatacaaaaattagccgagcatggtggcgggtgcctgtaatcccagctactcaggaggttgaggcaggaggatggctcgaacccaggaggtggaggttgcagtgagctgagattgtgtcactgcactccagcctgggtgacagaatgagactccgtctcaaataataataaagtaaataaaataacttttgatttgccttagataacttgataccagtttgataaaccattagtcttcattttaaacagcctgccctgagtatggtgaaggtttagtctaccgattctcgttagcgtatctaattcagtgtcttaaacaaacatcatctcattcttacagggctcgtgcaatccgcttcagacaggatggtaacgaagccgtcggaggattcttctctcagattgggcagctgtacatggtgcaccatctttggggtatctgtttttcccttttcgagttactgggatttaagagttcattactaagttgtactgggaagtagagcacatcttgagtcagtaaccttaaccactacagcaaatccgacgtcacagagggacagtctgtacggggctgtctggaactagcgaggtcaacagtgaaagtccatagattgatggcattagtgagctgaaagtgagtagggatgatggggaaaggaataaggggtaaagcaagcagccatggaagaaggaggccagggaagtcaagagtgccttccacagagtggtcccagcctttctttgtagactgactgcttacttcctcgacagaggcaggcctgcattttacccagagcagcagcttcctgcacatactcactgcctgcctttgtagacgtggttccactgtctcatgacattgaccccctcaccatttccatccccacacacttttgtttggcaccatctttggtatttttccaggcctgccccagatgtcacccttccccactagtgaacatcatcactcctcctgagcccccagagccttgtgtggtgctggttattaccgttgcggctgtatatggtgtgcaaccctcccaggcatgtgaataagcacaggtgctagaagggcaggattggatggaggaaggttccatccctttggctgttgggcagaggtcaagccaggtgcatgctccattcacatcagcacctgtagctgcccggagagggcctcccagatgcaggatcctggaatggcaaacaggcaggcaccagagtgtgaatggcggagctctcatagaggctgtggggaatgcaggacagacctcttgtctctgccctgtcgggaggactcaaggcttcacagagcaacagcaagttgaagatgattgcttgaggccaggagtttgaggctgcagtgagctatgactgtgccactgcactccagtctgggcaaatagagcaagaccctgtctcaaaaaaaaatgtaattaacaagatattggctgggcacagtggttcacgcctataatcccagcactttgggaggccgaggcaggtggatcatctgaggtcaggagttaagagaccagcctgaccaacatggtgaaacctcatctgtactaaaaatacagaaaattaggcatggaggcgcatgcctgtaatcccaggtacacaagatgctgaggcagaagaatcgattgaactcaagaggcggaggttgcagtgagccgagatcgcaccactgcattccaacttgggcaacagagcaagactccgtctcaaaaaaaaaaaaaaaagaaaagaaaccaaggcatctggatgagatacctgtgaattgtaccatgacacaggtgatccccctccacctgaagcgcctttcttcctattcctacgtcagtgatgtccttttcaacttcaacacccacctggtcagcttgcacctttcccacagctctcccattgcttgccctgctcccctatacactgtgtccttgtatgggccacggcactctccacaactgacctcgcctgcctcatatcctggggcttcaccgctggaacacactccctgcccagatcagtgtagtgcgagataaatgttgagtaaaattgatctgacattgctcatctgtggtctcacagtttctggtcatgaatttaacatgttattggagaatttcacttggtttataaaggtatatcttagattcactagattgtaaagcttaagagggaattgtgtctggatgtggtggctcacgcctcgattcccagcagttttggaggctgagtcgggaggatcacttgagtccaggtgtttgagaccagctcgggcaacatagtgagaccccatctcaaacaaacaaacaaataatttttttaacttaagaatgggccaggcgtggtggctcacccctgtaattctagcactttgggagactgaggcgttttgatgatttgagcccaggagtttgacatctgactgggcacaaaaaaatacaaaaattagccaatgtggtagcacattcctgtagtcccagctattcagcaggctgaggtgggaggatcacttgagcctaggaggtcaaggccgtggtgaaacatcatcgtgccattgcgctccaggctggttgacagagtgaccttgtctcagaaaaaaaaaaaaaaagactgaaagtttgcttttcccacgtggcctaatataattttgctcagaatttccccagcccagtatattacacacctgaagtagtccctgagaaaactagatgtccaggtgaagcaagactttaacggatgtatgggtggaatgcagtgtatgtgttttaagtcttacttctctgtgtggttatttttaagcttacagggatcttcagaccagggaagacatacggaatgcagcatggcacaaacatggctgggaggaattggtatattacacaggtaatctcttaacagccatgaaatatgctttttgtcttactgtttcaatcatgttctttcaccctgacactaataggtgggttttgtaatagtatgttgctaggatagtgagttatcaggttgtggggggaagggagatagtcaatttttctctaatacttacatgactttttttcaataaagtagaatatccatgctttcaaataggtatatcatctgttacagttttcagacccttggatgttgtaaattttacatcattacctgtttttgtagatttctatattctctgaaaacttattacacaaataaaatttttttctaagctttccttttccatcagaattgttagtatcccaaatcagaacttaatacatcaattaaagagtgattttgaaattagataaattaaacttcctgtatgtacagtatgtatctgggtacataatacatgcatgtgcacatacataagtatattatgaaaccctgtttgcttgatttttaaaagaaaacagttggctgaatgtaacccagtggcattggtagaggtaatcagtaccagccatgttgcatggcaagtatatttcaggccgggcgcagtggctcacgcctgtaatcccagcactttgggaggctgaggtgggcagatcacctgaggtcgggagttcgagaccagcctgacgaacatgatgaaacctgtctccatttgagagactgaggcaggagaatcgcttgaacctgggaggtggagattgtgccactgcactccagcctgggtgacagagcaagaatccgtctcaaaaaaaaaaaagtgtatctcagcccctatactaccaagaaaataaaagagtaatttgtcctagaaagtaggtgttaccttgtctttcagttcaagagattatataacatataattacatgttataattatataattgtatttgattttgctgcttacgcgaacgtttgagaaatcaccatttctcctcacagtatggacttttcctacctcccacaaataaaacaaatatccaggtaggatctggtttttttttttttttttttttttttttgagacggagtcttgttctgtcgccaggctggagtgcagtgacgcgatctcggctcactgcaacctccgcctcccggtttcaagcgattctcccgcctcagcctcctgagtagctgggattacaggcaggcgccaccacacccagctaagttttgtatttttactagagacagggtttcaccctgttggccaggatggtctcgatttcctgacctcgtgatccacctgcctcagcctcccaaagtgctgggattacaggtgatctgcgcccagctgatctgttgtaattttaatagcatcttgtaggatggcagctgatacagggtccgcttgtatatttctgcccttgaggttagtcctgtatattatgatattctcttgttttcaagcagcacatctgtgaacattctcggcaatctgtctgttagtgtcatttaccataatgtgtttagaaagtaacaagtgcagtaaccctgatcttgttttcagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacatatcacgtttggattttcttttttaatttgttctgagattgacaaacattgctgtgaatgaccttgtcactcttgcaaaatagcttgtcacaaaagattgaaggaagtgaggaagtcagctggcttctggggaaaatccctccataggaacaaattacgaggccctgggcaaggtcatgcctggtatgtgctgagggcagcagaagccagtggcagaagcagacatgagggagagtgtggtgggacacgagctcagaggtcacagggctggatcccttgagtgttggaggccattagaaagaccctagtggccgggcccagtggctcacaccagtaattccaacactttgggaggccgaggccagaggatcccttgaacgcaggagtttgagaccagcctgggcaacatgaatgaaacctcatctctacaaaaaatcgaaaaattagttgggcatggtagcatgtgcctgtagtcccagctactcaggaggctgaggcaggaggattgcttgagcccaggaggtcgaggctgtaatgagctgtgattgcaccactgcactacagcctgggcaacagagctagatcctgtctcaaaaataataacaaggctgggcacagtggctcacacctgtaatcccagcactttgggaggccaaggcaggaggatcacctgaggtcaggagttcgagatgaacctggccaacatggtgaaaccctgtctctactaaaaacacagaaattagctgggcatgggggtgggcacctgtaatcccagctacttgggaggctgaggcaggagaatcgcttgaacccaggaggtggaggttgcagtgagctgagatcgcaccactgcactccagcctgggtgacagcgagagcccgtctcaaaaaaagtgagactagaggagctcaccaagggagtgactgtagtcagaggagaggatcaagatgaggaggaacctgcaaaagagactaagaaaccaccagggaactcagcagacactcaagcaagtgaggcgtcatgagagccaagtgaaagtccatcagagatcacctctgtcaaatgctgtcaagtggctgggccagatgtggtccccaaactgttcatagttgggtgcagtggctcacacctgtaatcccagcactctgggaggccgaggcgggcgggtcacctgaggtcaggagttcgagagcagcctggccaacatggtgaaaccccatctctacaaataatacaaaaattagcttggcatggaggcatacgcctgtaatcccagctattggggaagctgaggcaagacaatcacttgaacttgggaggcggaggttgcattccagccttggtgacagagcaagacaccatctaggaaaaaaaaaaaaaattcatgaatttagcaacatgatggtcactaagtgacctttgataagggcattctattcttgagctattttatgaaattatcactttattttagcaattcctgctcagtttgacaagtcattttactgaatttctatagcacaatgaatcattattttgtcccactattaattttcttttttcttttttgagacagggtctggctctgtcgccaggctggagtgcagtggaacgatcttgggtcactgcagtctccacctcccaggctaaagccatcctcccacctcagcttcccgaatagctgggaccacaggtgtgcaccaccatgctcagataatttctgtatttttttgtagagacagggttttgtcgtgttgcccaggctgggctcgaactcctgggctcaagttacccacctgggccttccgaagtgctgggattacaggtgtgagccactgtcctcagccacactattacttttcattggcagtattcaaaacttccaaactcattttcaatttattggttataagtctgaggaatattacttataaaagccaactcatttttcgttatcacacgtgaggtttttaagtctgtttcaaaaagcaagtgtgc

SEQ ID NO: 17547 - DNA, 84870 bp, Human
  misc_feature (1)...(84870): n = A,T,C or G
aggtgatggttgcaaaactttgtgaagatacttaaaactatcaaattttacactttaaatgagtaagttgtatggcatgtgaattatctttttttaaaaaaatgagacgggatctcactgtgcattgtgttgcccagggacggagtctcgctggagtgcagtggtgcagtctcagaggctcacagcaacctctgcctcctgggtttaagcgattctcgtgcctcagcctccggagtagctgggattacaggtgcccgtatattttataatatattccataattaatcgctccgtattaaacttgctgatgcaggtctccaattactgaaaaacctgataccaagtttttcaatgggatttttttgtttgtttaagagatggggtctcaccatgttgctcaggctggccttgaactcctgggctcaagtgatcctccagcctcagcctctcaaaggctgggactacaggcatgtagcactttgcctgactcaaggggaatttttagtaagagtatataatccaagtctgtagcagttggaggatgtcgtaccacgctgaagtgtcacacataactgatgactcagtcccccaagcctattttatcatcgtaaagaaagctatttctttgattattccaactctttcagcaccaggactgctgcaggggctggattcatgctacctgtagttgcagtgtaaattatgtgtcagagccaagatcctaggaaagtcaaagactaggttacaagagcgattcttttttttttttttttttttttttttgagacagagtcttgctctgtcgcccaggctggagtgcagtggcacagtcttggctcactgcaacctccgcctccctggttcacgccattctcctgccttagcctcccgagtagctgggactacaggcgcccgccaccacgcccggctaattttttgtgtttttagtagagacggggtttcaccgtgttagccaggatggtctcgatctcctgaccttgtgatccgcccgcctcggcctcccaaagtgctgggattacaggcttgagccaccgcgcccggccaaggacgattctttctaatctttggtaagccagtttttacagaatgaaatgctcttggattgactgacttgattgggtaagtattcattgggctcttgttccatgcaagggcagtctacaagggcctagatatgggggcccccaaagaagaaaaatcggtttttcatcatattttctggttgagtttcttcctttattatatttgttacatatgttattaaattatttccataaaagaggttatgctgagcaggtaaccaaattcttgttcccccaaaagacatgtataattcagacgatttatgcaattagaagaagggagacttcatcagttaataaagtctagaacgtgaggaagcccagtcatttccaggaccttcagatgcccaagctggatccaggttttccaccccgacagctccagggagcacgctggagagacagacttcaccagcgggaaggcgcggcaccctacgcgcaaggaacctcaagtcccagaatcctatgaggactccaaatcccagaaacctgcacgcaaatctatcccgggtgccaagtcggccgaccgcagacgtgaccaagttgcgaggctagggtgaggtgtcgtagaatttgtccctaccattgtccctgcagggaagagactttagtgatctagagctggtcattgtctctttcacagctcgcgtgaaagcacccctctcggcgtgtttgatgccatgatcagcgtctcccattccctctgtcccctttctctgcccccgtaaggatggttcagcccggtattgaggctccttgagctggctggatggttgcgcccgccctaccccggaatgtgggcctttggagcgagcgaagtgggagggaccgacgcaggaggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcgggtgagtgtcctgggacagggcggtgggcgggaggggacaggccggctccactcggcctggaggaggggagggtgaggggctggaggtgttgtgggcggattgggctgggcgggcgggcggctccggtgactcagggtgagtgacgaagtgataggggtgggggcgaagcaaggggatgcagtactgggggcgcccccaggtatggcggtgcggggagccgaggggccagagtagggtccgagaaggaagctagggttagagtaggtgcacctggtgtggacgagagactcgcctcctgagagctttgtaggggccttgcatccttaagtctgggtgtatttggggttgcgagttgaggattccaagtgatgccttagttaactcagtttgctgtggggatagaaaacgggacttcttcagttagctgtccgttttgattaccagcaggcctaacgcctctggttctctgagatatacctccatccccgttgtgttcacgtagtgtatctgcactgccagtatattagacataggggttgtatttaagaatcaagtcgatgcgttttcagggacgtgcagtgggtacttacgtgtcgtcaagattaagttgcatgtgtgtaaatcaaaattttgtgagcctttctttctcagtgttgtttcaacgactacccgatagggtgagatactgcaaggtgaggagactagcctagttacagttttaaattctctgatcttcactcccttactatggttacaagaaaaaacccagttctaagttcattgtgttaaatcattttctatcagtgacgcaaagtgccccccttcctttaaattcagttgtggtttgaatttttttttgagataattatgtttaggagcattagaaacgtgaaatgttagtgtgaccataaaggttggagactgagaagtcacagaaaacccagctactttggcttgccttactgcttgtccaggtagaagtaaattgctttaaaaaactcaagcagtgctaggttgaaattttaatgcatacttttacattcctgagaggatcagtgaagatagcaaactctcaaactacctctcttgttttgatttcaaagaaaatctgagcccctaaatgttgtattgatttgatgtaaggacttttttttttattattatactttaagttttagggtacatgtgcacaatgtgcaggttagttacatgtgtatacatgtgccatactggtgtgctgcacccattaactcgtcatttacattaggtatatctcctaatggtatccctcccccctccccccaccccacaacagtccccagggtgtgatgttccccttcctgtgtccatgtgttctcattgttcaattcccatctgtgagtgagaacatgcggtgtttggttttttgtccttgatgtaaggacttttaaatttgctgccatgaagcctctggcctctgtttattattagcttgactgtatgcaggagtagtttattggagttatattggacagtatgataactttgtgtttaagcaggtaaaactgattaaggaggtttttattttaaatcagtaccaagaaacgtgtggatattttttaaagtttgtagttgtcacaagagctgttttgacttgaggatggtcagccatgaactttgcaaggtgagaaaaaagcttcctttgcttttttttttttaaacccttacctgtaatttgatgaatgagatgtttcactttattcttttattttatttttgtttgtttgtttttgagacagggtcttactctgttacccatgctggagtgcagtggcacaatctcggctcactgcattctccgcctcccgggttcaagcaattcgcctgcctcagccttctgagtagctgggattacaggcatgtgccaccacacccggctaatttttgtatttttagtagagacggggtttcaccatattggccaggcatgtcttgaactcctggcctcaaatgatgcgctcgtcttggcttcccaaattgctgggattacaggcatgagccactgcgcctggccctaaggctttcaataaattcttattaattgagatcatcttctccaatgagtctatgaaaggtaagaaattagtgcttctattttcccatttgtattagtttgacacatgtaaataggcccagttagtaaatgaaaatcattgtaaactcctttgagaagaaatcaaagtcttgctgtacttcatgaatttagatagcaaattatcttggcttattgctccagttattaaaaagaagagaataaggacatacagcttctttagtgtttgactgcaatttttccaagacattcaaggtaacattgtcttttaaaatctgtgaaattttgctgcggcgcaaataacctcttgcccattgtatactggtctttgctcaatgaaagctttctaatggtaccttcatttcaagcctcatttaaagacaatatcagcactctaaattgtaccaaattcctgtcctctgaaattagatgttaagattatgtgtttgtatagtctaaactgatgattgtggtattacatagtcagctgctcattaatatagatgaagctaaaatgagtcacggacaaggatagttaataaacaggttggctaactagaacacctacctgattttaaaatagaaaatccttcctttataccaagaaatgtgagaacattctgcatttgaaaaagttttcttttctctccaatcttctgaagggccattattacatagcatttcctctatccctctacacttttcttttcttttttttttttttaaatagagacaaggtctcaccgtgttgcccaggctaatcccaaactcctgggctcaagtgatcctcctgcctcagcctctcaaagtgctgggattacaggtgtgagccactgtacctggctccactacccttttctaacaatatttctttccagtgaatgttgactcatttaatagccagcattttttttagtgaaaaaattgccctctcttttcaaagatgtgtatagtgttattattctgttaagcttgatctcagtgaaaacgtgtaatctctctagatctaataacatttaatttttttctaatttttattttattttattttatttatttatttttttggagatggagtctcgctctgtcacctgggctggagtgcagtggcgtgatctcggctcattgcaacctccgcctcccaggttcaagggattctcctgcggctgcctcccgagtaggtgggactacaggcgcccaccaccacgcccagctaatttttgtattttagtagagacgggttttcaccatgttggccaggttggtctcccaacttctgacctcaagtgatccacccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcacccgtcttttcctagcaaggaagcttttcagtgaggggccttcagttattacctagtgctagtagtttggaggaagagaaacaggtttcattaattagtgataaactgtcaatgtatgtgcttatccttatataaaattacttgctattatgggatagactttaacaaggcaacatctggactgctcatttctttacattatatatgtatggaaatttttgcagaaagcttgtgaaagttctttttaaaccgctgctgtcaagtagtaataacaatacagaggattccttctgtgcacatctagaaataaaagattaactctttgcatatttggaatagctgcttcagtgaagaagtatgtaggatttttcttactgtgaacaagtcttggcaagacttgtttttgaaagaaatgcaagattattttagcaatatactttagtaatggttctgaggaaatacaagtggtatcttgagggttggggggatgttagctaattggtcttagagcttcagccatggcacctaatcctagggcagctgatccatagcttggccaaagagagaaaaaaatagagcatgctagcctggtgccaaaaaacccaaaccaaacacaaaaaaccctcagaaatttgaatgagaaaatatggagataaaattggtcagcactgggaactgaagctggagttggagggagagtctggcgaggccagaactgacaatgtgcaaatgaaagatgtgaagaagcagaaactgaggaagcaaaggagaaaggagcaactctgcacagaaaaattctccccacaggtccttagttcatgatggctttctaatgcaactgcagccctccttttacaactttagtgtctgttttttttatgattgaaatgagcctaatttaaacatagattttaaaaattccagtcttgcttaagatttcaaatataaccagagatcattcaaactgagtttagtaaatattgttgaacgtccgtaatccaggcacatgatgctgtcgtaggcacagagaatgtagaggtaggtaaggctctgcctttaaggaattaagagacttgtggagggaaggacatataagagttacaatagaaacaatttaatttgaagtacctatgtaaggtatttgcaggaatagacgttggggaggagtttggggtgatggaagccttcctagaggaaatgtctgaggcttttaaaggataactaggagtttgcctggtgaataatgatgttaggtgggtgttataggcattaaacaaccacatggtaagtttgcagaattaagatcactttggctgttagtctcatattcattccttattaggatataaagtatgaagtgggcactgatgagaaatgaggctaagaaagttcacaggggctagattgtaaagacccttgaatgtcatactgcagagtttagactttttctcattgatgaaaattctaagtaagagaaatacatgatcagatttgcattttagaaagataacacttgaaattagtatgggagatggattggtgatggatgaaactaatttggaggcttttgaagtagtccagatgagatattttaaggagagagaaaagagtgtatggattcggtggaaattttaaggggtagtatcagtagaattaaagatagtcttgtaggggtgacgggagttggacaactcataggtttctcgtttaagagagactggggaatgtggaagagatttgtgggagaagttaattaattggctggaacaattcactgaattttgagttctaggtgtttatgaggcattcaggaggaaatgtcagaaagaatggagcaattatttattgtctgtctactctgtgttgcaagcactgtgcttgacagctaacctatgtaggaatgtggctgagaacgataatagaaacaaaaatgacaccagtggccaaatacagatcacaaaggcaaggcactaaaactaaattttaaaaatatagaaatacagaaagaggctgggtatggtggttcatgcctgtaatcccagcactttgggaggtcagggcaggtgaatcacttgagcccaggaattggagaccagcctgggctgaatgtggtgaaaccctatctctacaaaaaaattagcctgtagtcctagctactaggagggcgaggtgggagaatcacctgaggccaggaagtcaaggctgcagtgagctgtgattgcaccactgcactccagcctgggcaacagagtgagaccctgtctcacacacacacagacatacacacacacaaatatatatatatatacacacacacacacacacacacacatatacatacacacacatataaagttcccctgtagtctctcactcccaccttattttattttattagtttatttttatatatttaaagggtacaagtgcagatttctttctttcttacatgtttgtatcatgtagccatgaagtctggtcacttagtgtacccatcaccggaacagtaaacagtaaaacccagaaaattacctgtacccgataggtatttttcaaccctcacccccctcccaccttttgtagtctccaatgtctactattccctctttatgtccatgtgtaccctttgtttagctctcacttataagtgagaatatgtggtatctggctttttgtttctgatttttttgactagggataatggccttcagttccatccatgctggtgtagaagacgtgatttcattattttttatggctgtctcactcccactttctagagatagccattgttaacagttagggatattctatatcatatcggtatatttataagtatagatatgtatgtgcatacacacacacagacatacccttttatttttccaataaatgagttcatatttccacacatgcatctgcaacttgattttaaaaatcgtggtcatcttttcattccagggtagacagacctctttatagttggtaatacagtgttctacagttgttgttgttgttttaagagacagagtctgattctgttgcctacgctggagtgcagtggcatgatctaggccctctgcagcctcaaccactctgggttcaagcagtcctcccacctcagcctcctgagtagctaggattagctcacgccactaggctcagctaattttttttaatatgttttgtagggacggggctggtctcaagctcctgtgctcaagtgattctcctgcctcggcctctcaaagtgtagaaattacaggcatgagccattgcgcccagccaccataatatgtttaatcttttttcggattgatgaacatttaaagttgtcttcatcaactcactatttcaaataatgttgaaggaacctccttatatttaatacatattcttgtaaatatggtcaaagatatgcctatcttgaaatatgatattgtttcccaaaagagcttaatttacattcttaacaacaggactagtgaagcttctgccttatattcccattgcatgttatctgtcttttaaatttttgactgtcagattggcaaaaaatggtaatttatttttacaagtatcttttatatattaatgatcatttgtatttcttctggattgttcctattttacccattttctattgtattatttttcttattaatttgttgacaggacattgacattttgttaaagttgccagcatttccccaatctgttgctagtctggagtttttcgtttttatgtcatcaaacctgtcctttttaaaaatttccttgatagtttctggatttactgtcttaggtaaaagtgtttttcatctaaaaatattctatttttcttctattatgcaacttttttttttttttttttgagacagagtcttgctttgttgcccagggtagaacccagtggcgtgatctcgtcttactgcaacctttgcctcctgggttctaacaatcctcctgcctcagcctcctaagtagctgggattataggcgcacgccacaacacccggctaatttttgtttgttttttgagacaaggtcttgctcagtcgcccaggctggagtgcagtggcacgatcctggctcactgcagcctctgcctcctgggttgaagtgattctcctgcctcagcctcccaagtagctgggattacaggcatgcgccaccatgtccggctaattttttatttttagtagagacagggttttgccatgttggccaggctggtcccaaactcgtgacctcaagtgattcacccgctgtggcctcccgaagtgctgggattttaggcgtgagccactgcgcctggcttattatgaaacttttaaagtgattatcttttcagtgaatctggtattttggggtttagtcatttatagggtactgacacaactttttttttctccaaaatttattctaataccattattgggcagattgtcctttcaccactgatttgaaatggtaactctgttatgtactaaatttcccacaatgtgcgtaggtactttctattgtttcattgattttaggggagagatctatttttgcacataccactattggtttaattattgtaatattatagttaactttgatatatgttatggaatggcttgattcattatttaattttttttttttgttttttttttttttgagatggagccttgcactgtcacccaggctggagcgcagtggcgtgatcttggctcactgcaacctccgcctcccaggttcaagcgattctccagtctcagtctctcaagtagctgggattacaggcaaggcgctaccatgcctggctaatttttgtatttttagtgaaaatggggtttcaccatgttggccaggctggtctggaactccttacctcaggtgatccatctgcctcggcctcccggagtgttgagattacaggcttgagccaccgtgcccggcctattcctatatattttataatcatgtgcttttgtgaatggggtcttcttgtagacctattacatactgttttctttttgtatgtttaaattaaactttccaccttactaataatttaactgtcttagaatttttaagctagataatgtcatctgcaagtagcaattttgcctcttcttttctatatcttatttatttatttattatttattttatgttttttgagacagagtctcactctgtcgcccaggctggagtgtagtggcgtgatctcggctcactgcaacctccgcgtcccaagttcaagtgattctcctgcctcagcctcctgagtagctaggattacaggcgtgcaccaccacacctggctaatttttgtagttttagtagagatggggattcgccatgttggccagactggtctcgaacgcctgacctcaggtaatccacccaccttggcctcccaaagtgctaggattacaggtgtgagccactgcgcccagccttatttatttttagccataggctagaattttctagacagtattgaattatagtaataatctcttatcttagtgaaatataatagaaaaatttctgtcaattaaagaaaaaagcttttaaagaattaaagttagtgttattcagaaatgttactgaggccgagtgtggtggctcacgcctgtaattgtgccactgcacttcaacctgggtgacagagcgagactctgtctcaaaaaaaactcaactgaaaaaagtggaacaaaagaaaaagaaccatgataagtattttgcactttttttttttttgaggcacatttctactctgtcacccaggctgagtacagtggtgtaatcacagctcactgcagccttaactgcccaggctcacgcagtcctcctacctcagcctcccaagtagttgggactgtaggcacacaccactatgtctggctaatttttaatttttttgtagagacaaggtctccctgtgttgcccaggcaggcctcgaactcctgtaccgaagcgatcctcccacattggcctttcaaagtgctgggattatggcatgagccaccttgcctggctgcactcatttattttcatttatttttcattttttgagtcagtgtcttcctccatcacccaggctagagtgcaatgacatagtcacagctcactgcagcctcaacttcctgggctcaagctgcacttatttagtcttcatgataatactcagaggcagatatgattatctccatttttcagataacattgagacttactaacccacaatacaaagctgggtgtgtttttttttttagagacagagtcttgctctgtcgcccaagctgaagtccaatggctcgatcatggctcactgcagccttgaactcctgggctcaaatgattctcgtgagtagctgggactacgctatgcttggctaattacaaaaaaattttttttagagacagggtcttgttctgtcactgaggctggccttgaactcctgaggtgatcctcccgcctcagcatcctgagtaggtgggattacaggcacgagccaccttgcccagccaaaactggaccttgaacttcaaagagatttctcttttccccttactacattgacagggctttataacattgcttttttactttattgttacattcatatttcacaattgttatttttgaattcactatcttcttcattattaaaaggtggaaattgctttatgaccttttttataattaataatttggggggtgatactttgagattatatgaatactctagtcccccaaaacattttgcccaatggtcttaccattcatggataatcctgcctaaaccaattattataatggttattgcaaataaaagtattttttcgaatagcctaatttagaagaaaagcttacactgaggtagcagaaggactgaatgtgattcttttgggggtttatttttaaaagcaattagtcctaaggaaaaactttataatagattctatattttagaatataggcacattgaaagcagtttgtcttctaagctcaatagcaaaataaaagacggagtctcgctctgtcgccctaggctggagtgcagtggcgggatctcggctcactgcaagctctgcctcccgggttcacgccattctcctgaaaccatatctaaattnnnnnnnnnnnnnnnnnnnnggtgatactttgagattatatgaatactctagtcccccaaaacattttgcccaatggtcttaccattcatggataatcctgcctaaaccaattattataatggttattgcaaataaaagtattttttcgaatagcctaatttagaagaaaagcttacactgaggtagcagaaggactgaatgtgattcttttgggggtttatttttaaaagcaattagtcctaaggaaaaactttataatagattctatattttagaatataggcacattgaaagcagtttgtcttctgaagctcaatagcaaaataaaaaatgcttaaaaaaattcagctaaaaccatatctaaatttgccattttgggaatctttgtgataaagcagattatattctgttgaggatcagtggtaaaataatttatgctagtgctgaagttaaactggaaaaaacatcatacgtgcataatttgttttatacctttagaatgtaatatctttattttgcagttcatttttagctttggtactgtaacaaggatctggtgattgtggaatgttatgaacatagtggtttcgcaattactgagagctaagtgtttatataaaactcccttgaatgttttagttcctggaacttaaggagtggtagttgataaagcataactccttcattgagtctctgatgggtatctatacttaaacttttttttttttaaacagaatctcactttatcatccaggctggagtgcagtgacgcaatcacggctcactgcagcctccgcctcctgggttcaagcggttatcctgcctcagcctcccaggtagctgggattataggcacccaccaccatgcctggctaatttttgtatttttagtagagacggagtttcactgtgtttgccgggctgatttcgaactcctgacctctagtgatccgcccacctcagcctcccaaagtactgggattacaggtgtgagccaccacacccagcctatacttacactttttttttttttttttttgagatggagtttcgctcttgttgcccaggctggagtgcaatggtgtgattggttcactgcaatctccgcctcccgggttcaagcgattcttctgccccagcctcctgagtagctgggattacaggcatgtgccaccacacccagcaaattttttatttttagtagagtcagggtttctccatattggtcaggctggtctcgaactcccaacctcaggtgatccatctgcctcaggctcccaaagtgctggggttacaggtgtgagccaccacgcccagccttatacttatactttttaagtattacacagatgtcttaaaagtatttgtatgttctgataagtgttttttagcttttgaaaagtaaaatttatgaaaaagccttgttgtttacaaatatgtttacctttctgttaattttaaatgtggactttgataaggaagttatatttcgatgatatccagtgtaactaattttttccctcttattcaagaaagataattttacacttattctttgacagagaaatttcatagaattttcttcttctaatttaattccagaatacattctctcaaccctatgccctcatactagtaaccttgagggttctttgaaagaaaaattgctttaaatcaagcaattctcttttgtcattaaaataagctattttctatttttatttttaaaaactatttaaaacaatataattatgcaagtgtgtatatatgtatttgatttttttgttttcttttgtttttatttatttttttgacacagtctcctctgttgcccaggctggagtgcagtgatgtgatctcagctcactgtaacctacacctcccatgttccccccctgagaaggatcctcccacctcagcctctggctaattttttttttgtatttttagtagagacggggtttcaccatgttgcccaggctggtcttgagctcctgggctaaagtgatctgcccagctcagcctcccaaagtgcatgagccaccgtgcccagcttgatattttaatttttacttgaatgaaatcatttactgaaagcaatacatgttgatgcacacacaaaattactgaagttcatcaaattgtcaagcattcagtaatatatacagcattattatttttaatcattttcaaactgaaaactccttttctttttcagggatatcatgataacacattttgaaccttccatctcctttgagggcctttgcaatgaggttcgagacatgtgttcttttgacaacgaacagctcttcaccatgaaatggatagatgaggaaggtgagtggtaaagacagggctgcctgtgtaagcattttaagatcttattctatcatttgttgtaaaaatataatgagtcctaaaaagtttaagaggaaagactattagaaatttgatgccattcttgttttttctttaagtatttaaaagaatactgaagagcacaatcttttttttgccccttttacgccaaaatgatgtgaaattaacttgactttttttttttttttttgagacggagtctcgctctatcgcccaggctagagtgcagtggcctaatcttggctcaccaaaacctccacctcccgggttcaagcgattctcctgcctcagcctcccaagtagctgggactacaagtgtgcaccaccatgcccggctaatttttgtatttttagtagagacgggggtttcgctatgttggccaagctggtctcaaactcctgaccttatgatctgcccacctcggcctcccaaagtgctggcattgcaggcgtgagccactgtgcccagcctaacttgacttttttaagcataaggtaagcatctcatcaaatagtgtgatgttttactttaattttgttttttctttgaattaaattttttttttttattttttaaagacagggtcttgctaagttgtccaggctggtctccaactcctggcctcaagtgatcttcccatcatgacctcccaaagtactgggattgcaagcaggagccactgcattcagcttcactttattttttaatttaaatttttttttttttgagacagagtctggctctgtcgcccaggctggagtgtagtggcatgatatcagctcactgtaacctccgcctccaaggttcaagcaattcttgtgcctcagcctcccaagtagctgggatacaggggtgcaccaccacacccagataatttttgtatttgtagtagagacggggttttgccgtgttgcccaggctggtcttgaactcctggcctcaagtgatctgcccacctaggcctcccaaagtgctgggattacaggtatgggccaccacacctggcccccagcttcactttaattttgaatatgtgttgtcttatattttaatttaagagattacctatttttaagctgaatattaccttaaagaaaatattgtggaatgaaagtgattttgacaatcattatttcaaagtagtggcagaaacctgatacctcagtgacttgtactcagaaaacatttatcatatatgtaggcttacgcctgtaatcccagcactttagagtctgaggtgggaggattgcttgaggccaggagtttgagaacagcctgggcaacattgtgagaccctgtctctacaaaaagtttttaaaacttatctggtggtagcgtgcacctgtggtcccagctacttgggaggctgaggtgggaagattgctcgagcctggaaggtcaaggctgaagatgggccctgattgtgccactgcactccagcaacaaagcaagcaaagcaagaccctgtctcaaaaaaaaaaaaaaaaagaaagaaaaagggaaaaagaagcaaatatctgtgtgctgaggacagacatttcctatcctcaaacccatagtctgatagggagatggacacatgtgtaacaaatgtgataaattctggaacataaacgcataggggccttgaggaatacaaaggaagacacatctataatacatctgcaatgtttgacctaaacctgtaacagagtagaagtttttgaggtagaggaggtgaggagaaaaccatataggctgaagaagaatatgtagaaaggcacagaaatgtgaagaacatgatgagtgaaaagcagtaattcactgtatctgaagtatgaagtggtgaagtatgaattggcctacagtttaacaggctccacgggtgagttgtatgaatacagaaatttgtttgagaagcatgagactagatccccaagagctttgcagatcacattaaattttattttacatgactattatggaagtctagttaaaaggtaccctaaagaaagggtgggttgggggtgagggataaaggcctacatattgggtacagtgtacactgctcaggtgataggtgcagcaaaatctcagaagtcaccactaaaagaacttactcatgtaaccaaacaccacctgctccttgaaaacctgtggaaataaaaaaagagagaagataccctaaatatactactttttttacaatagttttctgttaattgttatacaaatagaatttcattttaaggaatgtcataatatttagctcaatatttgggatcatttctatcttccctgatataaagaactctggaaagtcattattgaagctccaagctataggtaaacataaacacattctcattttttaaaacagtgttcctgaagtaattcatgttcactgttcaggaaaaaaagtagtgcaaaaatttatgaaatgtaaaaagaagcctcctgtttttccttttttctctctcctccctcaccaattccaattgtaagagaatagcttagtatgtatccttctatatattttctatgcatttgcaaacgtgtatgtatgtttctataaattctttattaacagttttattaacatgacaaatgacatacagctgatattttgcagacctggtgggcatggggagcttggagcccagtgccacccaccctggccctccatggccttaaaaaaaaattatatggggccgggcatggtttctcatgcctataatcccagcattttgggaggccgaggcgggtggatggcctgaggtcaggagttcgagaccagcctgaccagcatagtgaaaccccatctctactgaaaatagaaaaattacctgagcgtggtggcgggtgcctgtaatcccagctactagagagggtgaggcaggagaatcacttgaacctgggagacggagggttacagtgagccgagattgtgtcgttgtactcctgcctgggcaacagagcgagactccatttcaaaaaaaaaaaaattatatacaaatcgttatgcagtgttttcctttatagtatgcgctggacattttttcatttcagtgtacttcaatttgcatcattactctttttttttttttagtactgcatagtattacatattatagatgtttcatgattaatcccttatcgatggacatttggactatttctagtttttcactaccataaacaatatataatgaacatttcttttctttttttttttttttttgagacagtctcactctgttgcccaggctggagtgcagtgtctcgatctccgcccactgcatcctcctcctccttggttcaagcaattcttgtgccccagcctcctgagtagctgggattacaagcgtgcaacaccatgcctgcctaatttttgtatttttagtagagacggggtttcaccatgttggccaggctggtcttgaactctggcctcaagtgatccacccgccttggcctcccaaagtgctgggattacaggcatgagccaccactcccagccttatttatttatttctcttttaatacagaggctgggttctcactatgttgcccaggctagtcttgaactctggccttaagtgatcctcctgacctagcctcccaaagtgctgggattacaggtgtgagccactatgtcaaaacatatgtatatcaaaacatcatgttatataccataaatataatttttgtccattaaaaaattaaactagtttttcacacaactacatgaaatgagaggattttttcattcttgcccttaccaaccttagatatgaatcataaacatttttaaagatcagtaagtgaaatgctaacctggtatttcaaattttgcattaagaggaaagttgagtatctttatctttttgacctaccctatcacaaagatagtttaaatatggttacttataaatgtcatgactatctcacaatatgtcttcagccagaaaatgagactatatataatttagcacagtgtgcaacttatgcttagcattcaataaaatgcttcttatcataaatgaatattcttattttaatcctgatcatttcataccatttatttgctgattagagttgtttttcagtcaatgattttcaaattgcagcacacataggcatcactggataatgctttttattagacgtacttagtttagcgatagtccattaaacgtttttataatacctttgtattatccttgcctggagagttctgttcccagattgtcacctggctgtctctcatcattcaggttttaactcaaatgtcatgtcctccaagaagccttcctatctccattcattttgtatcttcttgccctgttttttctcttgtatggtagagtgtttttttttttttgtatggtagagtgtaagctccatgagagcagaggtcttgtctgttttgttcatgttggagctgcagtgcctagagcaatactaaataatactatgctcaaaaaatatttgtggctgagtgcggtggctcatgcttgtaatcccagcattttgggaggccaaggcagaaggatcccttgagcccagaagtttgagaccagtctgggcaacatagtgagatagtgagaccctgtccctacaaaaaaaattttttttttagttagctgggcatggtggtacacacctatagtctcagctactcaaaaagctaaggtggaaggattgcttgagcatgggagatggaggctgcagtgagccatgattgtgccactgcactccaacctaggcaacaaagcaataccctgtttccaaaaaaaagatatatgtgtatatatatatttgtgagttgtacaagaggctagcaacaagcctttccctggtttaattttgcttcagttattggagacttaagcattgacagttactgtttattctgttttttttttcttaaagtagcatattttaattaacagatgcacatagtaaattaactttctgatgcaacagtcttattataatgcatttcatacttctttctccctaagtagctattaagtttccaagttttctggggaaagctatgaagctctaggctttgtcttgttcaagtaaaaggttaaatttttcattaaggtctgttgattcccatgcgatccttctcaccttgcttaattctgataccaatcttttcttaattttaggcatacagagccaacagtaattatttttaagttactttcaattagttttcagttgtaattttgtcacctttgtttttaatcatgtaggcattggggcatgtcggtctgatctggagaaaaaaaattctctaggatcaaagacaggacagtcacttgatttctctggcatatgagaagtgctgttcctcaagccaaacatttaattgttggaattttatgttggagcaagtaaagatcttaagcttacttcatctgtttaaagagatttaagacaactgccctttttccttgtactcaaaaccagtcttagtgatttgttttactgtggaaaaactggtttgcttaatctaactaaacattttagaatgagtagtaattttgtaaccatcatgccacactcctctttctcataaattcttgtgtaacaaaagtgtgggacagggaatgacaaatgtgactttatttttttaacaaatgtaagttttcagttcttttttttaaatttttaattaacagataataattgtatatgttcgtgggatacagtgtgatgtttcaatacatgtatatgttgtggaatgaaaaaatcagggtaattaacacatctattacctcaaatacttatttctttgtggtgaggacatttaaaatccactctttttgttattttgaaatacacaatacattattatgaattgtagtcaccatgctatgcaatagatcaccagaacttactactcctgtctaaccacaaccttgtaccctttaactggcacctcctttctctatctaacccactccctccagcctctggtactctctacgtgtatgagttcaacttttttagattccatatatcatgtggtgtttgcctttgtatgcctggcttatgcttatttcacttagcataatgtcctctaggttcatccatgttgttgaatatgacataattttctgcttgaggctgagtagtattccattgtgtgtatatgccatatttatttcatctgtttatccattgatgggcatttcaattgtttccatatcttagctattgtgaatgatgcagatgctacagcgtagttcacctttgttttgagagagggagagagagagacagagacagagagagagagagaaaaggcctcactctgttactcaggctggagtgtactgatgcaattatagctcactgcagcctcaaacctatgggcttttgagatcctcccatcgcagcctcttagctacaggtgtgtaccaccatgcctagctactttaaaaaaaattcttttggctgggtgcagtggctcacacctgtaatctcagcacttggggaggctgaggcaggaggatcacctgaggtcgggccaacatggagaaaccctgtctctactaaaagtacaaaattagctgggcgtggtagtgcatgcctgtaatcccagctacttgggaggctaaggtaggagaattgcttgaacccgagagatggaggttgcggtgagccgagatcgtgccattgcactctagcctgggcaacaatagcaaaactccgtctcaaaaaaattttttttgtagagacagggtcttgttacattgttgcccaggctggtcttgaactcctggccttagccaggagttgaattcaaccaactctttggctgaatgtgtagccaatgctacttcacctatttagatagctgtattatggctccaaagctgaaaactgaaaaattaatattaacagccaggcatagggctcatgcctgtaattccagcactttgggaggctgaggcaagaggattgcttagcccaggaggttgaggctgcagtgagccaagattgcaccactgcactctagcctggaccacagagtgagaccccatctcaaaagaaaaaagaaaaagaaaagacaagaaaagaaaaaattaacagcacttagaaaaggaaagctaagtacctccaagcatatctagttttgtaacttatatagttttcctttataatgttaaaacattataatgttataatgtaaagaacttatacattatgaattattatacattattacattatttataatgtaatgtaaagaacttcctttaacatttcttttgtttttgttttgttttgttttgagatggatccttgctctgtcgcccaggctggggtgcagtggtgtgatctcggctcactgcaacctcgacctcctgggttcaagcgattgtcctgcctcaacctcccgagtagctgggattacagacacctgccaccatgcccggctaatttttgtatttttagtagagatggggttttgcagtgttggccaggctggtctcgaactccagacgtcaggtgatccgcctgcctcagcctcccaaagtgctgggattacaggagtgagccactgcgcccggcctcttgaacatttcttatagagaagttctgctggtgagaaattattcatgtttttaatttcacttaaaaatagatttattgaggtataattgacatatatatgtatacataatatatataataagttatacatattaaaactttacagttggatgagttttgatacctaggaacccatcagcacaagcaaggtagagaacgtatctgttatccccaaatgtttccttgtgctaagcagtgcctcactcctgctcttttgtcctcaggctactactaatctgctttctgttactacagattagtttgcattttttagaattttatatggatagaatcatcatatagcatgtactttttggtgggatgtgtgtatcagtagttcattccttcttattgctgagtagtattctatcctgtggatgtactacaattcattaatctgttgaagatcattgggattgtttttggttttggctgttttaaataaaggtgctatgaacagtcatgtacaagtccttccttgtatggaaatatatttccatttttcttgagtcaaacctagaaatagaatagctggatcatgtggtaggtatatatgctgcttttataaaatggaaaaagaagattttgaaaaggagatgagatggggcacttcatcccaggcacatccttgggcagatggtttttagtaaggaattcacaaggaagttgaggatcaggaaattgattccttttaaaaactgtctatgcctgttagtccctgaaaagttttcctgcactccaggggtactgtattccaattagaagatagctgacttagagatgtccccagctacttctcttagttctggcctctgccccagctctgttcttcagacggaccttatgcccaggaaattctggctgccatcttttacacaccaggctgtctggaggcctgggagaaaaaggaattagactggggttcacctgggagaaacccttggcagtggtggagtggggatggattcagaagtgaggtatgatactataatataatgaaaaaatgtatctgctattcatcgctggttcctgacagtgcctaaaacccttgttcaagtaaaaggttaaatttttcattaaggtctgttgattcccatgagatcctgagtaatagaagtgagaagagcatcttttgttatttatgataagcccctgccaaccaaacctgattttatgctaatgaggtggctcttggaggatggcttctggttgccagaggaatcaaccatgtggttatctctaaggtgggacttttcagcctacctcccccttatttctgaggagggcagaggggcctggagatggagttaatcaccagcagccagtggtttaatcagtcttgcttaggtaatgggacccccttaagaactcaaaatgtaggggttcagagagcttcctgctcggtgaacaaatcaaggtcctgggagggtggtacatctggacccggcttggaagctctgcgtccccccgtaccttgtcccattacctcttcatctggctgttcatttgtatcctttataatatcctttataataaagtgtttttgtagcaaattgtttaacatgaggagggggttgtgggtgtaggggccagggaaaagcttccccattgatctccaaaggtttgctgaaaaatcaactcacaagaggcagattaattggagaaaagtcatacagattttattacatgtacacgggggaaccacagagattactcaccccccaatggggttcggaagcatgtataatatcctggcaaaacaggttatatggctggtccaggtgcagtggtgtttacagctaattgatcacagccagttacagatttctttgttccttccactcccactgcttcacttgactagcctaaaaaattaattaattaaataaaacaggttataggagaagggagaagaggaattctgttgtgaggattactaggaagaatgaatggatcagggaagggagattaacttgtacattatcttgtggaaggatctgttcaggtgtgattacattcttggtcttactgggaggggaatgcaaaacagttgttctcggtgggtctggattttaggcgataaaggaacttcagagaacgtcattctgactttgggagaagtcagttgtaggggtgggtggttgggggaagtcagagagaccctgaggtattggttactgagtcccaacatgggaatgcccagtttgtagccaagtcagactaatttgactgatttgtggctaatttgaggatccactacttgcaattagcatctgaagttgggggtagtctgtgggactgagccctaaacctacgggggtctgtgctaactccaggtggtgtcagaatttaattaaattgtaggacgctcgattggtctccacagagaatagatttgcttctggaaaactcacacatctggtgttggaagcattgtgagtggagaaacagttttttatttatgaggcaagagaggctatgggggtcttgaggcggtattggggaccttagatgctatcatctgctccagtatctgggaaggtctgtcctcctcattggcatcccgtctccagttgccctgtcttcttcctctccctcatagaccactgttcacacgggatacacttatgatccccacactgttttctccttactctcacttctccatccctaggcaatcactgatctgctttctgtcactattccatacatataaatgacaaaatatagtgggtttttttgtttttgaaagacaggatctcactgtgttgctcaggttggcctccaactcctgggctcaagcagtcctcctagctgaaactacagatgcacaccatgactcctggctcaagcacagtgtttttgtactttttaataaatgacattatatatcccatattctgaaatgtctcttttttccctggatgttatgtctttgtttttttttttttttttttttctgacacaaatcctttctttgtcacccaggctggaatgcagtggtgtgatcatggctcactgcagcctacctctcaggctaaagcagtccccctgcctcagcctcccgagtagctggaactacaggagtgctccaccacgcccagctaattttttttcttttttttctttttgagacagagtctcgctcttgtcacccaggctgtagtgctcgctcttgccgcccaggctggagtgcagtggcatgatcttagcccactgcaacctccgcctcccgtgttcaagtgattctcttgcctcagcctcctgagtagctgggattacaggcgcctgccaccatgcccagctaatttttgtacttttagtggaaacagggttttgccatgttggccaggctggtcttgaactcctgacctcaagtgatccgcccgcctcggcctcctaaagtgctgggattagagggctgagccactgggcccagcctaaattttttattttattttttgtagagacagagtcttgctatgttgcccaggctggtctcaaaactcctaagcccaagtgatcctcccgctttgctctcccaaagtgttaggattacaggcatgagccaccatgcccagcagatgtcttgagatctgttaatgtagttagagaactagtgtaccctttaaaaatttttttattgtaattaaatataaataagaaaatttaccagttcgaccactcttaagtgtacagttcagtggtataagcacattcacagtgttgtacaactattaacagtatccttctgtttccagaacttttcaccatcccaatcagaaactgtacccattaaacaataactccctatccctccttttgcagtccctagtaacctgtattaaactttctgtctatgaatttacctatgcttggtcacctttgtttttgtgtttttgaaagatgattgtgattggtaaataactccaggttggaagtttttgtttttttttctcgttcagtaccctgtcttatagcttgcattgtttctgatgcaaaatctgctatcaacttcctttctgtatgtgaagcatctctttggctgcttttaagacttttttgttttgttttgttttggagacagagtctttgcctggagtgcagtggtacagtcatggctcactgcagccttgacctcccaggctcaagcagtcctcccacctcagcctcccaagtaggtgtgcgccaccatgcccagctacttttttagttttttttttaaatagagatgggatcttgctatgttgcccaggctggtcttgaactcttggactcaagcaatcctcccaccttggcctcccaaagtgctgggattacaggcgtgagccactgcacctagccttaaaccactgtttaatccagtgttttaaaattgctttagagggagggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgtaactgaaaaagggagtctttttttaatgaattactttatttctttgaggaaaaataaaacagatttgtaaactttgctcctggactagaatgctactttgcaggcaaacttacttttgtaaaaatgctagactctggccagacatggtggctcacacccataatcccagcactttgggaggcctaggccggtggatcacctgaggtcagcagtttgagaccagcctggcctctgtcgctattaaaaaaatacaaaaacaaaaaaattagctggacgtggtggcacacacctgtaatcccagctactagggaggttgaggcaggagaatcacttgaacctgggagctggaggttgcagtgagccgaggtgtcaccaccacactccagcctgggtgacagagtgagacttggtttgaaaaaaaaaaaaaagctagactccacattctttaaaaaaaaaaaacaactttgctaagatataattcaccaatgtaaagtgtacaattcattggtttttagtataatcacagagttgtgcagctgttatcaccatcaattatagaacattttcattaccaacccccccccccaaaaaaaaatctcgtgtctattagcagttgctacttgtttcccccctacccctttctctgcaggccccagacctagacaaccactaatccacgatatgtttctacagatagactgattctagacatttcctatacagtgtcattactaattccttttatgggtggataatattccattgtatggatatacatattttatttatccatttatcaattgatggacaattggctattgtgagtaatgttgctacgaacatttggttacaactttttgtgtgaatatgttttcatttcatatggtaactgtttaaccttgtgaggaactgccagttttccagagtggctacaccatttaccttcctaccagcagtgtatgagaattccaatttctctatatacacttagacttgttatttatcagtgtactgagttttgatcaaaaatagtgtacctgtgtagtgtggttaaatcatgttgacctcactctctttcatctagcctcttaaaatatcaatactaagacttataaaatgagcatatgaaaaccagtaactttccttcctacagattgaaaatactcaatcagaaagtatattcaaagaaaatatttaatccacagtagcgacataaaaataggttttaaaaaaaatctagtaataaaccttagagaaatttgaagaaactatataaagaaacaagaaactcaattgagtgtcataaaacgaaacttgaatgaatggtttgggaaaaagcaacattatacaaagtgaattccctgcatatcaatctgtgaagaaaacatttctcccaaatttccaacaggattttaaatctgacaaaaatttcatcaggaaaaataaatgctcaacaataaacaggaaaattttgaaaaagaaagtttggaaagagaagacttttcctaatgttgtatacaggaatagtaacaactgagagaaaatatttgcaacatttacaacaaaggattactatctctattgtacaataaatgccaagaagaaatagatgaaaaatctacataatgaggtataaatagtcaattcataaataacaggctcaaaaatcactaataattaaagaagttttgaaatattaaagtgagacattacttttcacctattggactggaaaatacagaatttagtaattatctctaagaaattagggccaggtgtggtggctcacacctgtaatcccagcactttgggagaccaaaacaggtggatcacttgaggtcaggagttcaagaccagccaggccaacatggtgaaaccctgtctctactaaaaatacaaaaactagctgggcatggtggtgggcgcctgtagtcctagctactcaggaggctgaggcagaagaattgcttgaacccaggaagtggaggttgcagtgagccgagatcacgccactgcactccagcctgggcaacaacaagactgtctcaaaaaaaaaaaagaaattaggaaagattggccgggtgcggtggctcacgcctgtaatcccagcactttgggaggccgaggtgggtggatcctgaggtcaggagatcgataccatcctggctaacacagagaaaccctgtctctactaaaaatacaaaaattagccaggcgtggcggcgtgtgcctgtagtcccagctgctggggaggctgaggcaggaaaatggcatgaacttgggaggcggagcttgcagtgagccgagattgcgccactgccctccagcctgggtgacagagcgagactccgtctcaaaaaaaaaaaaaagaaattaggaaagataccctgttggttgaatgaatgtatgtgtcataactcttttggaggacagttggaaatacttggccaaattttaaatgggcagactttttttgttaattttttactttaattttaatggatacatagtaggtgtatgtgtttatggggtacatgagctattttgatgcaggcatacagtgcataatcatgttgcgtaaatgggatattcatcacctcaagcatttatcatttatttgtgttacaaatattccaattatactcttttagttatttttaaatatacaataaattttgttgactgtaattaccctgttgtgctatcaagtactagatcttttttttcttttttactttttctaacctttttttttttctgagacagtgtctcactcttgctcaggctggagtatagtagcatgatcacagctcactgcagccttgacctcccatgctcaagcagtcctcctgcctcagcctactgagactacaggcttgagccaccattcctggctgttttttaaaattttttgtagagatggaggtctcactgtgttgcccggggtggtcttgaaccaaatactagatcttactcattctgtgtgagtatagttttgtacccactctccaccactatcgttcccagcttctggtaactatcattctactctctatctccatgagttcaactgttttaatttttagcttccacaaatgagtgagaacataaggtttgtctttctgtatctggcttatttcacttgacacaatgtcttccagtttcatccatgttgttgcaagtgacaggatctcattcttttttgtggctgaatagtactcccattgtattgctagacacttaagttgcttccaaatcatggctattgtgaatagtgctgcaataaatatgggagtgtacatatctcttcaatatactgatttcctttcttttgggtgtatatctagtggtgggatttctggatcatatggtaggtgtgtgtttagttttctgagaaatctctatactgttctccatagtgactgtactaaagtacattcccaccaacagcatgtgagggttcccttttctgcatatcctttccagcatttgttattgcctctcttttggataaaaaccattttaactggaatgagatgatatcttgatgtagttttgatttgcagttccctgatgatcaatgatgttgaacaccctttcatatacctgtttgccgtttgtatgtctccttttaaaaatgtctgttcaggagccgggcacagtggctcacgcctgtaatcccagcactttgggaggttgaggtgggcagatcttgaggtcaggaaatcgagaccatcctggctaacatggtgaaaccccgtctctactaaaaatccaaaaaattagccgggcgtggtggcgggtgcctatagtcccagctactcaggaggctgaggcaagagaatggcatgaacctgggaggcagagcttgcagtgagccgagatcgtgccactgcactccagcctgggcgacagagcaagactccatctaaaataaaaaaaaatgtctattcagggctagggatggtgtctcacgcttgtaatcccaccactttgggaggccgaggcgggcggatcacttgaggtcaggagttccagaccagccaggccaacatggtgaaaccctgtctctactaaaactacaaaaattagctgggcatggtggcacgtgcctgcaatcccagctacttgggaggccgaggcagtagaactacttgaacccaggaggcagaggttgcagtgagccaagattacgccactgcactccagcctgggtgacagagcaagatccgtttccaaaaaaaaaaaaggaaaaatgtctattcatatcttttgcccattatttaatcagattattaggttttttttttcctattgagttgtttgaactccttgtctattctggttattaatcctttgtcagatgcatagtgtgcaaatattttctcccattctgtgggttgtctcttcatttttttgattgctttgttttgcagaaacctaagttgatgtgatcccacttacctatttttgctttgattacctgtgattgcggggtgctactcaagaattacttgcctggaccagtgtcatggagagtttccacagttttttcttttagtagttgcatagtttgaggttttggatttaagtctttaattcattttgatttgatttttgtatatggcgagaaataggggtctagtttcattcattcttctgcatgtggatatcttgttttcccagcactatttattgacagtcttatttattgaaggctgtcttttccccagtgtatgttcttggcacctttgtaaaaaatgagttcactctagatgtatggatttatttctgggttctctcttctgttccatcggtttatgtgtctgtttttatgccagcaccatcctgctttggttactacagtttgtagtataatttaaaggcatagaatgtgatccctccagttttgttctttttgttcaggctagctttggccattctgggtcttttgtggttccatataaatttacaatgatttttttctatttctgtgaagaatgttattggtattttgatagggattacactgaatctgtagattgctttcagtagtatggacattttaacagtattgattcttccaatccatgaacatggaatatctttccttttttttttttaatgtgtatgtcttcttcagtttcttgtatcagtattttatgattttcattgtaaagaaagagatctttcactttttttttttttttttttttgagacagagtttcacttttgttgcccaggctggagtgcaatggcacgatctcagctcactgcaacctccacctcccgggttcaagtggttctcctgcctcagtctcccgagtagctgggattacagggatgcaccaccatgcctggctaattttgtatttttagtggagacgaggtttctccatgttagtcaggctggtctcgaactcctgacctcaggtgatcctcccacctcggcctcccaaagtgcagggattacaggtgtgagccaccgcgcctggctgagatctttcacttcttttgtgatacttattcataggtatttttttatttgcagttactgtaaatggaattacttttttgattactttttcagattatttgctgtggcatatagaaatgctactgatttttgtgtggtgatttcatatccttcgactttactgaattagtttatctgttctaatagtttttttgtggagtctttaggtttttccaaatatataagatgatatcatctgcaaacaaggataatttgacttcttcttttctaatttggatgccctttatttctttctcttgtctcattgctctagcttggacttccattactatgttgaataatagtggtgaaagtgggcatccttgtcttgttccaaatcttagagaaagactttcaattttctcccattcagtatgatactaggtgtgggtctgtcttatatggcttttatcgtgttgaggtatgttccttctatccccagttttttttggatttttgtcatgaagggatgttgaattttaccaaatgctttttttagcatcaattgaaatgatagtatgatttttgtcctttattctgttgtatcatgttttattctgttctatcatgtgatatatcacgttgattgatttgcatgtgttgaaccatccttgcatccctggaacaaattccagttggtcatgatgaatgatctttttaatgtgttgttgaattcagtttgctagtgttttgttgaggatttttgcatcaatgttcatcagagatattgacctgtagttttctctctttttgacatatttgtctggttttagtaatactgatgagtattactgggtcttagaatgagtttgaaactattccctcctcctccatattttggaatattttgagtaggattggtattagtttttctttaaatggcactgaagccattggatcctgggcttttctttgctgagagactttttattatggcttcgatctcattacttgttagtactctagtcaggctttggatttcttcatggttcaatcttggtaggttgtatgtgtctaggaatttatccatttcttctaggctttctgatttgttggcatatagttgctcatcgtagcctctaatgatcctttgagtttctgcagtattagttgtattgtctcctttttcatctgtgatttgatttctttgggtcttgtatcttttatttttagtccggttaaaggtttgttgatactatttgtcttttcaaaaaaatcaagtttacattttgttgatcttttgtgtgttttgtttcaatttcattcatttctgccccgatctttattacttcttttcttctactaattttgtgtttggtttgctctcgcttttcttgttctttaagatgcatcattagtttgttcatttagcgcctttctcctttttttgatgtgggcacttattgcttgctataaactcacctcttagtactgctttcactgtatcccattggttttggtagtagttgtgtttctattttcatttttttcaagaaatttttcaatttttttcttaattttgtattgaccccctggttaataaggggcatattgttaactttcatgtgtttttgtagttcccaaagtccatcttgttactgatttctagttttgttccattgtggtcagagaagatacttgttagtttttgtaggttagtaacaatatttggattatactaaggagtttttatctagagttatagagattttcttagaatgctgccatggtagagaataagtgggtgggtatataggggaaaacaacattttgaaatatgtttcaaattttccagattaaacagttaaaaagaacaggtggtgaacctagagaatagtgttttagaaaccgagacacaggatttcttaatagtgggcaactttgtcagggactgcaagagagatcacctagaataaggactgaaaagatgtcataggtttcagcagctggtttcatgacctttgcaaccgcagttttggtggagtgtttgggctaaaacctggcagcagcattttgagaaatgtgtggaaggtaagaacatggagaaaggatatgatcactatgtgaaaaaaagttgtttcattataaaagattacaaacttatgatttttaaaatattaaagagaagtatgaagtgaaaaaaaaccctgccccttttcctttctcatcttctcacctgtttcctccagttttagtctctagttttactcttgagatttgtggctactgaatgaatggagtgtcaatctgaatgggaaagagaattttttttttttttttttgagacaaagtctcgctcttgttgcccaggctggagtgcaatggtgtgatctcggttcgctgcaacctccgcctcccaggttcaagcgattcgcctgccttagcctcctgagtagctgggacaacaggcacgtgccaccacgcccagctaatttttgtgttttcgtagagacggggtttcaccatgttggccaggctggtctcaaactcctgacctcaggcgatccacccaccttggcctcccaaagtgccgggattccaggtgtgagccactgcacctggcctgaaagaggtttttgagagggagactcagaaacgcctttgcctgagaagagctaggaaatagaaggaaagaaaaaaatggaacagaggagctcagagaagataaaaggaagtagggatgcagtggtcaagtgggagaaaaaaaaggagaggcactcttttctttgagtagccaggaaaaaatgactttgtttttctttctcaattagcagaccaagctgtatgctggtgattgaggtttggatagggttggtggcatctagtgtgtagtaactatgggaattagcaaatcaatggcagagtgaaggactcactttcactcgctcaggtccaaactaggctttaaatgacttcttttttttttgagacagtcttgctttgttgcccagggtggagttcagtagcacaatcttgactcactacaccctctgcttcctaggttcaagcgattcttctgccttagcctcccgagtagctgggactgcaggcacacaccactgtgcctggctaatttttgtatttttagtggagatgggctttcatcatgttggccaggctggtctcgaactcctgacctcaacccgcctgcctcggcctcgcaaactgttgggattacaggccaccacacctggcctgaatgactttttcactgaggaatgccatagtccaggcagatgtgccacctcattgatcgccagggatgactcagttgtctggctagttgggtaagggaggtgttttttccatcacttctgtgtgtctgttactaaaactgttcatttatatttcacagcagctcaagtgcaactgttcttcagtacttttgtagcttttcatttctgtgactcctttgaggaggctctgtcatgtgaaaggaaaaatttgataaaatgattacatggagacttctaactaatcgtattgtggcaatggaactactttcacttcctcttttaaagaaacaggtaacagaaagcctgctctttagactttcccattagacacatagcagtgacaatttaaactgtggtcagtagccaggcatggtggtgcacttctgtagtcccagctatttggaaggctgaggcaggagaatcgcttgaacccaggaggcggaggttgcagtgggccaagataacaccattgcactccagcctgggcaacaagagccaaactccatctcaaaaaaaaagaaaaaaaatgtggtcaggaatagattctgtttgctgtatttgggatatatacaatgttaagaacaaaatggccaggtgtggtggctcatgcccataattccagcactttgggaggcccaggcgggaggattgcttgagcccaggaggtcgaggctgtagtgagccgtgatcatgtcactgcattcagccttgagtgacagagtgagaccctgtctcaccaaaaaagaaaaccaaagaacaaaattttatatctatatacattggtgtctgtgaacctcatgtggtatttttatgcaaatagaaatggaagttatatgttacctacttcagaaaattgaattgtctaaataaatatctaaatatttgtccttaggccaggcacggtgcttcacgcctataatcccagcactttgggaggccgaggcaggcggatcacctgaggtcaggagttcaagaccagcctggacaacatggtgaaaccctgtctctactaatacaaaaattagctgggtgtggtggcacacacctgtaatcccagctactcgggaagctgaggcaggagaatcgcttgaacctgggaggcagaggttgcagtgagccaggatcatgccactgcactccagcctgggtggcaagagcaaaactctgtctccaaataataataataataagtaaataaatatttgtccttgtcatatatttgtttataaatatgagattattttttctaaaaatttacattatgaaatttgtttagtaatcatcacatttaggggttttaaagtgacctttactttacttttgtgttttttaggagacccgtgtacagtatcatctcagttggagttagaagaagcctttagactttatgagctaaacaaggattctgaactcttgattcatggtaagagagtagtcatttcatactcgtccagactgataatttctttgaaatcactctttattcttcaccattttgaaacataatcttaatgtcattttctcaatctctgtgactcatgcctaagtaattgtcgttatttagtagtttctcacgtgctacagaaggtaaaattaatctgctgcttatagtctggggaattttgtggtctctgtatgtcttgttggatattaaaatgtgatatctcagtgtatcacagcaaatttatgatagaacttaaaaattgagagcctggggaatctaagtcatctacttgaaattttgttatgtatacaaataatgacctccaaaggtaaggtatcttaaatatcctttcttttgcttaaaggttaatagtgaaactatttacatgattcctttatttttgagacagtctcactctgtcacccaggttggagtacagtggtatgatctcggcccactgcaacctctgcctcctgggttcaagcatctcagcctcccaagtagctgggattacaggtgtgcaccaccatggctggctaatttttatatttgtagtagagacagggtttcaccatgttggccaggctggtctcgaactcctggcctcaagagatccgcctgccttggtctcccaaagcactgagattacaggcatgagccactgcaccaggcccatttacatgatgctttagagacattaatatgtttatacctcagcaaccttgagatgtaggaagtggcatagaagaagtaacctaaactcagttatcattgtaactggcacgttgtagacctggattgtgaatctaggaattctgattccaaatttgtgtttcattcaactatgctaaccatcaaaagtcatgtaaaactttttttttgtttgtttttttgaggcagtttctctcgctctgttgcccaggctggagtgcattggtgcagtcatagctcactgcagccttgacttcccaggttcaagcgatcctcccacctcagcctcctgagtaactgagaccacaggcactgccgcaccactatgactggctaattttttttttttttttttgtatagatcggatatcactatgatgcccaggctggtctcaaactcctgtgctcaaagagtcctaccacctgggcctcccaaagtgctgggattagaggtgtgaaccaccatgcccagccaagaacctcttaatatactgcatttaattgcaatatattgacagtatttcgttgaacatttttgagagctatgagaccagacttaggaatcttctaaaaaagtgaaacgaatgtaaatctttccttaagtataatgaatcatttcagtgccttattattatttctttgtattttcctttacagtgttttttttttaaaaaaaaaaaaaaaacagtggtttgattttatcttttatttgagacacagtttcactctgttgcccaggctagagggcagtggcacagtctcaactcactgcaaccttggcctcctgtgttcaagtgattctcatgcctcagcctccaaagtacttgggattacaggcgcctaccaccatgcccagctaatttttgtatttttagtagagatggggtttcaccatgttggccaggctggtctcgaactcctgacctcaggtgatctgcctgccttggcctcccaaagttctgggattacaggcgtcagccactacgcctgacctgatttttttctacctccagaatttgacatagtgactcacaagggatccataatgtactttgttgagattctaaaagagctttaagagtctattttttttgtcatctctttccagaataaaattacaatgaatgcataaagaagtgattgatgaatggtattaaacagtcagttttaagtcttattgccttttaatactacatcacagatgttttcagaagctagcttacgtttcagcttttaaaaatatgcattaggaactgtgcttcctatagtctgtgctctttattaaactgtgtcctttagtacatcacagactaagaatagctgactagatattcataaatacattgttgctttatattctaccttgttataaaaatggttttaattagtatatacatttaaagtttctaatgtaaatttacatttttgattttggtactgtttctggtgttaatttattcctaagtttagtatacatcttttaaaaaccaatattttatgttccatatttgtatacatttttgtaatttaattttcatccttcattgtgacaaacttgtcctactataccaaggatttaaggcgatattagttaatgatttctttaaggataagaaaataattcatgatgtaacagggactggaattagtcatttgagcttctgatgcattggtttttttgttttgttttgtttttgtttttgtttctgagatggtgtctcactctgtcacctgggctggagtgcagtggcatgatctcagcttactgcaaccttcgcctcccaggttcaagtgattcccgggcctcagcctcctagggagctgggattacaggcacatcaccatgccaggctaattttttttgtattttttggtagagacagagttttaccatgttggccaggctggcatcccctgacctcaagtcatccacccaccttggcctcccagagtgctgagattagaggcgtaagccaacgtgcccagcctaatgcattgtttatagacatgtttgttttcataagaacttttttctttctttcttttttttttttttttttaacatcaacaaagcaaggcaaataaaaccttcttttgtggccgggcgcggtgactcacgcctgtaatcccagcactttgggaggccgagacaggcggatcatgaggtcaggagatcgagaccatcctggctaacacggtgaaaccccgtctctactaaaaatacaaaaattagccgggcatggtggcgcgtgcctgtagtcccagctacacgggaggctgaggcaggagaatggcgtgaacccgggaggcggagcttgcagtgagtcgagatcgcgccactgcactccagcctgggcgacagagcgaaactctgtctcaaaaaaaaaaaaaaccttcttttatatggccttggtaaaatgaatccctttggcaaataatattgatcacatgctaagtatcttgtctcaagtgaagagagggtcaggttgaaatctgggtcagtttcttttacatttgaattttaaattctgtgtaatttgtatgttttaaatatgctgttaactcatgttcgtttattttctttcagtgttcccttgtgtaccagaacgtcctgggatgccttgtccaggagaagatagtgagtgtttatatacttcataccttttacaagagttactatgctatggtacaagtgaaaaagaaatcagagatagaatttttagctaggtgcagtggacagtggctaatgcctgtaatcccagcactgtgggaagctgaggtgggaggatcgcttaagcccaggagttcaagaccagcctgggcaacaaagtgagaccttgtctttccaaaaacacacaaaaaaattagcatggtgtgtgcctataatctcagctacttgggaggttgaggtgggaggatcccttgagcccaggagtttgaggctacagtgagccaaggtcgcactacttgcactctagtgtgggtgacagagacaggccttgtctcaaggggaaaaaaaaaaaggaaatagaagttctaattcatttgatttcttttccatttttcagtcaatttagaatatattagtgactgcccaaatgctactttgccagatcaaattcagatagttcttagttacaacttacatgattgcctgttgcacatatgaaaggaatattaagttaaatttaagttttaaaattcaattttggaaatgttcaaacctatacagaagttgaaacaacatggaaaacaaggatacctatatatcctttgcccagatttaccaatttttaacgttttccctgtttgctttatctctgtatctgtctatatctcatatatgcatgcacagttatacataacaaacacatttttttttttttggttataccacttgagactgacatgacactcagcacatgtaattaggaattggctttttttttttctgcagtgttttttacttaaacaggtattaagtcacttttgttgttgttgtttttgagacagaatctcgctttctcacccaggctggagtgcagtgacgcaatcttggctcattgcaaccttcacctctggggttcaagcaattctcctgcctcagcctcctgagtacctgggattacaggcgccaacaccatgctcagcttatttttgtacttttagtagagttgaggtttcaccatgttggccaggccggtgtcgaactactgacctcaggtgatccacctgcctcagcctcccagagtgctgtgattacaggtgtgagccactgcacctggccccaagtcacttattaaatgtctttaaatattgcagacttcctacagttgacccagagaaatgtgtatatttattagatctccaattcctagtaacttcaggtaaccaaccagagtccacagtggaacggtgattcttacccttggacacattaaaattgtgggatggagggaatgatcaatgccaaatttccatccccaagcttaatgaattagtgtggaggtgaaatctggatatctttgtattttaaaatggactctcaaaatgtagccattgggtcccacagcatcagcttcacctgagaactgaatagaaactgcactccaggctgggtgcagtggctcatgcctgtaaccctagcactttgggaggctgaggcaggcagatcacctgaggtcaggagttcaagaccagcctggccaacatggtgaaagcccatctctactaaaaatactaaaaaagttagctgggtgtggtggtgcatacctgtaatcctagctacctgggaggctgaggcaggagaattgcttgaacctgggaagcggaggttgcagtgagctgaggtcgcgccagtacattccaatctggacaacagagcgagactctgtctcaaaaaaaaaaaaaagaaaaaaactgcactccaatctacgtgattcataaactcttggactggggctgagctaccagatttaacaagctcttcaggtgattctgatgcacactaaagtttgagaaccaccatttaaaagcttccccaggtcaggaattgttaacggaatttctttggaatatctaagccaatggttactattaatgagatgaactaagagtgtccaactactctttgttctaatgtaatttaatatgcaaacttatgtttgattgtaagttattgcttttggtattttggcataatttactaattgtggatattaggcaactcattttcatttgtggtttctgcacatgcccatcactttagaaggaatagtggtaaatgctttgctttgaattaatcgaaatagctctaaactttctttttcttttttttttttttgagatggtcttgctctgtcgcccaggctggagtgcagtggcgagaactcggctgactgcaagctctgcctcctgggttcatgccattcagcctcctgagtagctgggattttaggtgcccactaccacgcccgtctaatttttttttttgtatttttagtagagatggggttttgtatttttagtagagtgctagccaggatggtctcaatctcctgatcttgtgatctgcccacctcggcctcccaaagtgctgggattacgggcgtgagccaccgcgcccggcctaaactttcaattctgtattaagctatcctgagatttctaattgagagcattgcaactggtctttagtatcttaattttaaatagtaaacccattgctatatttgctttaaaatatgactttgggaacctgttgtaatctttctatggtattaactattactgttattaccattactgtgggatgttattattaatgactaatagacaatatataaaataatgatggacttaaaaatatgaaggtggactagatttgatcgtttggaacctctttctctaactatatttgagaaacatattaatataaagaccactggatgaaaagttgttggggaaaaagatatgcttctggtacaaaatatcactttacagattagttacaaagactgaaatgtacctttacaatgaagagatctagcagtcactacctttaatggttattgaacatcagtagtgggagttgataatccgacatttgtgtacctcatgaaaagtaatgagataagaaatacacaacactacctatgtgttatttttgccaaaggtatttaatactgcctctaatcgtaagtaaacagacaaatccagaatgtgggatataatatgaaacaactaaccagactctttaaaaaaaaaaaaaagtcaacataatgaaaaggaagtaacaacaaataaggcagagtgaatgttttaaaatgttaaggagaccaaaaaaagcatgatcaaatgcagtccctgaatcttgattgcatcctggatagaaaaagtgagctttgaaagtcactttggggcctggcatggtggcccatgcctgtaatcccagcgctttgggaggctgaggcagacagatcacctgaggtcagtagtttgagaccagcctggccaacgtggcaaaaccccatctttactaaaaatacaaaaattagccgggtgtggtggtgtgtacctgcaatcccagctactcgggtggccgaggcaggagaattgcttaaacccaggaggcggaggttgcagtgggctgagattgcaccactggactccagcctgggtgatggagtgagactgtgtctcaaaaaagaaagtcactttgagaccagttagggaagtttgtatatgaattgtatactggttgatattgaattaatgttgattttctaagacatggtaaatggtattgtggttaggtagaattgggtggcgggggggtgcggaatatccttaatctcagacaatggatacttgggtattaaagggtatttaagtgccatgatgtctgcattttacttccaagtaattcagaaaaaaaaaagtattttttttgtagtgatgaaagtaaatatgacaaaacatgaataattggtaaatctcggtgaaagatgcaggtgtctattcttttaccttttctgtgggattaaaagatgttcaaaataaaaagttggaggaaaatttttaaaaagaaaagcagtagtaggccgggcgcgttggctcacgcctgtaatcccagcactatgggaggccgaggcgggcggatcatctgaggtcgggagttcaaggccagcctgaccaacatggagaaaccctgtctctactaagaatacaaaattagctgagcatggtggtgcatctctgtaatctcagctacttgggaggctgaggcaggagaatcacttgaacccgggaggtggaggttgcagtgagctgagactgtgccaccgcactccagcctgggtgacagagcaagactccatctcaccaaaaaaaaaaaaaaaaaaaaggacaagcagtaggcagtagtagtcaaatatttatactctgtggtctttatttttctttggtcccttgatgaatctattttattttttgacgttcaggtttttatcagtatttttttttcttgcagtgagtatcatgaaaaaattacagacttaattataaaatgatttttactcaaacttgctcttttttctttttttaactattactctgtcttcagaatccatctaccgtagaggtgcacgccgctggagaaagctttattgtgccaatggccacactttccaagccaagcgtttcaacagggtaaacatagtttgttgaatgtcgataatgtgaaacagctattttttccctttctactatgaaagaaaggtagtttgttattaagtcttgttatacacttttaaatacataagtagcatgaccttacatttccagtttgcctgaggcagtatgcctataatttttaatagcatctctttcactcttaaaaatgctccaggccaggtgtggtggctcaggcctataatcccagcacattgggaggccaaggctgccggatcagttgaggccaggagttcataccagcctggccaacatggcaaaaccttatctctattaaaaatacaaaaattagccaggtgcagtcacatgcacctgtagtcccagctactcgggaggctgaggcaggagaatcacttgagtctgggaggcagaggttgcagtgagccgagattgtgccactgcactccagcctgggcaatggagcaagactcagtttcaaaaaaaaaaaaaaaaagctccagattggatgattaattattccacataatataccctagctgtaagaaaattgaattttaaaatataatttaaggcaaccagaaaacaagcaaggtttatttatttaatattaatctttatttttccagttagtgttgtaatttgattttcactgtttagaaaataataatagcaaacacttatctgggttgtactacgtaccaggcacttttccaaatgccttatatacattgattcatttcatccttacaacaaccctgtaagataggtactatatgtttccactttatagatggcaaaactcaagtgcagggcagtaacttgcccaagataatacagctagtaagtgatagaaccaaagtttgaaagcagcagtctgtcttcagaagtcagttattcatttattatttatttattttttttttattttaaagacagagtcccgctctatcgcccaggctggagtgcaatggcacagtctcagctcactgcaacctgcatctcttgggttcaagcgattcttgtgcctcagcctcctgagtacctgggaccacaggcatcagccaacaggcctggctattttttgtatttttagtagagatggagttataccttgttggccaagctggtctcaaactcctgacctcgcgtgatccgtccgcctcggcctcccaaagtgctgggattacaggcttgagccaccatgcctggccagaaacgaattttttaaatactcttgataaccgcaaatttttggatgccatttccattctaaaactaatgccatgtaattaattaatgtaaatagaaaccaccacccgaaatccctctccaaactctcttacttccagtagcactgacatttaagaaggctttgaggctgggtgcaatggcacatgcctgtaatcccagcagtttgggaggctgcgaagggggaacactgaagcccaggagtttgagaccagccagggtaacgtagtgtgagatcccatctctacaaaaaatacaatcattagcagggcatggtggcacacacctgtagtcctagctactcaggaagcttgagcccaggacgttgaggctgcagtgaatcaaagtgactccactggactccagcctggctgacagagcaagaccctgtctcttaaaaataaataaataaataaaaagagagaccaagtgcggtggctcacacgtgtaatcccagcactttgggaggctgaggtgggtggatcacctgaggtccaggagtttgagaccagcctgaccaacatggtgaaaccccatctctactaaaaatacaaaacttagccaggtatggtggcgcatacctgtaatcccagctactctggaggctgaggcaggagaatcacttgaacccgggaggcggaggttgcggtaagctgagattgtgccattgcattccagcctgggcaacaagagtgaaactctgtctcaaaaaaaaaaaagaaagaaaagaagaagaaggcggctttgaaatgagaagtcactttaggttattgctctttaagaaaacagagctttgttttgacctctgaacagcctgcaaggtttatgtttgcttaggagtccttcaatggctttttctgccatatatatttctagtttaattctgttttcattattttgaacttgattatgtaaagactgaaaattcttagacttagaaagaaatgtggttgcagatttcactgtctctttaaaataagctctgtttttcgctgaccttcatagcttttaaaaaattatgtatgaggaagctttgttttgcttttgtttttgtttttgttgtgggctgacagttgacaccgtgacaaagggaattgagtcagcaaactatttgggaaatggttatgaccttcttggttaataaaatattgttgaattactcttttcagcgtgctcactgtgccatctgcacagaccgaatatggggacttggacgccaaggatataagtgcatcaactgcaaactcttggttcataagaagtgccataaactcgtcacaattgaatgtgggcggcattctttgccacaggtaagatgtctgtccttttttttttttttttttttaagagcgtgcttgataacactgctataacagagtgctaaaatagggaggtgttcaggaattacagcacaacagagtagctacagagtatggggaggaataccttacgttactgttaacacaccgtgaactttggaacttcgaaatatctgtggtaatacttgtctgtgggacacagttaacttctttacctgctgtaaaatcctctggtctaaattaggaagctatagagagaaccatttaagagttttttccccctctcctttaatctgaacgtattagtttatagctcacattattctagcttctatcctaagcagatatcaggtaagaagagtcaaaggtatcatgtttgttatttaaactgtgagattactggcgaggaaagcatttaaaatttttatttattaatttctattttaaatatataaaacatgtttgttatcgaaaaaaatacagaatacagatgaataaagaaaactaagtaaaagtccacatatattctaccatgtaaaggtaattgtcatttggtggatatccttccagaacttttcctgtgcaaatttatatgcataaacatttttaattttccatatggaaaaaatgtaaacatgtataagagtaggtggaacactataatgaactcccatttactagacatccagctccaacagttatcaactcatgtctaatcttggtttcatctgtacccccattcacttaacttccccttgccctgtattattttcaaacaaatctcagacatatttcagtatgtacctctaaaagagaaggacttttttaaaaacctaactaaaaaacaaattctttatgtcaaatatccagtaagtgttctcataaatattataattttgtttttatagttttcattatgaatcaggatccaaatgaaatgcacttgtacaattgattgatctcttagatattctttaatttactggttctttcttcatttctctctcttctttttttccttacaatttaattgtaaaagaaacagttatttgtcatttacactgttgtaaaattttgctcattacttctccatggttatgttcagtatgttattgtcttctttattcttttatcttgtacagtagttggatgtcgaggtttgattagattctggggttggtttgtttgttttggtggattgtttttgagtcgactttacagagggttgtttatccaccagaaggcacatgtgcttgcctgtgtcttttttgttattgttttgagacagagcctcgctctgtcttccaggctggaatgtagtggcacaatcttggctcactgcaacctccacctcccaggttcaagtgattctcctgcctcagcctcccaagtagctgggattacaggtgtgtgccaccatgcccagctaatttttgtattttcagtagagatggggtttttgccacgttggccaggctggtcttgaattcctgacctcaggtgatccacctgcctcggtctcccaaagtgctggaattacaggcgtgagccactgcacttggccaatcttagtgaactttctggcaaatcttacttccttaaggatccagaattagaattactgggttaaaagatacgcatttaaaaaaatacctggatgcagctatctaagcacactgcctatcgattagccctgctccacaaggaacagtcaaaaaaagaaagaaaaatacctggatgcatctttctaaattgtcctttagaattgttattccatgtttattcatgggacttgctttggacattgtgaaagcaggttattaccggtagctctttggtattagaatctttaattagttcatataagcttaggaatgggtttgtagtaaaggggaaaatccaatcttaaggaaaaacagaaggctgactatttccaacatatttatgtaggttactattaatatttttgagtattctttggtgacatatggaaggaaagggggcagggttagtgattatattgaagttttaaaaatccttaagcttacttatgagcctttctttaacgcagccttgaaatgctaactgtatcattaatgttctttctcaagtttactttttcctgctggtattcattaaatgtgagtctaagaataaatcagtaataacttgggtttgaatttacctttttcctgagattattcgccattatttgggtaagttggattctagaaagtatttcttttctcttttttggggccactgacacccttgagaatcttcaggaaaatgggaaacccacaaaattttacatgtaattttaagaggttatagacatcctgaagtctaccccggaccccagctaaagaatgcatattccagaaacttatttttgccaaagatctgaagtggagcttgaaggaagaataggtagtgttgaagagaagcaaagcagaatatatggcagtttaatatgatttctaattggtggtctgaaattagttttgtattttcttttctgtaaaatgtgactaacattacctcattcacagcagtattgtatagtttcataaaacaaaattaaaagtaaattctcacttaagttatattctttcaaaattaaattttaatatgctgtgtgttgttgaaatagtgttatttctggtgtaatagaggtactccactgagttactgtgtctttggaaatgtttgtaggaaccagtgatgcccatggatcagtcatccatgcattctgaccatgcacagacaggtaagagtggtgctggcacaacccattgttcattcacagagtagcatgtaaagacttacttaggtgactctcttacccaagtttaaaaacatttacttcttcccaattaaaagtaaatacatatattttgtagtggtgaaatcagtcacactatttaacatacacatttggcatttttaaaagacaactgtgggctgggtgcggtggttcacacctgtaatcccagcactttgggaggctgaggcaggtggatcacctgaggtcaggagttcgagaccagcctggccaacgtggtaaaaccccgtctctactaaaaatacaaaaattagcagggtgtggtggcacactcctgtagtcccagcttctcaggaggctgaggcgggaaaatcgcttgaacccagaagttggaggttgcagtgagccaagatcatgccactgcactctagcctgggtgacagaacaagactccatctcaaaaaagagagagagaaaaaaaaaagacaactgtgggctgggtgtggtggctcacggctgtaatctcatcactttgggaggtcgaggcagaaggatcccttgagctcaggagttcaagaccagcctggccaacacagggagactctgtctctatttaaaaaaaaaaaaagtatgtaaactacaacaaatgactattttttctagttcacataaatttcttttgagacgcctttaaattcagcaaactcagtttttttccataatgaaaaacatgaggctgattttgtggcccatgttgactgtgttcaggtgactcgcttttttctttttctttcgagacagagtcttgctctgttgcccaagctggaatgcagtggcgtgatctcggctcactgcatcctccacctcccaggttcaagtgattctcctgcctcagcctcctgagcatctgggattacaggttcatgccaccatgcccagctaatttttttgtatttttagtagagatggggtttcaccatgttggccaagctggtctcgaattcctgacctcaagtaatccacccgccttggcctcccaaagtgctgggattacaggcatgagccatggcacccagctgaagtgacttgtttttattaaaagctttattatcagaagtagaaattatgtgaaacatagagagatgcaatataggaaattccaggaagatggtgtaactgaaaacgttagatagatacaaaaccttaaacacgtatctgggaaatttggagagcagtgcaaggaggtagaacagcatgatcttctctggactaaatcaagaaagggaaaacaagggagtttttctggaaagacaaaatgcaatctcgtagtcatagaatgatcaactctatgaaatgcaggctcttttttttttgccccaagtagctttaagaagtagaagttccatccttgtctgttctttacttgaccattgtggtagttaggaaaattctgagtacaatggagtgagaagtgaaaaccagaggtcctgtatctctatgtcttagtcatactaaaaaatttaaacatatcttatagagtcatttgtttagaaggaagtgtttgattaatttgtaaagaagagaaatgttttaaaaataacgaaagtacttgttaaaagcagtacttggctaccaggttgtgatgcttgctctctttaccctcactaaagattaggatttaactattgtatttacatacaatttgttattagtaggacagatagtcagttttaaataatgaaaatttattcagaagtaaaaactaaaataaaaatcaggagacaatttttatttcaaactcattaatggttgctgtttttttctcctgcaccttttttttttttttttttaatgtttggtattgggtttttagtaattccatataatccttcaagtcatgagagtttggatcaagttggtgaagaaaaagaggtaagataatttgtcttattgtacattatatcattagctttttaataaggctcaggagtttaaaagtatgacatattgacctgcttagactttagatcataatggtgaaatgcaaaaatgatttgtaatgattccagagttttattctgatttaatttagtaattaaattactaatttaaactaggaaataatttagtgggataacttattttcattttaaaatagcttaatctgaaaattacaatgtatttaaggatactgtttaaaatacttggtagtattgtttaaaatatatagtagacccttccgttttgtgcctgaattgcttatttagacaataaatgattaaacatattaactgtcattgtttttttgactattaagtattttatcagtttttaaaacaaaacaaataattaaaatgatttgattaaaataataatcagttttttgaaaaaagcttatagtgaaaaagataatcatgtctcccaccttccactcccagtttggcttcttggcaaccttttaaaccatttctagttatgtccataatatttatatttctgtttttcaattttttatttttgtgtatttctggacatgaaagatttagttcacactgcctcctctctttcccgtatcattctttttttttttttttttgagttggggtcttgctgtgttgcccaggctggagtgcagtggtgtgattatggctcactgcaaccttaaactcctgggctcaagttatcttcccaccttagcctcccgagtagctaggactatagccctgtgccaccacacccagctaattttttcattttctattttgtagagacagagtctcactatgttgcccaagctagtcccgaactcctggcctcaagcagttctcccaaatcagcctctctaagtgttaggattacaggcatgagccaccatgcccagccaaaactttgaaacataaataaaagtaaacaataatataacaaagcccttgtatctattgttagttaaaacagctatcaattcatgtctagccttattttgtctactcacttccctcactcctgtattattttgaagaaacctgttagtcacctatttgatgttatgttttagtttcttgttctgtttgtctgaaaaagtctttttttctttttaacttttttttttctttttattttttttgtgagacaggattattgcacaggcacccgtgcagtggtgcaatgatggctcactacagcctcaacttcttgagttcaagccacctcagcctctcaggtagctgggactacaggcatgtgtcaccactggaccctcatcacaatatacaaaaatttactcaaggtggaataaagatttaaatgtaatacctcaaactataaaaatcctagaagaaaacctaggaaatatcctctcgacattggccccggcaaagaatttttggctaagtctccgaaaacaattgcaacaaagccaaaaattgacaagtgggacctaattaaactacagagcttccacgcagcaaaagaatccaccaataaacagacaacctaaagaatgggagaaaatagtcacaaactatacatccaacaaagatctcatatccagaatttataaggaacttaacagcaaaaaacaaccccattaaaaaatgagcaaagggctgggcatggtggcttacaccagtaatcccagcactttgggaggcagagtcaggcagatcacttgaggccaggagtttgagatcagcctggctgacatagtgaaaccccatgtctactaaaaatacaaaaaaaaaaaaaaaattagggcgtggtggcacacacctataatactagctacttaagaggttgaggcacgaaaatcattggaactggggaggcggagattacaatgagccaagatcatgccactgcactccagcctgggcgacagagcaagacactgtttaaaaaaagaaaaaaaaaagggcaaaggacatgaacagacatatctcaaaataagacctataagcagccaacacacatgaaaaaccactcatcgtcactaattatcagagaaatagaaatcaaaaccacagtgagataccatctcacaccagtcagaatagctgttactaaaaaatcaacttgggcgtgatggctcacacatgtaatcccagcactttgagaggctaaggcggaaggattgagcctgagagttcaagagcagcctaggcaacatagtctctactaaaaatacaaaaaattagccaggctcggtggcaggcgcctgtagtcccagctgctcgggaggctgaggcaggagaatggtgtgaacccaggaggcggagcttgcagtgagcagagactgtaccagtgcactccagcctgggcgaaagagcgagactccgtctcaaaaaaaaaaaaaaaagaaaattacaaataacacttttactgtttctctagaagatgcagtgaccttggcacaccttaaattcattccttttccattcctgcctttgggtgttattattatcagagtttaaaattctgtgtgtgtgtatatttgtttttttaaacagttactccttatgtagatttacccacattttaccctttttgtttttctttccttcctacgtctgttcctccatctgagatcatgcattttctccttcaagaactcaatttagtttttcctttagtgagcacctagtagtgatggatccactcagtttttctttgtctgaaaatgtttttctttcactttcactttgtgagctacttttgcaggatagagaattctaggtcagctgttttcttcttttttaggccctttgaagatgacatttcactgttaagtggcgtctatcatttcattcagccttattattgtgtcggtgaagttaactctatcttttttgctccacttgattctctcttatagtttccagttagccatatttcaagtctatgtgttgacttactttcttacacttctcttctttcttaaccttctcaaacctggtttcttttcactctgctgtatttacccttgtgtgttagtctgttttgtgttgttacaaaggaatacctgaaggttgggtgtggcagctcacacctataatcctaggactttagaccgggaggatcatttgaggccagtagttcaggaccagccttggcaacatagcaagaccctccatgtctacaaaaaataaataaaaattagccgggtttggaggcacatgcctgtagccccagctacttgggagactgaggcaggaggatcacttgagcccaggagttcatggctgcagtgagctatgttcgtgccactgcactgcagcctgggtgacagaacaagaccttttcttaaataaataaataaatgaaggaaggaataaaggaatacctaaggctgggtaatttatacaagatttatttggtgcacggttctgcaggctgatcagtaagtattgcactagcatctgcttctcaggaagctttcagtcttggcagaaggcaaaggggaagcaggtgtgccacatggcaagagagggagcaagggagtcaggggaggtgccacactctgaactcactcattacacaggaacacaccaagccattcatgaggaatctgtccctgtgacccaaacacctcccactagggatcacatttcagcatgagatttgagatttggaggggtcagatatacaaactatcaccttgttaccaaatcaaattattattattattactattattgacagggtctcactttgtgatgcaggctggagcgcactggcacaatcacagctcactgcaaccttgacctgcctggctcaggtgatcctcccacctcagcctcccaggtagctgggactacagtgcacaccaccaacatccggctaatttttgtatattttggtagagatgaggtttctcggcacattgcccaggctggtcttgaactcctgggctcaatcagtccacctgcttcagcctccctaagtgctgaaaatacaggcatgagccactgtgcgcagcctaaattattatttctaagtttttaagttgtcattctcactcagtttttctaatacccttctttcagttttgtgcttgcgggtttctttatctttctcaaaatttactatttgcttttcttggtattcttcacttcagagatttcatactttattctcatgggtccattgtgtgctgatgattttgcaggcatctaataaaagactgtcttcaggcttctctgtaaattgctagaagcttacatttgtagttgtgaatgaattttaaggcttactttgtcgtcccaaaggggtcttggtattctgtggaaaagaatgtcttccattcgctgaactacttcatgcttgttttctgtctatagcatccaaaaacgcctctgaatgtgtgctctcactagcttacattctatgtatcaagcttccagcagactctttcatcttgatgtctcattataacttctgaatttatcatgaaaaacccaatcgttctctccagtaactttgtcaatcttatcctagccacacacttgacgttccctgtcagtggtacccccaatctcttggtcaccaaggttaatgtgtttttttaattcctgcatctctattgcctctgtacccaaaagttatcgtatcctttttaagacatccttcgatgtttttgtgatttcaactccctccccattcttattaccatccctcttatctcaaaattcatccatataatctggatagttagattatttggtttggaatgacatttgaaaaatattaagaacttaaaatatttttatgttaggaaaatatctttaaatcgttataggtacaactaggtgttagaaatataatgtactacgcaaagcatttcccattataactctgatacaaatgttctcaacaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggtaagcactgcatattttattgcttctaaactgcttgagaatactattcttttttttttttgaaacggagtttcgctcttgtcacccagcctggagtgctagtggtgcaatcttggctcactgcaacctctgcctcccaggttcaagtgattctcctgcctcagcctcccaagtagctgggattacaggcatgcaccactatgcccagctaatttttgtatttttagtagagatggggtttcaccatgttggccaggctgctcttgaactcctgacctcaagtgatccacccgcctcagcctcccaaagttgctaggaatataggcgtgagccaccgcacccagccaagagtactattttaaagaaaacctctatgtttgtgctttattatctcattctgcttttctaaatatgtgctaagtaaatgaaatatattatttcggtttacttttcttatagatggtataagatatttaaagtaatttgattattagatttttttaaaaaaacaaaaatcaaaccacattattatcaggagaaatacttgagctttgtaaaagttttctagacagttttataatactgaaagattgactagtgttatttttctctttgtatgtaaattttcgtttcatgattatcaatggttttgatatttagcctagttaaccattgcatttgtgaccattgaattgctcagagcaaatttatcattaattgtgatatcagtttgacatagatttcttacatgtttcaaaataggatattgattgggtacagacagagaagcatgtgtttgagcaggcatccaatcatcctttccttgttgggctgcattcttgctttcagacagaaagcaggtaagattgaaagatagtagaatgattactgggcttcatatttttggtcatattacacagttagaacctttctgccctaattcatgaagttgatatcatggaggatgcaacagtgttaggcttataacttcctgctaataatactgccatcagtgatatcagtttgatattagatcagcattaggaaatgacctactttaggcagaacaggaaatagccatgtcgtaattatggcagtagaaatccaaccttttaaatatccccagtattctagttttatgacttaaaattttctagcatttaacaaggaggaaaaataccttgacagtcgaaaatgacttatttagcaaatgctaaaattaggatggtaatgagtggctctggattgcaagtggtactactttagaacagaagtagtaggttacaaaattattatcatgctggtttactttctcgtatgttccgtaccctagataccctttgtttccaccaaaattttggcatctttttaaaggctaaatagtagagaatgctctctgttgtgatggtttctgaaaatgcaaagttacactaccttattttggatcttgatttcatgggttctctcctgtgttttagattgttctttgttatagagtatgtaaatggaggagacctaatgtttcatatgcagcgacaaagaaaacttcctgaagaacatgccaggtgagtttttgtttactgtttgtgttgttttctttttggggccatgtggctttttatgtgcagtggttggaaacagtagataaataatttattttgatactagttaattatttgtaagtcatgcagaggctgagctaaaagttaatttacattatatatatgtaaaacaattatatattcttttacatttatacacatacatgtacatacacatgcacacagtgcttcctaagcaattgaaaagtgtgaacagtattaaaaggcaaacctttagtctgctaaaaccaatccttttcaaatattatgtctatgtagcatcagccatttaaataattgagactaataaacacttattagtcttttcaggtttgtagtggtctctcagagagttcttcacgataagagtgctattcatacatacttgagagtaattaaacgatccctctggctgggcacagtggctcacacctctaatcccagcactttgggaggctgaggcgggcggatcacctgaggtcaggagtttgagaccagcctggccaacatggtgaaaccctgtctctactaaaaatacaaaaatttgctggtcgtggtggcgggtgcctgtaatcccagctactcaggaggctgaggcaggagaattgtctgaacccggaaggcggaggttgcagtgagcccagatcgcaccactgcactccagcctggccaacagagcaagactctgtctcaaaaaaaaaaaaaaaagatccctcttaaactagtatatacttctgactgttcttcctgtgatttattgttctttggcttttttttcctctaatcccataattattgatgaataaaataatatcgaataggccaggcgcagtggctcatgcctgtaatcccagcactttgggaggccgaggcgggtggatcatgaggtcaagaaatcgagaccatcctggccaacatggtgaaaccccatctctactaaaaatataaaaattagccgggcgtggtggcgggcacctgtggtcccaactacttgggaggctgaattaggagaatcgcttgagcccgggaggcggaggttgcagtgagctgagattgcgccactgcactccagcctgggtgaaagagcgagactccgtctcaaaaaaaaaaaaaaaagtattgaatattaattttgtgcccttaatttgatattaatatacaagactgtaaattgtttatgtgttggatggaggagataggtgggaagggatcatggccttgagtaaaaagtttaatccatcagtaccatgttttgtttcttatccgtaatcagcagtaattctcaccctttcctacttcacaagagtaatgccaaaatgaagcatgtgagtttgtatatgtatgttattatcatgcagggaataaatattagaaatttcatttaaattaaaaacttgtagaaaatttgctacttcattattgcttgtcaaaaatttcataagaagatataaattgtacttgtctaatcttgaggccaacctgggttttttgtttatttgggtttttttgttgttgttttggtgttcatttatgttcattgtgtatttatgccttatcaaatggtcacccttcatagagccacagatgatattttgaattgtgaacatagccaatatttgttccttgtttgttcagttgaatgtgggaaagctagtctggtttttactatattaatgtgccagttttggttttataccatctttgcttttgtaagaactaaagcccaggacaagggcttaagttcccaaatcacggaattaagtagctaggaggtgtatgttacgtacctccacacatgatcatgataatgtgccaccaaagcagccatacatcagctcaggcattccattttcattattcaggccaaaagttctgggttgtcaccagtgagttggtagcagtttttttaagttcttcatttaatattaaattttacagttgtttatagttgtagaatattttcatttaattccttttctaaaaccttcatgaggattttatagtattgagtagtcagcttgtagtattctttctattctcgaccccattagtggttcttagccttctcggaggatcacgggtcccttagagaagtgatgaaagctttgaggactctgtagatactgtgcatgtacatacgggcatacacctttgcccccagttgtagaagtatggactgcctgaagttcacccaaggacccagattgagaacccctgtttgagactatcaaattaatagctttatgaaaaatgtgagtttaagttagacaggaacttttacaattgtgtcttgggctcagatgttttaaagtggtacttcagttcatttttcaaatttgttcctaaaatcactgggagaaaaaaatatgttttaatatgaatttttgtgtttccagttgtaaatgtagaacttaaatatggttgaatcaaatgacttattttttatttaattttagattttactctgcagaaatcagtctagcattaaattatcttcatgagcgagggataatttatagagatttgaaactggacaatgtattactggactctgaaggccacattaaactcactgactacggcatgtgtaaggtgaggaaaattttctagttattttaaaaggtcttcagcagctagtagtctttgtaaaataacttcatgtttaaagatgaggaaatgattactaattttgctaatttacttaagctttgtggaattctagcacaaagacaaatgtactttttttctaaccatttgcaaaatttgtatcttctgtgttatgtgtactacaataagagctaatttctttttattatacataactttttatcttgaaagttgaaatacaattgaagacaatttggaaataaaaattgtctgcaattccactacttaacacaaccatttgcatatgaccttccaatttttgccatttagtagtgaatcttatataatgcattcaggattttcctcagaagtcaaacattttttatatttaaattttaaacatctgacataaagcataataggataaaacaagaatttcagttactcccggaatatgtcttcatttctttttttttttttttttttgagacagggtcttgctctgtcccccaggctggagtgcagtggcgcaatctcggctcagtgccagctccgcctcccgggttgacgccattctcctgcctcagcctcccgagtagctgggactacaggcgcctgccaccacgcccagctaagtttttgtatttttagaagagacggggtttcaccatgttagccaggatgatctcaatctcctgatctcatgatccgcctgcctcagcctcccaaagtgctgggattacaggcgtgagccatcgcgcctggcctatttcttgatgttttattcttttataacagtgttccattttaaatgtctgatattttcccactaaatgtgtaaggaactattccttgttaaggtaactggtacaaaattatcctcacatagcaatacaacaaccagtatgtaaatgtgtgaattgcattccctgttcacctgtgggaagtgcctccagagcctggagattatctaaatgctaacaacatggcatatgacaacctagttgtatcgaagatttaactttattatctgttcagcatgcattaaagaataaaatcttcacttaaactatgtttgcttttatgtacagaattcaaccgtacttttcacatgatacttattaattaattattgttgttttttttttttggagacagagtctcgctctgtcgtccaggctggagtgcaatggcacaatcttggctcactgcaacctccgcctcctggattcaagccgttctccagcctcagccttccaagtagctgagattaaggtgcgccccaccatccctggctaattttaattttttttttttttttttaatttttgagacagagttttgctcttattgcccaggctggagtacaatggcacaatctcggctcactgcaacctccacctcccaggttcaagcaattctcctgcctcagcctcctgagtagctgggattacaggcacctgccaccatgcccggctaatttttttgtatttttagtagagacggggtttcaccatgttggccaggctggtcgcgaactcctgacctcaggtgatccacccgcctcagcctcccaaagtgctgggattacagatgtgagccaccatgcccggcccttacgtatttatattatacaagttttcaatcataaacaattagaaagcttagcgagtggaacccctatgtacctatcacttatatttgtggtacctttttgatctctgtgtcattttttttcctaagggatttttttctcatttcagaaaaaagtgacagtgatagaggagtcttatccccaagaataaatgaaactgaacaaaaaacatggagagtattacccttcatacgaagtgcacaaattaaaacaatgaggcttttttttttttttttttttttgcctgtgagatacgggttttaaagttagaatagcctgtatgtacaagagtttaaagaaatgggcatatgtcactggtgtgtatataaattgttacaaaccttttgagaagcagtttgatgggggaattatcaggaatcctaaagatggccatgttctttgatccggtaattctgcccttggatattctgagtaaatattttggtttatgaggagagatttctgaccaaaacttttattgtagtttatgatcaatattataaagtcatttaagaagatctttatttttattttatttttactttcttttttttttttttaaatagagacgaggtctcgctgtgttgcccaggctcgtctcaaacccaagagttcataatgttagcatttagataatctccaggctctggaggcactttcctcaggtgaatggggaatgcagttcatacatttacatatttgtcatgttactatgtgaggataattttgttccagttaacaaggaaagcaagccaccacgcccgactgaagatatttgtaaaaaatacataacacatgatggctcagacctgtaatcccagcaatttgggaggccgaggcaggcagattgctggagctcagaagttcgacaccagcctgggcaacatggcaaaactccatctctacaaaaaataggaaaattacactgggttggttgtgcttgtagtcccagctacttgggaggctgagatggggggatcacttgagcctggggctgtagtgagctgtaatcgcgccactgcactccagtctgggtgacagagtgagatcctatctaaaatatatatatatatagagagagagagagtaataaatatatatatgtatatacataatgcttataacagatgaagtcttaacatatagaattgtctgattcttttatgtatcattctgttatgtagcatcacacgttgattctgtttacttttcagcatttttcaagttgttattttaaaatgttatgttaaatgtggttaccaattgcattacagtacactaatgcattttaataacattttaaaatgttatttttaaataacacctttaatggaatcactgcattgtttaaacaatcaaaatgggcagggtgtgatggctcacacctgtaatctcagcactttgggaggcccggcaggcagatcacttgaggtcaggagtttgagaccagcctggccaacatggtaaaatcttgtctctactaaaaacaccaaaagattagctgggcatggtggcacacctgtggtcccagctactcaggagactaaggcaggagaattgcttgaacctggaggcagaggttgcagtgagtggagattgtgccactgcactccagtctgggtgacaaagtgagactctgtctcaaaaaaaaaaaaaaaaaaaaaagaaaatcacaaaaatgaattaagacttttctcttggccgggtgcggtggcttgcacctgtaatcccagcattttgggaggccgaggcaggcggatcacaggtcaggagattgagaccatcctggctaacatggtgaaaccccgtctctactaaaaatacaaaaaaattagccaggcgtggtggcggacgcctgtagtcccagctactcgggaggctgaggcaggagaatggcgagaacccgggaggcggagcttgcagtgacccgagatcgcgccactgcattccagcctgggcaacagagtgagactacgtctcaaaaaaaaaaaaaggacttttctctttttgtctttcttagtcttttgttactcttactggaaaataatattggcttcttatacattttcatttcttacagggatcctcaatcaagttagtcaaggtgtttcataaatctgagatctttatcgagtaggtctttaaatcaaatgtcctcctacctccctttctgcctttcctccttctccaagagctgcctagggcgggtgcagtggctcacgcctataattccagcactttgggaggccaaggcaggcggattacttgaggtcaggagtttgagaccagcctggccaacatggtgaaaacccatctctgctaaaaccacaaaaactagccaggtgtggtggcgagtgcctgtaatcccagctacttgggaggctgaggcagaagaatctcttgaacctggggtggggtggagattgcagtgagctaagatcacaccactgcactgcactccagactgggcaacagagtgagactccgcctcaaaatatatacatataaaataaaataaaaaataaagcttatgagaaattaaccctccaaaagtttgaatgctcttttatgacttagtgtcaatatttaacttacctgaagcttgacttcatgcaagtgttggatgaatttctttataaagattgcagaggatagtgatgaaaacttgaattagtatctttagagttatgtttgaaatattttatgaacgttgattttattaagtggcagcctttcgtggttttatgaactgatgtgcctttaagtgtttttttcatcaacagaggaattctaataatatctgttatgctgcagaaaacttagcaaatggacctacattctgacattcagtcaacaagtgaatgattaagcatagctgttacaagttaacagactacatctcttacctctgactattgtactgaaagtacatgtcatttttcatgagaatgtattgccgttgccaataatagaaaacaataaaaaccatattcatatttctaaaaatagcatataatatcccttttagaaatcattttaaaattcttggagtcacaacatattactaaatatttcttctagatgtttatagcagtgttatatataacagggtgaaatttgaagaaaaatatgttcaccatgcccagaatgtctctggagggccacataatagtggttgcctctagggagctggaactgggtgagtcagggacaagaatggaaggaagggccgggcacagtgctcacgcctgtaatcgcagcactttgggaggctaaggtgagtgaatcacctgaggtcaggagtttgagaccaacctggccaacatggcaaaaccccatctctactaaaaatacaaaaagccagaggctcggcacagtggctcactcctgtaatcccagcactttgggaggccgaggcgggtggatcacttgaggtcaggagttcgagaccaacctgaccaacatggtgaaaccccgtcactactaaaaataaaaaattaggtgggcgtggtggtgcatatctgtaatcccagctacttgggaggctgaggcaggagaatcgcttgaacctgggaggcagaggttgcagtgagccgagatcgcaccattgcactccagcctgggtaacgagcgaaactccatcttaaaagaagaaaaaaaagccaggcgtggttgcatgcacctgtaatcccagctacttgggaggctgaggcgtgagaatcacttgaacctgggagacagaggttgcaatgagccaagatcacgccactgaactccagcctggatgacagagcgaaactcggtctcaaaaaaaaaaaaaaggaaggcttgagttttgtgctgcccctcttttttggtttagaattttgtaccgtataatctataggaaagtggttaagttctaggtacatatgttctgttgaatttcatatagttgttaatattagaaagtcttcggttgtgtaggaaatgcttacaaagttttaaaacatgcttaattatgtatgattcagttgtctttagacttttttattgttgattttttttttatttgccttttggccagagaatggtttgaatattagttcattggaatacattgagatttcctttatgacctaatatatggccagtagcccatgtgtacttaaaaggatatataatctttacatgcagggagtctctctctctaatgtctctcttccttctccctcactccacacacacatatagacgtacatatattctacatgtatatgtattttgtatatatatatatatattttaactctagcttttttccaaatctttctctgcctactgatttttagtatgtgtgatctatcattttctaatatagattattctcatattaacttctcctattatgattggagattgtgaaattctcctaataattttgtccttttttactctttgtattttgaggccatgttgttgagtgtatgcaagtgtatatttgttacaatttcttggtgattgtcccattaattattgggtagttcctttactctgcctgttagtgtgttttgccttattttttttccatcctacagctattaaaatacaggcccggcatggtggcttatgcctgtaatcccagcactttgggaggccgaggtgggcagatcatctggtcaggagtttgagaccagcctgagcaacatggagaaaccccattttctactaaaaatacaaaattagttgggtgtggtggcacacgcctataatctcagctactctggaggctgaggcaggagaattgcttgaatccgggaggcggaggttgcagtgagctgacattgtgccattgcactccagcctgggcaacaaagtgaaactctgtctccaaaaaaaaaaagtgttcttaggaaaaataaacagaaggaaaatattgtagtcttatcaatggttgtattaggaggtgagatttaaagtgcttcttttcttcatgaaatatgccttattctactaatattaaaattttgttattaaattttaacttgtatgtaaattattttaaattcaagtcgtaccttaattgaatcaactctagcaacatctaatgaggacaggttttcttcaagctatttagtggtgatctgtgattttaataataaaggcagttgccaggcatgatggctcatgcctgtaatcccagcactttgggaggccgaggcaggtggatcacttgaggccaggagatcgagaccagcctggccaacatggtgaaaccctgtctctactaaaaatacaaaaattagctgggtgtgttggtgcatgcctgtaattccagctactcaggaggctgagacacaagaattgcttgaacccaggaggtggaggttgtagtgagctgagatcgtgccactgcatgccagcctgggcgacagagcaagaccctgtcaaaaataataataataataaaggcaattgttctagtgatgttaagtgagcttaatgtatcactgcagatgctgaacttatatgataggtgaaatagaaagggtgaatttaaaacagaactttttatctcattctttctttctgttctttttaataaaaggaaggattacggccaggagatacaaccagcactttctgtggtactcctaattacattgctcctgaaattttaagaggagaagattatggtaataaataaattggtggtattattttagctattgctagatgggtggtaaaatgtggtaccaattgcattacagtacactaatgcattttgacgtgatcttattaatataaggattcttgatcctgttaaaaactacatggagagtcccagactttgaaatcgagacagtgggaccttggcagtatttgggggtaccaagctgaataatattttattagtggcaaacactaaacagtagcaggcactattctaagcagtttacatatattaactaagttaatcctcttaacaaccctgtgaggtaagtactattaattctccttttacagttgaagaaactgacatacggaaagtttaaataactcgcctaaggtcaaggattcagaacagcacccatgtgactccagagtcatgaacccctggaaaatttttcagatttcctgggatatttgccccaggaatctgaaagatggtggaaagattaactgtatctcaggcacccgaagatacacttatcttgagaaaacatttgactttttgggttttggccctctgccttcagcagatataaaggacaatgtggtacttgtgagagctgctcaaagtctgaatccactgtccttcactggtctttatcagctagcaaaagatcaagtttaagaccaaggaggcaggagaatggcgtgaacccgggaggcggagcttgcagtgaaccgagattgtgccactgcactccagcctgggcgacagagtgaaactctgtctcaaaaaaaaaaaaaaagcccctgtccacacctccagcagttgccaacatatagccgggcgcggtggctcacacctgtaatcccagcactttgggaggccgaggcaggcggatcacgaggtcaggaaatcgagaccattctggctaacatggtgaaaccctgtctctactgaaaacacaaaaaattagccgggcgtgttcacaggtgcctgtagtctcagctactcgggaggccgaggcaggagaatggcgtgaacccgggaggtggagcttgcagtgagccgagattgcaccactgcactccagcctgggcgacagagtgagaccccatctcaaaaaaaaaaaaaaaaagaccaaggagattactctgaaatacaatttaattatatcctcaacacacaatattagatattgggcatgagtctgaaagtagaaatacatggagaaagaaagtttttttttctcataattttatttttaaaattatcttttaggtacctacccttgttgataaatgaagcatttctataatcttcagtgcctaccatgatagttggaatgcatttagagtttactttttcattgtttctttttcctttatgtgataaaatttccagttactaactttcaagaatgcaaagtgtataatttattgctttaaaatttctttctgaaggtttcagtgttgactggtgggctcttggagtgctcatgtttgagatgatggcaggaaggtctccatttgatattgttgggagctccgataaccctgaccagaacacagaggattatctcttccaaggtaatttggagtattttacagagattctctgagaaaaacctattctagagtacaaatgagagtgattcaggttactactttgagtaagaaaaatgagcataatctggaaaatataatcctgactggtggtattaggttttgttgttgtttttgtttgtttttgagacaaggtctcactcttttgcccaggctggagtgcaggggcgcaatctcggctccatgcaacctccacctccctggttcaagcaattcttctgcctcagcctcccgagtaactgggattacaggcacactcccgagtaactgggattacaggcacacaccactatgcccggctaaattttgtatttttagtagagacagggtctcaccatgttggccaggctggtcttgaactcctgacttcaagtgatctgcccacctcagcctccccagcatgctgagattacaggcatgagccactgcacctggcctctgtgtattaggttttgatgttttttaatacattctttcttttctatagtcttcactcctgttcacagttaccttctcatactcaaaatcataacaggggttatttagaattatccatcacaaacagattggagaaaggaatcctgtggctagagagataatctttacacagggaccctgaggctgagtgcataagttcaagaacagtatgaggggaaaatagagcaccaagatgatgagtgatcaaaagatggggaaaaaaggccccacatcagggaatatacagaattgacagaaacaagcagacaagtgcagggacctctagcacagaatccaaagaagtatgaaaactactataaaattctacatttaataattaaagccatcacaggatataaataggcatttcatgcccaaatggccatggaatatgtgaaaagacattcagtctcactagcaattaagggaatgcacattaaatgttaatgagttaccatttcatatcggtacatttgatcaaaatattaaagttgggtaataccagtgctggtgaggatgtggagcaactggaactcttctagactgctggtaggaatgaaaactgacacaacagctttaaagaataatttggcagtgtccaaaaaaattgcatattatatatgctaagcattttacaaatgttaactcatttaaacctcataacaatcctatgaagtatttttttattcctattttacagatgaggaaactgaggcataattaggtagtcaaagaataagacattcatgtaaatgataaatagtattcagattagaggctttctctgagaagatgggaaaagaaggggtttaggaaagtacaggaggcacttcagttatatatgtaatatcttattttttttcctggaatgccttaaatatcttataataaaaatttaaagattgcacccaggcatagtggctcacatctgtaatcccagcactttgggaggccgagatgggcggatcacttgaggttaggagtttgagaccagcctggccaacatggcaaaaccccgtctctactaaaaataaaaaaaaattagctgggcgtcgtggcgggcacctgtaatcctaactactcaggaggctcaggcaggagaatcacttcagcctggaggcggaggttgcagtgagctgagatcgtgccactgcactccagtctgggcaagacagtgacactctgtctcaaaaaaaaaagaaaaaagaaatttaaagattgccaggtgcagtggttcacacctgtaatcccagcactttgggagtccaaggcaggaggattgcttgaacccaggagttcaagaccagcttgagcaatatggtgagacccttatctctacaaaaaaatttaaaattagccagccattgctgggcgcagtggctcacacctgtaatcccagcactttgggaggctgaggtgggcggatcacttaccttcatgaggtcaggagtttgagaccagcccggccagcatggtgaaaccccatctctaccaaaaacacaaaactcactgggcatagtggcacacgcctgtaatcccagctactcaggaggctgaagtggtagaagcacttgaacccgggaggcagaggttgcagtgagctgagatcgtgccactgtgctccagcctggatgacaaaacaagactccatctcaaaaaaaaaaaaaaaaaaaatttagccgagcgtgatggtggcgcctgtggtcccagctacttgggaggttgaggtggaaggattgcttaagcccgggaggtcaaagctgcagtgagctgtgattgcatcactgcactccaacctgggcaacagaacaagcccctttcaaaaaagaagaaaaaagattaaagccatgtaaaagttaaatataatactataatttttatctttctagttattttggaaaaacaaattcgcataccacgttctctgtctgtaaaagctgcaagtgttctgaagagttttcttaataaggtataaattgtgtataagaatattttgtgatttgtctctttctatatatatcaaactggtcagtagcggtttgggaaatgtaaaattccaaaacagtagagaatgtaactttttcagtttgacccagaatttgtctcttacccaaagagtaattgacagcattagatcctgagataagttagttgtcctttccattttggcaataaaatttactccccagctatatattacataatttttgtgtatgtgtaaataatatataccatattctcacataggggaagagttaatctttgggtttagccataattgtactttgaactctgtttccattttctctgtatcattatccatagaatctatttattaccatgtactttttgagcacgtgggccgcagtgctccctacaaattctcatgtcaaaaatgctataattaggtaagattcggaagaaatgaaatgctatctttggctcttaaaaatgtgaacatcattcaattgtttgttgctgttggtaggctagaggagttttaggatctaggagtgtggtcttggcaattataaattctactttaaataaatggtatgatagaaaagttgatgtacatttaccttctaaggtaaatagataagataatgagttttaataaaataagaaattgaagccttttaaaaaatgaacaatttatgtgaggaaagatttaaacttgaaacctaatttttcacatagtgaaaaatgaaggcaagaggtgttgatatgcaaaataaaataccttttatcagaaagaaaaatgggaacatattctcattcatagtgatgaataagccaagactttttataagttgcaggctcctcagtccagtgattcagataatggttgtatcattgtcttacacaggtggtggtttgttgctataattgggcatggggattttaaattaagctaaaaacaaacttctcatgaagtttggaggtttgcatgttttgactctcacactaggtcatgcaaagaaatggctgggtgctgtcaaatgattctgctgttctctttttcctcctgtttttctttagcaaggaattggtgatgattctctgttttaattacatgatgggtggagaaagtgccttgaggaatcacaagtttcaaataactcaatttgttctggagttgtactttctagaaataaaaggtagaccattccaacttcagaaataagagtatcatgtgagggcacacaacacagatcacaaagatgatttattttaaagcatgacattcacccaattcttgaaacatttctttcaccataggaccctaaggaacgattgggttgtcatcctcaaacaggatttgctgatattcagggacacccgttcttccgaaatgttgattgggatatggtatgtaaattttgattactcaactattaggtttcattattatcttgggccaattttttgttgttgttctgtttgtttttagacagagtcttgctctgtcaccgaggctggagtacaatggcacgatctcagctcactgcaacctccgcctcgcgagttcaagcagttctgtctctgcctccctagtagctggaattacagtcactcaccaccatgcccagctaatttttgtatttttagtagagatggggggggtttcacaatgtcggccaggctggtctcgaactcctgacctcaggtgatacacccacctcggcctcccaaagtgctgggattacagatgtgagccaccacacccggcctatctcgggccaaattttattgtcttagctaacatatcacagctttaaaaacttaaaaccactttctaaactgctttttagaaaacttttaaaacaaaaaaaaaattcaatttttttttaatttattattttttttctgagacggagtctcattctgtcacccaggctggagtgcagtagtgtgatctctgctcactgcaacctccacctcctgggttcaagcaattctgcctcagcttcctgagtagctgggattacaggcacacgccaccacgcccagctaatttttgtatttttagtagagacggggtttcatcatgttggccaggctggtcttgaactcttgacctcaagtgatccacccgcctcagcctcccaaagtgctgggattccaggggtgagccaccatgcccagccaaaaaattgaatattaatgtaataaagcaggttgtaatgttattaaggcccatatcaatgtttatacttgtttttatttttttaggagaaacagtctcagtccgttgcccaggctgtagtgtagctcacgacagccttgattgaactcctgggcttaagagatcctcctgtgtaacctcccaagtagctgggactacaggcataagccatggtacccagctaattttcaattttttttttttttttttttgagatggtgtcttgctctgtctcccaggctggagtgtagtggcacaatctcagctcactgcaaccttcgccacctgggttcaagcgatttctcctgtctcagcctccagagtagctgggattacaggtgtgtgccaccacacctggctaatttcggtatttttagtagagacggggtttagctatgttggccaggctggtcttgaatccctgacctcaggtgatctgcgcaccttggcctcccaaagtgatgggattacaggcgtgagccactgcacccagccaatttttaatttttttatagagatgggatcttgctatgttgtctgggctggtcttgaactcctggcctcaagtgatcctcccatctcaacctaccaagcggttgggattacaggcgtgagccgccatgcccagctcatatttgtaaattatgttcatcattgctaatatcattgaaccatgcttcaggactcactttaataaggtaaacaatgagtgcagaggagaactgtagaggtggagtttttctaagaatacagacttgagctgtcatccagtatgtcttttcagatggagcaaaaacaggtggtacctccctttaaaccaaatatttctggggaatttggtttggacaactttgattctcagtttactaatgaacctgtccagctcactccagatgacgagtaagtaattctgtacactgaaatttttttttaagttctttggaaatcccatttttagtgactatgcaatgtttcattatcagattatactataatttttttattttctattttatttcattttattttattttgagatggagtctcgctctgttgcccaggctggagtgcagtggtgcaatctcggctcactgcaacctctgcctcccaggttcaaatgattctcctgcctcagataccctgagtagctggtactacaggcgcgtgccgccacgcccagctaatttttgtatttttagtaaggacagagtttgccatgttggccaggctgatcttgaactccagacctcaggtgatccacccaccttggcctcttaaagtgctgggattacaggcgtgagccactgtgcccggcctatactataatttatacaaccattcagttactggtatttgtatctactgtaccattataagttttaatagtaactgtcattttctcctttgctttatagtgcattatcttattttcacaacaactttgtaatctagttactgtcatcttcgttttacagatgaggaaaccaaggctcagagaggttaagcaaagttacacagctatcaggtggcagagtcaggattcaaacccaaatctgactgactaaggcctgtgctctttctaccacgctgcactgtttcccatttgacaaggactgtctttgagttcctgagtattgccttaagatagattcctagaaagagaattaggtcagagggtattaacattttaaagctcttgtattgccaaattgctttttttaagaaattacattgagttattaaatccagccatcagtgatctggtatattttttgtgcttatacttcatcttttaaacatgtagtttggaataattgggagatattttgattatttacctgttgttacagattcattctctctaatctcagggaggcccttattgtttggcagtcatttcacttctatctcatttcttaccacatttctcccagcacctgctccaaacagtctcttcatttcagaagccttcagttctactcctttttccatcactgttaatggattaaccttgtcttaatttgatgcaaggactgataacctctctgacgtgaccttgcctcctttgcagctgtccccagaccaccttgcatctcagaattgctttctaactcttttcatcattttcttattccctactcttggaagactctcctttacaaggggtgtccctgctattttcctagacctgtttccttagttttctccaagatttcattttgtcagttatctttttattagaccttctttatttttttctagcttgtttccctctgtgtaagcatgctcagatactctgatttttccccctaactcatggcccctctttgaacaaccacgtttttcctcattttcatttcatcttaaagcctcaaaaaaaaaaaagttaatagatgttcatggtcaaagaaaaataaatacacagcacctctaatcaaacttcttcagactagtcaacattgattgtcttgaattttttttttttttttttttactgtcaacacttcaaccccttacaatcgaacctgtcctccagcttttgaaggttgaatcaatttcttaatttctaaattgtaaagcattttggggtcagtcctcctctcccttgattaatgtaaagcatttggtactcatggctttgccttgggtagcactgcctattctggttctgtttcatctctgtgactactttcctctcatgtgttttccctgtccccttgagaccaggatgctccatggttctgttcatgacagccttctttttgctatatgcagtttgtaccttggagatttcagccagccctgtagcatagataccagctaattaaatggctctcagttaaatggcaaatggttattgagcaaaaggtgttatggtaaatactagacattcaaagacaatcaagacagtctgatctccccaaaagcgtgctgtctactggaggagaaagatgtgtaccaagtcattatttctgacagcattgtgtattagaaggaacactggatttaatcaaaagataggagtttgaatcccgatgccacctcttaccaactgggtaaccttggataggaattgcataacttctctgagcctgttctcaaattgcctacctcataaggttgctgtgaagaataaatgcatgatggtttctgaagcacttatcccctgccgttagatctcctgagctgcatttctgtttaacacggcccccagtttgtcagccaagcagctcaaatatatgaagtctaaaatgaaagtaatgaccctttatgatctctttctattgttctcaatcagttcctttttttttagttacctaattctgctcacggtgtgtccctgttgttcagattccagatgtcagtgattgtggactcctcctttttcttaacagattacataatacctgcagctgccaagtctttgtctgtgttttcattatttcatcatttacatcagatctttcttttctcttcccgttgacacaccctagttcaggcctcattcaagtcatacccagagtattgtatcagcctcctaattgatctttactccttcactttgcaacctattctgtatgccttgtgaagtaccactccaattcttgaacccctttaattagaaaccttcagtaactccttcattgcctatcaggtaacatctatcctcttggctagcatttaaggcctccccacatctgctccagcctgactttctagcgatacctctcaccataatacaaacagtgttctgatcagtcttagctactcaccattccctagtagtattattgtctctgcttctgcctgttcattcctgtgtatcccgccttcatttttacctattgaaattttcccatctttcagagccacctcagatgcaaccagatctttgatggatcaaggtgaaactccttagtgtaaacatcactggcctctttgatttagccattatttttcttcagcatcatctaacacacttctattcctgtgctccaccctaattacttgcatttcccaagacctaccacagtctttcatcattccattcattaagtgtttgcagaatgaatactgccttccttgatttctccaactagaagtcacacctttctttagaaccatggttagaacaggacttagcttattgtgtataaaatttaacaagtactgctttctcttccagtaggaattacctcccttccttgaaggaagggactgtatcctctgtaactttgtgcttcttagtatggcataatacatttatgtattaaatatttgatagcactactcactgtatattaaagtagaagcccagtgtaacaaaatgccaacctctcccctctctgtgacccatgatctccctgcggtgttctctcctcattccaggtctctcagtgtacttgttcctattgccttttccttttggctaacttcttctgggctacactatctaacatctggctgttgaggtgactactaaattgaatgctaattcaaacctggatgttcacctgtaactaggaatgttgttctggtcaaaagttaagattaactggaatggtgacaactggtgtcttttttattcgcagtcctcagttttgaactcctttttggctctaaacttgcttgtgggattatcggggttttttaaattttcagtactccattcttgattcgtctagaaaatctgggggattaatctaaaaatttatagatttcctttcagtacaattagcctaattacttgatttttaatcttattttaccatttaaaggttgaagaaatcttgattatgatgaaaataaatttatttttctttcaacagtgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaa

SEQ ID NO: 17548 - DNA, 19368 bp, Human
agttctgcatatatattactaggttggtataaaagtaatcgtggtttttgccgttatgtttaatactttgcaccaacctaatagctcacagaataaaaaaaaaagtctatgaggtaggtacagttttcatccttattttacaaatgagaaaaggaggccaagaatgataaagtaacttggtctcacagccagaaagtgatggagccaagatttgaacttgggcagttggactgtgttcttagtcactgtgcttcctgggtgattactgtgacccttgtacttgacactctgctatcaattacaagagccatttctgtgtgtgcacttgatttccttggggtctccagggaaatgtaattgtctcctcaagtccaggctttcctagaagacatggtgattgcactgataaccagcattagggctggctttgggaaagctcagtacctatgatttatggttagtatcttagattttagaacgctgagcaggaagtttttgtgctttctgaaatcctcacacctttaagtctcatgattggtgaggaggcagtggtccaagggaatggatagaaggagataataagataagccaaatgtttcaaagggagtgaaaactgttgaatgtaaatgcagctcaaggaagacttccctatctgaataaaaaggtgcaaataatgcggcctatttgtatgcatggtggcttaatgatgttgatggtgatgatgatagctttacactatcagagcgctcattctgggctaggcagttttctcagtggggtacagatattaatttatttacagtgagccagagaagtctgctgtagcttttaatgcgtctaaaatgggacacatgaaccccttaggaattttcagactgatcaggacagtttcctagaaacagttcgtgaaagggatgagatgggcccatggtatctaccccttcctagctgcgtgaacttgggcaactcaaccttcttgtgctgtttctctatggctagtgcgtgtaatttgttgttgttgttgttgtttgcttttgagacgttgtctcactcagttgcccaggctggagtgcagtggcacgatcttggcgcactgcaacctccttcaagttattctcctgcctcagcctcccaagcagctggggttacaggcatgcgccaccatgcccggctcatttttgtattttctgtagagatggagtttcaccatgttggtcaggctggtctcgaactcctgaccttaggtgatccgcccaccttggcctcccaaagttctgggattacaggtgtgagccaccactcccggcctagtatgtgtcattgacaattgttcctacctcaaaggctgttatgaggattaaatgagctaatgcatgtaaaatgcatctgcataatatataacacagctcgataaatgtgagttgctattgttgattattatggccacgtttgccgctgatgatgttcaaccactgaaaagcatcgttttctttcttctagtaactgtgtgtactgaatgcctcgcgtttgtccctactgcacttttcagtctgtcacaatcctgggtcgtcgggggactgtaccgagcgcccttggagtgctcgcagcagggaagaaggagcgagcagggaggagctgaggagggtcggagcggaatggacacccagagactgagatgagagaggggctataagaagagaaaccagtcgcaggaaaacagaactctcgacaaacgcacgccctctttgcgctctccgtttctctggacctggatggaattgttttactttgcatcgccggactgcgctgcggacggggtggggcggcccaatggcccccctggggttactctgctccccttcacgcttccctcccggccccgccccgcgattggccggcgcgccccggggctgccgccgattggtgctcgccggccggagccgcggggcttaaagagggggcgggggcgcgctgcccagcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggtaaggacccgagcttggcggcggctcccaaatccttatcctctgggtagagagcgggatattagacggcgtcacagagacattttgggggcttgaagacctttgggtacgtttttgacatccctagtcccaccttgttgtaaaagaattaggcagccccgaacttaacttctctaggccgcagtattcttatctggaatttgagataatagtggcaatgtggccggtggtaacactggccgggtccctttgagaatgaacaaaccggaacacctaataggaactgagtccgtgttaattactgcggtcccagcccgcatccttccaccgtccgcttcccgaagtgcttcccgctcccgcccggcctcccccggggcgccgagccttcgcgttaggttccgcccgcagaggtgagaaggagcgtgtaacacaagctgacaggagaatcgaaccggctcaggctgagtttctcggtcctcatgggatgggcgaagcgcccccggccaggttagagccctcctagctccgtccgcgcagccgctgagcaattcacgtccagggctctctgggctgcctggtttgggaaatgtcacgttgattcccgcacgtgcccagggccatctccgctgcccccgctacccccgcccctgctgtgggcgcgtcagactgcggggctgcggtgacgccggctcccgctccgcgccgctgggttggatagggacgagcgggcgctcctcggagggcggactccactggggagatacggagcgcgccgccgagggtcgctcgccgccacccctccagcgtgtctcagattgggaaggggaggtaaaaattgacagcctagcgccggccaggggccacattttcacatgtgtcctgtggaaacattttgggcgacagcctcaattcagatttaaaccaatgggttgggcaatggcgaggtcgcgggcacccccttggttttctgctggaatctctgctctacccccaaggcatgtccctacaaggtgggcttctgtcccccagccttcgtggattgtgctcacttaaaggattttcccggtttcctcaagatggggagaaacctgtccctgaagccgccagtcagataagactgtgctcgccccttaagcctcctccaagcacgccctatttccggtcctcgcagtcggaatctgaatccctcctttctccttgctgcctagtacttggctcttatcctcacaaaggcacattttatcttgttttttgttgattgttcgtgagtgaagttctcccactacgttttaaattccttgaagatagagatggcgtcctgttattctctttgcttcctcttctggacctggcatggcctctggcacacaatagctgcgggcagtgcttgcctggtttgccttacgctatcctttccttcattttgaactttcagaaggccagaggtcaacgaacgcagatctagactcagctttggctaatgctggtgttggcagacccgggccagcctccggcatccaggactcacaatctgggtgaggggggacaaattgctagcctcagtgaaccacggttgtcttcttttaaaagttaaaatcagatcaaccacccatctttcacgattatttgaggattaaatgagataagaaatgtaatctcctttgagatagtagatgcttcatgaatggtacctatagtattttattaaaagctgggcatggtatttgtagggatctttgaagcataaaattaactttgttttcttctcctgaaattaactttactgagcattcagtgccaagtggtttgttttcagagaacaaaggctgtcctccagaggggagtgcatactctgggggtggggggggggtggggggcggcgctagtccttcctgccttccccctccctcatactttgggtggaggcaggaacagtcctctgtccctatcttttggtgtccggacatggccttggcactgtagcatgtggacagccagtgccatggatttcagaacctgcattgccagttgactgcctgctttgtgtgagtactggctctctacaagccgcagaggcggacggctgggtcaggggatgggcctcagacttcctggagctcctttctggagatcttcaagtcagtagacacttgactgattatctttaattctgaaggagctgagatgggcagtgctggaagagggcccttgtgaagtccgaattctggcaaaacgttccttgctaagagacagcgttgaagttaggcctttttgcacgtgagggtcgtggtgtgtgaggcagatgtcggctagattcctggctttgctatgaactctgcctcacccaggccactagtactagttccttctgagcaaaaaagggagggtaataaatgtgaccccccccaccttttttaagaggagggagagttttaatgagaaacattacatttgaaagtgaaacaaatttgtctgtgaaattctcccagtatcttgtcagatttattctaaataaatgtgacacatattgtaatctgtttcttaatacagtttttacttggcattttacttgacaggataaagttcatgtagttttgctctactcttctatttttcagttctcttattccttgattcgcaattgtttccatgatctgttgtgggcactgtgttaactccgtgaataccaaggcaggtgtctgccctccaggaaccctgagggctggagagatgccttttaagcaatgatggacagttggggaaggatgcccagggcactgtgggtgaggcaggagatggggtccaacaatttaggggcaggatccatgaggacagcagcctctggggagacagcaaagagaggaagcctgagtcttagtttagtctgggttagggccacagccaatgtgaatgaaagcacatggttaggagaaaatcacctaggacacctgaagatgaaagcgctgcactgagacagacaaagaacaccaatgataacaactaaccttttttgaggatttggtataggcactgttttaagcactaaataaattaactaatgtaatcttcagtagaattctattacagagatgtaggtactattatattattatcaatactttgtttgtttatttatttatttattttgagaaagagtctcgctctgtcacctgggctggagtgcagtggctcgatctcagctcactgcaacctccccctctcaggttcaagcgattctgctgcctcagcctccccaagtagctgggactacaggctcacaccaccacaccaggctaatttttgtatttttagtagagatggggtttcgccctgttggccaggctgatcttgaactcctgacctcagaagatccacctgccttggcctcccaaagtgctgggattagaggtgtgagccaccatgcctggcctgttgttactttatagatgtggaaaataagacatcatggttaagtaacttgcccaaggtcacacaggtagagctatcaatagcagactggaaccaatagaggccctcacagaatgattcttgggagatttcagttttcatctgaactttctcagggggatgtaataatgtaaatggactcttggcccctccatcctggaagcttggccaagtggcctaaaccaggggtccccatttagtttctccagcccccttttttcttgctgagttgttttaaaagttaaaaagtgcttagtgaccttggacaacattagcaccttctaagtcctggaatccaccaagaaggaggaagggagatggtgctgaattcccctaaggcagggctcaggaagcaagagaaccctgtggtctaacctttcccatctgctctcttgttcccaggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctgggtaagacagctttctcagtggtaccctacctatgagggagcctgatgaatctcagatcttgtggttgctgccttctcaagttcaagagaaatgtgaaaggaagccaagtgaagccagtgggggatggactcccacaatctgtatccctttgtattttatgggcagtttacacagagggctaagtaatgtctctgggagtcactgaccatgaagataagtttaaaaagagaaagaggattttgaaggtaggaaatacctaagggaaagacctgaaagatggaagccttctcagtcttcacagtggaatcctttttgaacacctatgcccaggtcccacagcagatcaattgaatcagaattttctgggcatcaggccaggcaaagatattttttgaaagcttcccaggtgatgcttatgtgcaggcaagactgagcagctcagttaataaagaaggaggccgaggtgggcggatcacctgaggttggaagttcaagaccagcctggccaacatggtgaaaccccatctctactaaaaatacaaaaattagccaggtatggtggtgcatgcctgtaatcccagctactcggggcgggggttgctaaggcaggagaatgatttgaacccaggaggcagaggttgcggtgagctgagatcacgctactgcgttccatcctgggtgacagagtgcaactccaaaaaaaaaaaaaaagaaaaagaaaaagaaaaaagaaagaaagaaaaaagtaaagaagagggcaagagaaaagtcaggagttgagggtggttagaccaccaggtgatggctccgtcctttaactcagtaagccttccttgagcatgtgggccagacaccatggtaggtactggggacactggggaaaataggccgtctttgctttgagtgtacttggaaacctcaatagaatatggtatgtgctcatgtagaaaaggtatatagtctgtgcatacacataggaaggcacctaacccagactggatgagtttccagagtggaagaacccagcagtaagctctgagacttgaagaggaggtgggctggtcatgaattgaggggagggacagtccagggacaggaaatggcatgtgctcatttggttttgctgattatacctgcacataaagggcttcatttaacaacctatggagggtccttctagctctcttctcgtcagtgatttaatttctctccgtttttttccctcagatgctagtttcattagcacattctaaatcctaatagacaatatgaattttaagaacaactcttgttgcaaagtgcgcatatcagtgacaacaaattagtctggtaatgggttagatataaaatcaccttcttctgaaacaaggaattcatacccccagattggcatatcagatgatgaatttgaggggtaaggataaggggtcagggttctgtgtgggttgatgccacttggtgggtacctcccatctggaggcctcacactcataatgacaccagtaaggtgaggggacatgagaggtggggcaccattttccaggattgcaaagggacggaggtttgcaggttcttgtgaagccacaagggtgtgtgtgtgtgtgtgtgtgtgtgtgcgcgtgtgtgtgtgttaacaggagtgaaaaggccactaatttccagagaaaaatctgaatgtggaaattttggttccagccacaaagaatttgtgtgccagcgtcacacggaacacatatcagcatccggtgctttatctgactcacaggggctccctcttgcagtgctctatggaggtcaggtctattgtctgactccctttccaacaggaaagtgaaagctccacaagtaaacttggtttgcagaatccaggtgaaacccttctcctagacacttgctgtttgttactttcctcacattctcacagaagccccggaaggttctcttgggctctgaggatggcagagccaaaaggtgggtctgttgtgttgagtgctcatgtttagaaattctggccttccatatgaatgtcacaggtatccacaagtgagagaacacactaaaacaaacatacaaaccctggaaaatagagggataaaagcaaagtatacgtagtttaaacaaccctaaaaacaacagaattgtttagttgaataatcagggatattgaaggaaaaagcaaccggtggtttgaaacttcctagctgaatttgtttttctttatcttctaaaagtgtgttgatatagataggcagcatcacagaggaagaaagcaaggtggggctggggagtgggtgagtgcctcagtccctgtttgcctgtctggagtgaaactatgggggaagcaggacatggagggacctgaccccacccaaggaggctgcccatttccggacactcaccagagtcccctcattgcccttttacggccttgcatttccgatattgtctgcctgctttgctcctatccggatttgtttctcagtggatcaccactgcctttgggctggatgttgttttgaccggaacgagctagctctggaaatgtaaagctcattgtctcaagcatggcacctgctgatctcctctaggtcttctcaccacggagccccaagtgccttgtttcccctgttggcagtggtgggaggagcatggggactgaaggctccctttgtgttgctctggactgtttctgtcactcccccagagaagccagcgctaggcctgtgcaaggtcctcagggtcactgaatggggctgaacaaacacacctcattcgaccaaagaagatgaggcacctcctgggtttcgggggcctgggaactggacacagtgtcacagctagtcctggtatgggaactgtgaacactgctaattgaaatcagtttttcctgaccctgaaaatctgtaattatttttgtgaaagcttaaaaaaattatgtctgttgtacaactttatcttctcagcagttacgtttgatggtgtgaggatttggttcctgctgtggaggaagaaataggagccagttgcttctaaagccagatgagtagtacaggagcagcaggctctcagatctgtggtggatttgaggctaatctgtttgtggcttttcaagagtccctgccaaggcaggaggtgcctgtgccctgaattgtgtgatcttatcagctggagtcagatccaactgtgctgaatctggaacctactactttctagctgtgtgaactggggcagttccttaatgtctctggtcccttccataaaatgggaacaataacgcctgcttctcaggttagtaaaaacagtgaaatgatgtgtgaaaattatttagcataggatctggcacatggtaagtgctcaataaatggttgctattattattgttattgttggttagctggttaaaagaatacccagagagcagctgggtattcttccaatcatgtcaatttccttctttttatttttattttttgagacggacctttgctctgtcgcccaggctagagtgcagtggcgcaatcttggctcactgcaacctctgccacctgggttcaagcgattctcctgcctcaggctcccgactagctgggattactggcatgtgccaccatgcccggctaatttttgtattttttgtagagatggggtttcaccatattgggcaggctggtctcgaactcctgagccgtgagccaccgtgcctggccaagaaggtctttaagaacgtttttattttggaaaatatcagacctatataaaagtagaggaatagtataataaacccctgtgaacccaacctcctcaacagtgatcaactcatggctgtaatatatgcttcatctttccacttctccatttcttccagtcttcagatttttaaaaggaaatcttagatagcatatcaagaaagatttttttcgctattactaatgtaagaagtcagaataatttaaatgattttaatgaaaattttgctttgtgctagaaatgatgcttttaaaagttctttcagggctggacgtggtggctcacacctgtaatcacagcactttgggaggctgaggtgggtggatcacctgaggttgggagttcgaaaccagcctgaccaacatggagaaaccctgtctctacttaaaatataaaattagcagggcatggtggcacacgcctgtaatccctgctacttgggaggctgaggcaggagaatcacttgaacccaggaggcagaggttgtggtgagccgagatcgcaccattgcactccagcctgggcaacgagagcaaaaatccatctcaaaaaaacaaaaaacaaaaaaaccaaccaaaactacaaaaattagccaggtgtggcaggtgcctgtaatcccagctacgcaggaggctgaggcacgaggattgcttgaacccatgtggcagagtttgcagtgagctgagatcatgccactgcactccagcctgggcgacagagtgagactgtctcaaaaaaaaaaaaaaaaaagaaaaagtcctttcagtgggaagtgacaaagcttgaaaaaaggttcactggggccaggcatggtggttcacgcctgtaatctagcactttggaaggcagacgcgggcagattgcttgagcccaggagttcgaaaccagcctggccaacatggcaaaaccccatccctactaaaaatacaaaagttaggccagcctggtggtgtgcacctgtgattccagctacttgggaggctgaggattgatgctcgggagaatgagtctgcagtgagtcgagattgcaccactgccctccagcctgggtgacagatatcctatcaaaaaaaaaaaaaaaaagatttattggaaggaggaagaaatgtcagtgtctactgatcttgtctttctctgcctctttgtctgtctgtctgtctctctttctctcagttgttacctccaacgtcaaacatacctgtattgattttatttaacttcatgtttatttaactccatgtgttaccatgtgtcatctcatctttaaagagattaaaagccacacttacatttcattgctttaaaatggacttctcaaatattttctgtttggtcacatcaccatcattcttagtttttaacaaggcatatcttatcaattaaagaatgtattgtgttgcattatttgaaacttgttctcaaaaggggcaaacaattttattctttgaagagcaaggaattctgcttatgagaggaccaggtttagatatatctgtctttacatagtgaagctttcttttcccttccctttctctcccttctcttcccccttctcctccttctcatttttagctaagaatatacctcagttttactttctgttttccaacaacaaatggtaccccccaccaccttgtgtagttagctgttgcatcttctgaaggtaaaaaaggagaaaaactgaaaaatctgagtgctaaaattactctgtcttgtttttagagacttaatttaaaaataaactctgatgatataaaaagaaaaagaacaaaaattccctttgtctgtcttcaattttcttgaccttacaggtaactgactttctagaaaaacactttctttatttttcccaaataacagagagaaccattccaaactcatctttttgggtttgcgaataaaattaaaactatcaggccttctgtgtctttaagaaaggcaattatttttggccagttatattactatttcacatttttaaaagttaagtaatgatttgtcttgaatttttaactttactggtcaaaacatatctctttctctcttgaaaccattgctgaaattgagtaaattctccttttttagtttttaaacatttctcattttgggttcaattgaaggtcactgttttcagtgagcctctcatttcctttcatgttgtgtggcagtctgtcattttttagtggttttgatgtggttcatctttgagagccacaggaattccacccagggttcatttgtctcctaggaagtaaagagcctgctggcactcatttgccttgttttgtgtgaattgtaagagaaggaaatctttaatgaggtcagtgatgagcttgcgactttaagtgtgttaaagtcacaataagattttatgactttgggtgtcagttttggtatgtatgaagtaaaatgtagaattgaaatgagactacttctcatctatccatccattcgttcccccgttcactcatccattcctatggaggttcattgtatgaaatatttagacctttttctgatttttccctttttctaatgatttatattggaataaaacctaacaaaatccctaaaatactcaaaaccaagactgatggttacttttgggatattgagtctgttatttccctgtgtgaagataatcttgttttatgatttgcttaagggaacaatgaaatgaatttagaggcagtttcttgtcttattctataaaatctcagtgtgaaagttaggttaacaatagatgtggggaatgctttcctgcatgtgtgtgcacatgtgctgtatgtgtaaatacaaagtatagttgaaaaatataaaacttgatttgaaccctgagttgttttgaaaccagttaattgtttataggaaagatcggttagattgaaccatatcagttgtttgggaattagaacttttttctctacagaattcagcttttcactccccttctttttcctctaaacaagcctgggtgtttggaagcctttgctaggttgctgttttttgcccacagcagaacgaatgcccacttttgaggtttagggctgtgtaagtagattgtgtattgctacggaaaatctacagtagttctctctggctgaaacactccagaagaggattttagtcccttttgctgacagagaaaaaggtttttctctgtgtcttgctgaaagtagagactctgataatagccaagcaattctccaagagtgcctgatttggagttcacgccagagaagagaaagaaaaagactttcccctgcatctgaggtttccaaagtcctgagctagaaagggaggtttcacgtacacactgcttttcttgaacattctagtcacagaaggaaaatacatcttctcatggtatctcatatgaaaatattacagaagctggcatgactgtgcttactttttaagaaaaaggaagcattagcatatggatagattttagcttcttctttttctctttttttttttttgacacagaatcttgctttgttgcccaggctggagtgcagtggcaagatctccgctcactgcatgcaacctctgccttctgggttcaagcaattctccctgcctcagcctcctgagtagctgggattacagtcacccaccatccatgcctggctaatttttgtatttttttgtagagatggggttttgccatgttggccaggctgatcttgaactcctgacctcaggtgattcgcccaccttggcctcccaaagtgctgggattaaaggtgtgagccaccatgcctggccaattttagcttcttagataatctataaataattaatggagtgaatttgggctgttagaaagccaatctgggcaattcatagcttttcaaattaactctcttccttctgatttcctcttgagatctattctttttaaggatagaaatcatatcttcctacatatatctatacccagcttgtgggggtgggcttaatctattgtcaataaaaatctatgttacaagcaacacaaatgcgatgagattgtttaaaaggtctttcaaaatgggtaagaccaatcttttttccatttagaactaatatacaaggctgttagatttgattgcttatgttaagttatatttcttctctgtgggcatagagagtaagttagaaaatcacttactatgagtagaaatcagaaaaaagcttgctgagttgaaagtgataacggtacccctggtggcaaacatcagactggcagtgcagtatctgtcttgaatttgttgatggaaacctcattgttattattattgttattattatttttctgtctgccaactttaatgtgccatctcaacttaaagaggtttggagttactttgtttagagctgtgttgttcggtacagtagccactagctacatgtggccatttaaattaaaattaatgaaaattcaaaattcagttcttcatctcactagcctcatggcaaatgatcaatggtcccacataacttgtggccactccatttgacagtgctggtctagagatttgaaaaaagtaaaaaaaagtctttatagcctcttgcctgcccatgttttgttactttgcttataaagaggtgaaaaactacatgatatataagctatttcttattttactctataaaatcaaaaccaaaatgaagattagattgattggtgcaagaccataagtaaagttctaccattttgacccttgaatgggtgagtttttctactccaaggactgttcatttgtgtgttgggattttgtgattgtgaacagtgtaataaaaacttgaacctttatctggtactccgttttcatctagcaacattcaccacagcaagagaaatttcataccttctccagatctttgtaatgtgaattgaccaaactgagaaaatagagtggaaaattgaggtggctgccatcttgtttctcatatttgaatagctcagatcattcagccattcaactggtctacattgagcacatactatttgccttgtaccaaggtagacataggtaagacatggaccctaccttcaaagaactcagagcttagaatgatgcatagacatgtaaaggggtaattataatacaattaagtaagaatactaattttagaattataactgtagatatgaagtgttgatatacaagtaaatacaaataaatattttttggacttaaatggtttatttctaggtttttacactggaattgttttgtctctgttacctgctgaaaaaaataaggacccagcagtctacttcttctacagatgccaactgctacatattggttcagtgttgagggagcagaactgtgtgtatggagctttttggagctggttggaagccacaagtgtgtgtatgtggagtgagtgggcctgcccaagtgcttggtgtgtgatggttgcgcccagtcaccgcctctccatgtctctccagctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaactggccttcaatcttctgttgtatccagaggtatcattattgatttaaaaaaatctcattaatctctactggtaatttatagggaatctgatcagtgattcaagaacaagtaattctgcattgccttgaataattaaaaagttatattttattcacggtattgcagtggtaatttgtggtcatgaaagcataacctcagtgctctctaggtttcttaagtggggtgactttatggcatctttaatcatcgatcaatgggcagcaatcagaaacaaagttctcagcattatgcagttaatgtccttcatctacttctaacacttagtaaaggaattgattggctaggtataaaaagagaattaacgaaacctattttattggatctttaagtaataatatctaaatacatttcgttcaaacatacatatgtagctgtttggacattttggacaaagacacattgagttgatttttatttgtttttctgttccagaaacttcatcaagttacgggcctggtctaagaaaacacattgcaatctattttggcagacttctttcaaataaaatactaatttcattagctgatagtatagtaattggcaaacatttcctctttggaaataccaatttgggctagccattttgcagaaatttgtgtagttttgattataacctgttggagagcatttctaaattacttatacataaaagataatcttttttttgtttgtttttttgagaagaagtctcggtctgttgcccaggctggagagcagtggtgcgatctcggctctctgcaacctccgccccttgggttcaagcgattcttgtgcctcagcctcccaagtagctgggactacaggtatgtgccaccacacctggctaatttttgtatttttagtggagacagggttttgccatgttggccggggtggtctggaactcctggcttcaagtgatcctcctgcatcagccttccgaagtgttggaattataggcgtgagccaccgtgcctggccatagaagacaatttttatgttaactaaaatatttgcttagctattataatatagcttttgtaaggataaaagtcatgtgactacattggaggactctccctacctcattaaaagttgtcaaggtataacgattatgaaccagaagggagcaaaaagcgtttgagggagtggacgaggaggcttcagaccccatgatccctttcctcacaaccaccagcttgtgtcagaagtgtcattaagtgggtctcctctcttatggatgtattgactcgcctgctccttccctgagctgctgcttgttttctctcataagggggctgctgcatgagctccacttttcccttccgtgtaagaagagagactcccaaatcgctcctagctgaccattccctgactaatgagggaatcccaatttggaggtcataactctagtgttaggtttagtatcagtttgatggaggagaggttgatgtgcctctagaacagtactgtccactaggaatacgatgtgagctgtttaaaattttccagtagccacatttcaaaagctaaaaataaacaagtgaaattaatttattttatttgatccagtacatccaaaatattatcatttcaatatgtaatcaattgatgagatatttcacgcccttgtttttgtattgtctttggaagagcgtgtattttacacttgcagcacatttccatttacaccagccacatttcaagtgttcagtagccacatgtggctggaggcttttggattggacagcacaactgtggaacaacaggttctgtctcagtaaccatcgagaggatcagtcttgattatcttatctgctgtcattagagtcccctgagaacttggcaattacaatttattgaagaattttaataaatcttcacctaggtgaagacaatgacctccaatcacgtgtaaaatggcaggcttaaagtactctgcgtaagtaacatggcaaagggaatttacgctgttgagacctgtatgtgttaggaacgtcatacatttaatcctccccatggtccccattttatagatgaggaaaatagtatgtggagagtttaagttgtcaagatcatatagccactatataaacaaaaagggatttaagactat

SEQ ID NO: 17549 - DNA, 24345 bp, Human
cctatgcctgtcattactttaatctcttaatcctgtcagtcgagaaggatgtatatcgtctcaggacctgtaataattgcgttaagtacacaaattatacagcatgtgtgtttgagcaatatgaaatgtgggcaccctgaaaaaagaacaggataacagcaattgttcagggaataagagagataaccttaaactctgaccgccggtgagccaggcagaacagaaccatatttctcttctttcaaaagcaaatgggagaaatatcgctgaattccttttctcagcatggaacgtccctgagaaagagaatgcgcacctaggggtaggtctctaaactggccccccggggcgtacctgtctcttatggtcgagactgcagaggtgaaataaactccagtctcccatagcactcccaggcttattaggaagagaaaattcccacctaataaactttggtcagaccggttgatctcaaaaccctgtctcctgataagatgttatcaatgacaatggtgccaaaacttcattagcaattttaatttcaccttttgcatctccttgaaatgtctgcctttgcacactctccctgaaagaggagggcaagggagccaggatagaaagtgaggtggagaagtgtagagctctggacggacaagcaggagatacgcagcacaaggaagcacactaggtaacacaccaagcaggggaacctgtctttcactacataggcaagatgctacgggaaatgggctctgggtttacacagattatgactcagttctctactgttgtgaagctgtgtttggataaatccctcaacttttctgagtcttattttttcatttgtaaaatgtagatagaagacctactttcccacattgctctcaggtttaaagtacgtcaattaggatacagcaaagtctgtttgatactgaaaactttccagcaacaatgaaccttagaacaagtcatctctcatctttgctcttgcctgtaactactaagcgactactccatcttctgttcttagggattttaaattgttggcgtttttgatttagtcaggaatgcgttgtatggggatatcaaacctgcatgctctccaagcattgactgtagtctgatcttagtaggtcgtgcacatataattttactatttctcaatttatttcggtgctgatgtaattagtaaaatacgatttaagagtgttatgatactttttaaaaatcgtgatgtcttttcttcatcaaagagatacttaaaagcacataatcatcttgtggaggcaagttgacaaaatcctttttgagattctaaaaggaatctttgtacttaaaatgtttaaggaccactgatgtattttggcttcatgtatcaattagatttagattttattgttttagagatgggggtctccctttgtcgcccaggctggagttgagctcacctcagcctcaaacgcctgggctcaaactatccttctgcctcagcctcctgagttgctgggactaccatggtgtgccaccaatttttatagagatgtgatctcgctgtgtttcccaggctggtcttgaactcctggtttcaagtgatcctcttgccttggcttcccaaagtgttgggattacaggcgtgagccaccgctcctggccccgatttattaatagatcttataaggacattttaggcctcacgcatcagtttcttaggacaagcttttctctgcactgcataataaatcagacggcagtgcaacaaaaaaacggtgatgatttcccgaagaacaaaccaagttcagaagcctccctaattgtcagaacagcaggtagcctgggcggagctctgaggctatccttaaacaggcgcactgagacgcaaggcgctggaaacaaaagagctcctccttgcgcccttccgccgccccacttagtcctgctccgccccggacaccccgcggccccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccaggtgagccgggtcctgcgccccgtgccctgcgccccgcgccagcatcctcctcgcgtgccctggggctgctccggaaggaaggggtggaggatgcggtcttcagcctggcacccgggagacgcggttcgcgggcgcctgctgatgctgcggctcctgcggtagggagggcggggcggacgcctagcgattgttacgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaaggcaaaagaactagcatgcctttttcaatggctgtcattttgcagggctggcttcagatgattgttatagctttaaataaaaaggacagttttcatctcggcccgtggcctacattatttctttactgtccattgccctgggcgcttgactaataatttaacagcagtttttttttttaaattttaaatcatgattcatagcattgctgtaagagtaattagaggtaaagtagggcttgaacctgtctgtagttggttacttactgagatcttaatataaaagtaaagggagagggtgaagttgtaagtagcactaagtggaatagaaattaaatgcactgaaactgccatgtccagttcggtaggcgctagccacctgtaactgttgagcacttgaagtgctggctagtcctaactgagatgtattgtgttaaatacactggattttgtcgttggagtaggaagaacagtgtaaaatatctgctcgataatattttatattgattacatatatgttaaaatgttactatttgggacatactgagttaagtttatttaaaattaatttcacctttttcttttaatggggctactagtatatttaaaattacatatgtggcttacatatatatttattggacagcactgttctagaagtttaggaagaaataagaaaaatattgagaacaggtagcggcagtaggaactttgccctcctataagactgattccaataaaaataataggttatagttttaattggctttttcctactagaaaaaataagtgtactttacatgcctctttgttctccctttttcccctccagtttagtggttagaatgtatttattatagcaggattaatacagggattcactaagcagcgttaagaagacttaggtaactgattccctgatgaccatacttgattttcaaagcactttcctaacccgttttaaattgatatagagtcaaaggcagatggcttattagtagtcatctcatttaaatcttatggaatttttccagtaaatctcaaataatttgttataggctatttgggctatttggtcaagtgcatggaagagacagcataggacatgtggtacttcatttccaaattgcttgagatgattttcattctaaccatatattatttggttctggttttccggaaaagccagctaaacctttggttcttttagatataaatgaaatatcatcaaagaatagctcaaagtgacttatgcaacttgaatgtatattttttccttagggtgtttatcccaaattatttgggcatttgctgcaattcgcagtttttttaaaaaaaacaccaaaatagttatttttcaagttagagatgttttaattaaaacatcttgtttttggtgtatccattgacattctcaaaacggaatgtatctggacctctgtgtacaatcttcgtagcactcagacactgaacagaaaggcagtcatcactgccaaacagggcccaaatgccacacatggtgcaatgtgtcattttgagctggcagcagccaaataaaacagccctttatttcacagttgagaatttgaaattggaaagtaattaacgtatgtaagggtgatttatttgcttccgggcttatagggatgagctaagttttttattagggatgttgttggtgtatatgtctcacctactttgcttccttactgaacaatgcaactttgagacagaaatatttgagaacatttttgtcagtgaggacattttgatagtgaatattttgtatcttctattaacttgaaatgttttatttgttataaagccaggatatctgatatcaaattaaattgttttttttttccctttagattttcttcaatcacatctgaataaatcacttgaaggtaacctagatgtaatatagtgaaatgcttgaaagagctgcgtatcttttacacttacagcagtatgattttctgttgtacccattatatggtacctgcagctagttcagataaagagggcatttaactgtcaagggaacctgagaggagactctagtaatctggaaagtctgttggatctttgagggattttgggatggtgagagtggggctaggatctctggctaggttggagccagcctgcatttgtatctgtatcttggaagcaaacttagaatgcagagacagatgtggcatggacgctgtcagctctagccaaccactaaatcctaaggtgggagagatgcaggctttggctaggtgctaagctgctgtagccggttgaatgtagaggtcactatcttttccgaatacctgtaagtaaattaaatcattctctactcccatgtgcctgccaacctaatgggaaatcgctatagaaaagatggtttaaattttagtctttgaagtggtttatgcacgtttccggaatcaagatttaatgcagagttggattggatattgaatatttttgatttgtctgcttttctctccatagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaaggtgaggagaaagaaaccagatgtctggatgcgattaaacttcagagtttgttggttacgatgatgttacatattctgtatcatgctttttcctttgcaaagcactctatgttcgttatctcatttgctctaagtatgtaaatagggaactgatgaataaaaaggtgagtgaaatgacttggtcacaaaaaaagtgataaaaatggggattacagttcagtttcattgactcttagaattttttctccttctccccagcttttcattttgaaaaaattcctaacatacagtaaagaacagaacaacaagcacctagattaaatagtcattaatgttttgccatagttgcttgatttttctttctacacacacacacacacacacacacatgtttttgctgaatcatttgagagtacagtgcagatattatgacactcctaaatatataagcatttatctcctaagaataaggacattcttctacataacatcaatgccattattaaacctaagagtccataataccacctaatatccagttaatacttaaatgaaatttccctaagtgtcccaagaatatttttatttatttatttattttgagacagagtctcattctgtcacccaggctggagtgcagtggtgcgatctcggcttactgcaacctctgcctcccaggttcaagcaattctcctgcctcagcctcccaagtagctgggactacaggcacctgccaccatgcccagctaattttttgtattttagtaaagacagggtttcaccatgttgcccagggtggtctggaactcctgagctcaggtaatctgcccaccttgacctctcaaagtgctaccaagaatatctttatagctggttcttgtttgttttgagccagatttcattcaaggttcatgcatttggttggtatgtttcttggtattttttgagacttcttgatagatacctgtcaggcattgatagagatttacatcctaatcacattttggacatttttatctgtgaacaatagcttttgtcattgtttgttgcctgctcataggaagactcttaataatagtcttctcatttaaaaagttttaaaatagttattcaggaaattccttttacacatttctttattcctttattaagggtctactatgcaccagacatcatttttctaggtgattggagatgaaatggtgaaaaggaaaggcaagaatggaatttcctgctagtgggaggtagaagaagagagtattaaaaattttttctaagtcaaataatgtcatatacatgagaacgctaggtggtattatggcattatcagcttggctttccccttaaatgaaataggaagtgccctgtttcacttgaacagtgttatttcttttattaaaaagttacaagaagttaaatattttgaaaataattaatttctattctaaattagccaaatgttatatttgtaaaagtagagaagtttgttccattgcttctaccaagcatctaagtttatgtagttggggcagctagcagtctgtctaatgagcagaatgtatactttaggcttatataaagtattcagaaatcccccccacacctcctttttggtaaaaataaagtttaccactacaataaaatacagccagaggtgtactgggagtagaaggagactgaatgaaagaaaggaggaatggggtaaaggctggggcaaagagcaggccctctccctgcaggggagtatcagggcctgcagccaagtcaaatgacagcatgacgtcaggaggcaagatttgagggcttttatttaaggtgcagcattggagtttggttttaggagagtaggaagtaatacatccgttacccaaaggacccttctcctttttaaataagttacctgcaaagtttaggccaaagaggtgggtaaggtagatttgggaagctgttgcttactaatatcaccgaatgctttatggtcactaacccttcaggcagttcagcccagaagagtcagcagaagactgtttacaggcccccacctgctagttacagatcatccctgatagagcagagaggggtgaccaggtagtgactttgtagtcactggaggcaaagcccatttttggacagttcagtgaggacttatagacaaaagattcacaaattatggagtgagttggatggagtgtgaagcatatttatgggtcatgcacatacataataggtttactttttgaaatttgaaagcatgttttaagcttatctaggatttccacctgatttaaacctcttctttctctaatgtcagccaaaaacccgagtacaaagaagaaagaggaatacatcaaggacttttcatcctcatagtttgccattaatggctcatagtttgccgttgatggtggagagtgtcagaattggggagtagcctaatcaaaccttcttactctgcatgcagtggcagacagtccctttgctgttcttttggggaatgcagactaataaagcgccaccgtcattttatctatcagtaaggagtagctttaatgctactgcagtggtggaagcactgggcattgtcatccacccctggggaccagcagctttgttttggatcatgtatctgttattgtgatggagccatttatttttcagggaatgatgccaaatgatgtttgtccctttgctttacatttttatagctaggactttgaagctgaactggaggaacttcttagccaatactatcttctcaaatcaaaagtttatagttgcagaagacacgttttttagtgtcatggcaaccaggcaacctattatcttaacttaaatttagaggttgagcatccctaatctgaaaatctgaaatttgaaatgctccaaaatctgaaactttttgagcactgacatgacattacatgtgcattttgatgtcacagtcaaaatgcaggtgtaaaacacgcagtttatttggcgttccctagggaaaaaagaccctctcagcccgcttcagctgcagtataacttttctacacatgcccggatttccccatgcaagcacgcccacaaagggtaatagaatggcacatgttcaagctggatacgccattggcaggatccccacagatgggacttatgtgcattatccattgtgtatttttgcttattttctgctctgtggtgttaagatactgaaaatgtcaaaaagacctgtagatatttctatgagcagcagtgataaggaaaagtagaaacacttataacacagaaagtcaagctgtaggagaaactggactgtagtataaaggtatagatgacatggtgaaaatgtgtgatagagatattgaaggactagagctacctgcattcataacagaacaagaggtcatgtcagtttataaaatcaaagagagccttccaagacaaaagccattgttaatgaagcagatgactctggagaaacatttaaaagtcatctggccgaatgcctcttcagtctcagaggacccgcttcctagttgctcagctgcttctgatatttcttctcacctgaaaaaggaaaaaaaaatacagtgtatagtaaccttttaatcaaaacgcagcattgtaggtggagtctgaaagcctgccattgtttgtacagctgtttaacagctgatgcaggtattctggtgattctactatgctacttattactttcttactgtattaatggtatgtcatattttataagcatatgaaaatgattgctcatcagcagcataataaattcagagtcaggaatgatggtcaatgatgtcaaacagccacagattttccacatggtagctgagatagtgacccctttgctttctgatggttccatgtatgcaaactttgtttcatgcacaaaattatttgaaatattatataaaattacctttaggttttgtgtataagatatatgaaacataaatgaagttcatgtttagacttgggtctcatgcccaagatatctcacatatatgcaaatattccaaagtccaaaacacaaaacacttctggttccaaacatttcagataagggatactcaatctgtatatatataaatatatgtatgtattacatatatggtatgtatataatatacatttccatccctccacaggttactgttctggcacattcccattatgttctgtttatcagactgcaactaaaattttcatgggttcggctttatgttgaacagaatttgcagaatatgagttgaagcgaaccatagtttaataatgctgtgattctcctaaatcaccaaagtgcatgaaaggattatagagctcagaaatactgaagcatctttgcaataaaaaattattagtgaatgtacaaggagtctaacattttggttttgctttcgcttcctaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtaataataaatttttctatagattttcattattgtcttggttgtacgttttcttttaaattatatttgaaaatctcttagagagcaatccagaattttacaagtgactaagttatgagtctttacctttttttaaaaaaacagaggagttgtactctccttttcagcacttaaattctgtaatccttgaaggatgattctttagtgcagtcgtttattttttgctgtgctaatatgctctacatctagcttgatcttaagtgcagttttaagttttcctgtgtcatactataatcgtagggttgactctgcaattattgcattgtggtactttgcgcagttatagcacagcaagtgttaggatttctaaaacagctttattgataattcacataccatgtaattcacccacttgaagtatacagttcagtggtttttagtatattcacagatgttggtaaacaacactccaatcagttttaggattgtttttccacctcaaaaaaaaccaaatcaaatcctatgccctttaccttagtttttgctggcaggatcaactaggtttttgtttgtttgtttgtttgaagagatggggtcttgctcagtcgcccagcccaggctggagtgcggtggtttgatagctcagtgcagccttgaactcgtgggctcaagcgattctcccacctcagcctccctagtagctaggagtataggcatgcaccacaacaccctgcctcctgtgccctttagctttgaattccatctctccatatccatcagctgcacccctgcagttgtagccccggcaatcaccagtctttctgcctctggattccctattctgtatgtttcatatgaacgggattatatatcataccggcttttgtgactggattctttcacttggtatagtgctttcaagatttgtctatgccgtagcatgtatcagtacttacttcttatggccaaatgatattccattacatggatacactgcattttgtttattcgcttgtcagttgatggacatttaggacattatttaccccttttggctattatgaataatgctgctataaacattggtgtacaagtttttgtgtggacatttcccttgggtgtatatctaggagtagaattgctgggacacatgataactatgttcagttgaagaactgccagactaatttttgaaatggctgcatcattttttattcactccagcagtgtattaaaatttctgtttctccacatcttcacaaacagtgtgtgactttaattctagccattctagtgtatgtgaagtggtatctcattgtgattttgatttgtattttcctgttgacagtgatgtccagcatcttatcttatgcttattggccatttgtatatcttctttggagaaatatttgttcagatcctttgccatttttttttcctgttagggatcattttattttaaaaacataatagactttatttttttttttgagcagttttagaaaaaattgagaggaaagtgcagagagttcacatatgctccccctacagtgcccctgcccagttttccccactcttaacatcttgcattactgtgctacatttattagatttgatgaactgatacttatatattaactgaagttcatagtttacataagggttcactctttgtgttttatagatttttggatttgacaaatgtttaatgccatgtacccaccattacagtattatgtagaacagtttcattgccctaaaaatctcctgtgctccacttattctttcctcccgtcctcttcctcctaaccccccagtcattactgatctttttgctttctctctcactttgcctttcccagaatgtcgtataatagttgtaatcatatagtatgtagctttttcagactggcttctttcacctagcagtatacatttatagttcttctgtgttttttcatggcttgatagctcatttattattattattattatactttaagttctagggtacatgtgcataacgtgcaggtttgttacatatgtatacatgtgccatgttggtgtgcttgctgaataatattccatttgtttgcatgcaatgcaatttgtttatccattcttgaactacccatttctaattgagttattttgtctttttattactgaattgtaatagttccttatgtattctagatacaaatcccttctgttcatcagggttgcaggatacaagatgaatatacaaaaatcaatggtatttgacacactttaactgaatactacatacttaaaatgagcaatcaaaatgaaattaagaaagcaacttcatttataatagcatcaaaaagaataaaatacttagaaataaatttaagaagtgtaaaacttgtactctgaaaactataaaatgttgttgaaagaaatgagaggagatctgaataaatggaaaagtatcccatgatcatgatttgaaggcttaacattgttaagatggcagtcctccctaaactgatttacagatttaacttgatccctatcagaatcccagatgagttctttgtgaaatctacaagctgactctcaaattcatatggaattgcaagagactaagaatagccaaaacaatcttttgaaaatgaggaacaaagtaggagacctcatattaactgattttaaaacttactacaagacaatggtaataaggacaatataatactgacagaaggatagatgtatagactagtgggatagaattgagagtcagaaatgaacccatacatatatgatcaacttatttttgacaagggtgccaagattattcagtggagaaagaagtttgaaaactggcacaggggcaaccagatatgtaaccatatgcaaaacttggagttgaatctttacccaacatcgtatacaaaaattatggatacagaaaaatggatcaggccaggcgcgatggcttatgcctgtaatcccagcactttgggaggccgaggcgggtggatcacgaggtcaggagatcgagaccatcctggctaacacagtgaaaccccgtctctactaaaaattagccgggcgtggtggcgggcgcctgtagtcccagctactcaggaggctgaggcaggagaatggcgtgaacccgggagacggagcttgcggtaagccgagatcgcgcaactgcactccagcctgagtgacagagcgagactcatctcaaaaaaaaaaaaaaaaaaaaggatcaaatgaatcagttttgaactaatccacttaaatgtaagggctaaaactataaaatcccgagaagcaaacatagaagtaaattgtcatgaccctggatttggcaaagctttcttaaatatgagaccagcaacaataataaaaatcaatgaattggacttcatcaaaattaaacatttttgcacatcaaaggacaccatcaagaaagtgaaaagacggcccacaagttggaagaaaatacttgcaaatcatgcatagcactttttgatggtaaacttgaggaagacatttatcttttatcccttacctgtacagcagtaacatcctaatatctctctccctgcctctttttgccattctttaaattctttctcacttaattttcagatttaatattggctgaagcagggataatgagatcaatcaaaggggtccttaggacactagtcacagtgtttgtactaatactggaactggcttattttcaggcatttctagtgtgatcagatggcaaagaacaagcatatatatatgtcagttgccaggactgctgggaaagcctggtaaagagaacactggggaaaagcagcctcctgctcccctgggccttctttgagcctgatgatcacttgatatggaacttaccctctgaaattccttaattgttcttttctatatccttgacactgtccttttccagaccaaattatctcatctggaatactgcaacaattttcttttctcagtgcttttagaataacctgtcaaaatctcatctgattatagtattgcctgcttaaaaccttttaattactccccattccctatccgggttgtgtagctcacttgagctctgctggctggtgagggaatctgggtcctttttctggtatttgaattcagtgctacacaggttactggctgggtagacaatctcaaattgtaaatcacgagtattccatgtagatagtccattacgatctacaataaaacattgatgtttgtatcaaagatcatggtgatgagaggttgggtactgtactgtctgtgagaatttattgaggaaatttaagttatatggttttattcacatatagtgtataacaactagttaagggatagatgtcttcttatctgactttaaagtaggtaaaagtggatcattgtacttgttaaaggtctgggaaccatggctgtgttctgaaaatacctcagtgatgacaaataaatgactcccagcctatcataacattaggactccagttcatccctttgcttcataagtgtgtcttttccttttgtgtatttgctttagtatagaaaataggttttcttgattagaaatctaagaagaagaaattgaacactggagatttttctatttctttgaattacgaaaagttagtgtaatttggcagtatatccctgtgccattattgtctctcaggtaagtagatggtagggcttaggaaaatagaaaattttttttcctattttgcttatttaatgggtatgtgtttgtattaaaaagggaaaataggaatgtagatgatgttaactaatcgtgaaagttattgggaagggttacctaatttgaataaaggtatcattgtgaatttctaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggtagcagacacccacccacctattccccatccttctccaagggaaaaaaattttaagttgtattctcccatcatttgaatgattttagtttcaagacctacttcctattttgtttggagggaacacattaagatttggcacactccaccattgagtaaataccatcatgatagatgttgatgattgtgtatttcatttcaataactaatccagcccaagattttctggagctgtttgatttactgctgtgtttataggttttgagatagaaactgtgaagaacaacctcaggatcctttttaataatgctgtaaagaaacgtttgatgacagacagaaggattggctgccttttatcaggtgaagtcaattaaaaaaacctaattatatttcatgtgtgtttaattgaaatgatttgtagccatccctttggtttttactataaaatatttactgtatgatttactctttccttcattataggatggaaatgattttttataagctgtatttaatagtcatagtcatactccaacttgagttacactatagctatgttattggtgttaagagtgagtcagtgaatgttctttagaattctgtgtagtgatttttaaccaattcaaatactactattatcacagtttatatatttttctcttgttgaagttgatttcagtttataaaacttggcggattttaaatagtaaaactatgatcttggtgtttatcaggaatatacatcttctgtccctgtcttatgcaaggcacataactaggacacttccacttcctcttttgcatgtagggggcttggactccagcttggttgctgccactctgttgaagcagctgaaagaagcccaagtacagtatcctctccagacatttgcaattggcatggaagacagccccgatttactggctgctagaaaggtaaggtgctgtctctgtcccttgtgtagtgtagttagagtagacttgttattagaatgaaaatggagtcaataatgggtgattctactgctgctgtattgactgggtcaattgttttaaattgattgtattaaaatagaatgaaatggctgttggatatgcactgtgttgtacactgtcctctgtgtacttttatctgttatgacccatgcaattctcacaaagaccctatgatgataagtatgctcttttgaaagtaaaggtgtctgggcatggtggcctacacctgtaatcccagcactttacgaggctgagggaggtagattacctgaggtcaggagtttgaaaccagcctgagcaacataatgaaactccatctctacaaaaaaatacaaaaactagccaggcttggtgacgcatgcctgtagtcttagccttatgggagcctgggtgacagagcgagaccttgtctcaaaaaaaaaagaaagtaaaggcataagtcaggtgcagtggcacacacctatagtcccagatacttgggaggctgtggggggaggtctgagctcaggagttcaagtccaggctgggcaacgtagcaagaccccatcttgaaaaattaaaaaaaagggttttttgttcgtttttttttttttttttttttaaacgtaaaggcatagtatcatggctaagactgcagactttggaacctgacttgtggtttgaaatcctggctctactcatttatgtaaccaaaataatagtgtctgctatggggaaattttaaggtgaaatgatataattcatgtaaagtaagtagggtagaacttagcatgtagtaagtacttaatgagtgttagctgttattattatttttgaaagtactgtatttagaatactgtgggcagagggcagcttgtctgtattcagtgagcgggagacctagttcccactatggaggactttcgtagcatggatgagaaaaagctagagagcagtctcagtgcaaggtaatcaatgccgagagaatccaaaatagccaaggaaagcagaatgaggggaagggccattctatataagaataacatcctggatataaaattaggcatttaagaaggaccaaaaaagaccaagcttagcgtgggaccatgttggactagagagagatgaggtgggttaggtaaaataggtagagagggaggtgccaactgggagaatggttgaagccttggcaccagaggagctgaggggagacttacttcctggtggtggagttgaagcaggcgagggaacagtgctggatggggcttgtatgtggtgggctgtaaagtcatttttctttttttcccttgtttagttttcaccattgttaattcataaagctttgtgaactcccatcatgtttgattttcaagggaagttattttctttaacaagtaaatgggtatttctttatataataaggtggcagatcatattggaagtgaacattatgaagtcctttttaactctgaggaaggcattcaggctctggatgaagtcatattttccttggaaacttatgacattacaacagttcgtgcttcagtaggtaaggtattatgatattcttaaataaaaagctttttttaatactgaaaaaaatgtaaggtttaaaaaaattatttcaagccatagttttaaaatgttatttaaggatgaatgcaaattaaatccctatgttactgattatttaagaccacttaagaattctctgaatctcttttggagtgaagggaatagtaaatacgtagttcaacctccacattgttggtgtcactgttggtgtttccccagggagcagatacatattttctgccctctacctcccatttctcttatagtttcttgggctacagtctatatacagtgaggaaataggtctttttggtaatgcatttttgataagaaatagtcattttagatatattccatcacacaacttaccagtcactagctatcattgctctgcaaacaatactaattttatcttgtagataatgtatctactgagattggaagtataccccaaatcagactgatccagtgttattgagcctttatatgctactgcctcccttgagagacttgccttggaaggcaaaaatatcttaggtattacaatggtttatggccctccaaaacatcacaataaataagcagatagacaggatagctctggtattggaatttcatggggctggggtgaggttaggaaaataagtgtctaaaaaggctctctagctgaggtgataataaaaacaaggttgagaagaaacactggtttagagagatgtggtgcaggaccaaggaggcaagtttaataacttatatagtctccccagctttatgtgaaatctggtaaatggggagtggcagggggaaaatacccatcaaaattaacactaaaccaccaaaacggttattcttatttttgtgtcataataccactatgaaaggcatgatttttaggtatttgagtcattgttcagcttagcaaagttttgaggtggacattcttggtctaaaaacattagaattttaaaacctgtttagaaaatgacaaaatggttccgggttattttattttacagtagtacttttggattaagtacatataaatggcttataaatacaaggtcattattgtggaaactactttatattaatatgaagtccagtatagtagtaaagctttcaattatttccaaaaatcaaatcaaaggcatttttggtggaaggttatgttgacattaaagttaatttctctctctcatttaaggtatgtatttaatttccaagtatattcggaagaacacagatagcgtggtgatcttctctggagaaggatcagatgaacttacgcagggttacatatattttcacaaggtaaccactctgaagtggagggatattcatgctatattaagaaaagtatgaattgtttgactattttctatcatctttcagtatgacagtgatatttttgagtatcttgtgaggttacaaaagggaatctgatagtgtttgctttctatctcttggggaagaaagaaattttaatgtgtcagataatttttattctttaaaactagttacagctgggtatgagggctcatgctcatacccccagctgctgaggaggctgaggtgggaggatcacctgaacccaggagattgaggctgcagtgagctgtgattgcaccactgcactcctgcctggttgacagagtaagaccccgtctcttaaaaaaaaaaaaaaaaaagttaaaaataaataaataaaactacttaagcttgagaatcccctttctgccatttcttagcatcctgtggaattatgactgttgcccattgtgttcattttattctaatattagcagtttggtaggaaggaaggcatgttttgtgaagcattgcttacctctgttcagttatttactcccttccctaaatttgtttaactttttgtcttatccacctttaggattggagagggagaaagaaaaactgctttgtgtgccaaaagcaaaactcttggtgtttttgtttgtgaaataggctccttctcctgaaaaagccgaggaggagagtgagaggcttctgagggaactctatttgtttgatgttctccgcgcagatcgaactactgctgcccatgggtaatatttttagaggctattgtaaaacaaaaacaaaaaaacaccaaaaacaaaacaaaacaaaaagctcaataccctgagaaaataaaaatcaatagctgattggctatatgttacatatagttggctatatgttacaaagtgtgacttttatagagaaaatgaagctgtttcttaactttgtcccaaaaggattaggccacatttcaaagtggtgttgtggtatatggagagaagtcttcttccataggttgtttgaggtggagttttcacctttaaagggtaacaacattctgctcacatctgaacaaccaagatggaagaggcaaggctgctacagcagctaccgttaagtgttttaaagagaagtaaagatcgtaaacatcatgtgacaagtagtgagtgcccaccatgcccatgtggtgctgtagtgaccctgagggaatagagtagtgaagatacaaggggtttgattacattataaagaaccaggtttctttggttatcatttctagttgtctaaagttatgttgaagaactgaagacttttactgtacaggataaacaactgacattaaatgtcttagttgcctctgctgaatcacacctagataaggatataattaaatatgggtttgaggaatgaactgaatctggtcattatcctctctgcttgtcctaactagagtcactaggcttcaggaaaccggtgatttggaatttgatgaaatatagtgggacactggtttatatcgcatattgtatgtgaatttttaatcagtggcaaaaaaatactgtatcgtcatcacaattgttagaagagatggtctcacctagtaaacactgagttaggtctaggcaaggtattttcttaatgattgggtcactcatgttttgtaactttttctgctttttgaaatatgcatttaactattcctagaagggaaagtaaaagtaatagtctcagttagttttactccctagatgacatgatatatgtattattttaaatgaagatttattttttgtatctattcattagtgtagggcagtcattaggaggcttgtatgtgactgtatgaccttaacatttcttaagatctggttgaattgatgggaaactgaatcagaacctaacctggcaggcactaaatacccattttaatttagattttcttcttttctcctttaagtcttgaactgagagtcccatttctagatcatcgattttcttcctattacttgtctctgccaccagaaatgagaattccaaaggtaggtaaatcaactcaaggtaaaactgtccattgccatcagattatatttgtaatttttacctgatgctcctttttttgtcacgtcagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggtataatgtctttaaaaacattttcaggaataagacagtttggatgcagagctgtcattgctgttcattttgtatttagtttgaatgatacatgtatttagtttgaatgatacatgtatttagtttgaatgatacatacatcagatatctctctgataggatgtccctatcagagagattcagagtctctgtaaacaattatctcttttgtaagaattacgtaagaattaagtagcatgaaggattataaagtagcatctagaatcgagagagagaggagacttactactaatcatcactgattttcatttatcagatttttgggcacctgctgggtgccagatcttgttaggcacaaatgactaaaacagagccaccaagtattaaaaatatgcatatgagtgttctttaaaaggcactgcagctatccatattatgaatactttagcattttctaagtgatgggtgattcaaagggtctcatacaagttacagtcacgtcttaacattttctgtttcgtgaaatgagactaaacacaagtatttcctgccattttaagccattttgctcttatatgcttattcttacaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaccattgctgtagtcatttatgttcatgcagtctcttcataagaggtaactagaactgttttgctgtatcacagtaaagtggagggtaagctaggaaaagggaaaatgatcagatgtctgcaagaactcacagccctctcctggcagagctgctttagatgacatttgcatcttgtgcccgtgtggcttccttccagtccttgcctcatcttagggacgtcatcaaaggactacactatttttgttctgcctacattcctaacagctgcctaggcagactcagacttgaatcttctataggagttcatcacagctctattttgcaagatagtagttcatttttttctcttttatgttgagccaaagccacttctggagacttgtcctagagcaggggtcaggctttttttgaatttttaatttgtttttaataaagagccagatagtaaatattttaggctttgtggacctcttttggaactgttcagctctgccattatagtgcaaaagcagttacatagacaatatgtaaacaaacgagcgtggccatgttctattaaaagttacttatgaaagcagatggtgggccagatacggcctgtgggccatagttagttgattgctgttctagaggaacaactaagctaactaagcatttctgatgaaagtctaaacctttgtcagatgagtagattgcaaaaattctctcccattctgtaggttgcctgttcactctgatggtagtttcttttgctgtgcggaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagttttagctttctacatatggctagccagttttcccagcaccatttattaaatagggaatcctttccccattttggaatctattcatctgtcaaagggctaatatccagaatctacaaagatctcaaacaaatttacaagaaaaaaaaaaccccttcaaaaagtgggcaaaggatatgaacagacacttctcaaaggaagacatttatgcagccaacagacacatcaaaaaatactcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcaaagatctagaactagaaataccatttgacccagccatcccattactgggtatatacccaaaggattataaatcatgctgctataaagacacatgcacacgtatgtttattgtggcactattcacaatagcaaagacttggaaccaaccaaaatgtccaacaatgatagactggattaagaaaatgtggcacatatacaccatggaatactatgcagccataaaaaaggatgagttcatgtcctttttagggacatggatgaaggtggaaaccatcattctcagcaaactatcacaaggacaaaaacccaaatgctgcatgttcttagtcgtaggtgggaattgaacaatgagaacacatggacacaggaaggggaacatcacacaccagggcctgttgtgggctacagggaggggggagggatagcattaggagatatacctaatgtaaatgactagttaatgggtgcagcacaccaacatggcacatgtatacacatatgtaacaaacctgtacattgtgcacatgtaccctagaacttaaagtataattaaaaaaaaaagtgagtaccataaaaaaaagtctaaacctact

SEQ ID NO: 17550 - DNA, 305491 bp, Human
  misc_feature (1)...(305491): n = A,T,C or G
ttctcatcagaggacaaaccctatcgtgaactgtgcatgtgagggatctaggctgcacacacctcatgagaagctaactaatgcctgatgatctgaggtggaacagtttcaccccgaaaccatcccccatctccccttccccatctgtggaaaaaaactgtcttccacgaaactcgtccacggtgccaaaaaggtgggggaccgctggattagggggaatgtctgaagaaaaggaagtcctagtggtgaaaaaggcaccactgaaggcaaaaatgttcaattctttcctcaaaacaccaaagaaactaatataacttttcttgcagctattctggtaaacgaaaaacccttgtttttgaaataagatatatctgttctttaaaaatgcttattcttttataattataaaagtaacagccattggaatactcgagaacgttgtaacaatacagaacacttaaaacagtttaaagacaatgaaaagcagtagaatcccactattctgaacaaaaaaaattgcatttttttcgaattgttcagtggctgtgcaactgggagtacatgcattttcatatatactacatgtatacacgcacactgcatttgttttactttttcatttaacatcaaaattaattttttttttttgagacaaggtcttgctctgttgcccgggctggagcacagcagtgtgatcatagctcactgcagcctctacctctctggctccagcgttcctcctggtgcagcctcccaagtagttgggaccacaggtgtgcgctaccacaccaccatgcccaactacttaaataccttttttttttttttttttttggtaaagatggcgtctcaaactcctggcctccagcaatcctcctgcctcagcctctcaaagtgttgggattacaggagtgagccatcatgccaagtaagttatttcttcacactaaacattcttcagctcttagttgcagagtatttctagcatgtgaaacttcatacaatcaaccacaaaacacagacaaatcagtatgtatcaaaaagaagtaactgaaaaacacaaaatattgtctttgacagaatgactattttttcagacccttaatagtgaccaggccttcgcaagcctagaagggactcctgggggtgttttcatgaaaggcctgtggaaccgacttggtatagcctcatagcaataacaaacagtttaggtatcattttgtccaggggaaatacaaattacaaaatcaaagctagagcctttttagtgttgtatgcctggcaacacacctcattctacactatagcactgctaagcctcctgccctccttacagtccagaccacatgaaaacaaagtggtaactaaatccatgcaagaagctgggtgaaagcctcctttctgtgggtgctaatctgaagttccctccctcatctgagacgacctgcccattttggcagaacatgtgttaagccaaaatctcacacagatgaactcccaagtcactcacctcgctccaaccactttacatttagtttgagaatgtcacaggaacaaatgtcatctcctatgatttgagaaacaagaataatacaacaccaccattaagtccacctacactgccttaatggtgctgttggtgccttgctcccgtattttggccgctgcaaaatgggcttaaatatgtttgtaaatacataacttaatattgaattcatcttccctattccgcgcattttgagaactgtgcttagttttcactttggacgaatagcaacccttctgatggccgtcatgacaatgtctccaataaaaactgacagtctagctggctgcaaggcaggtcctcttctatcttactgggcactgctaaactgcgaagtcggggcgacacggcagcaactttaaaatcaaaccgcatccccaagggctcggcgtgttttttggcctctgcagcttcacgtacttcgtacgacaggagcgcacttgttctctgtccgagaacttcgtcccgagagaacctcaggaactcgccgggccacaccccctgtccagggaaggaacacgcccccggtgacagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcgggtaagcactggccacacggaaggcgcgggcggcgacgctgcgcatgcgcgcctttgcccggcggcagcgcgcccgctgcccggaaggaagccgtgggctggcctcgggcgggtcgcggggtgggggtctgcgcaggcgcgaaggggcgccggcagtggccggggagacgctggggtccactgacgtccctttgtctttgtttggctcgtcatcttctggagccaaactgggcattctgaaggaatctagtgcatcggtctcacttacccggagtgcataccgtcgcggccccaagttttgggcaggaaatgtgccgctggggtctggccttgctcgcgggcgcccgcggcgctgtgcctgcgccctcctttcttgtctcctctgcgccggccgccgggacccagggcacctgcagcggggctggtgcgagtgttgtcccgggaaatgccggaatgagacgagacgatgaaaaccttaagtgtggaactgcgtctcaggccagtgttctggctgaaagagtcacccctagtcacccctcgtgccctaggtcggccccgctgtccccaggggcaggggctgccgtatgctgggtcagcttaaagcgatgctccacaaacttggacaactttctagtcgttctcacatcagtactttgggaaaatacaataagggtgaaatactagaaaaatgttcacgtgcttcgatgccatgtaatggtaaactgctataaaagttttcaaaatcttggcaatttctgctgcagacagcacgcgtttcccagaacgagggccacacgttaatattaccttagtgcagcgcttctcagagtgcccccacctgccgcagcagcagcagcatcaccacctgggtgggcgttcccccattactgaatcggagactctgggggtggagcccaacaatctctaaaacaagtcctccaggtgattgtaatgtacgctgtagcttgtaaaccactgccttagagctgttggaggattaagtgatgtttaatctacacatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaattgtgtgactggcttattattaatcgaattagcagtttctgtttcctggtttccccatcatttcacctgctactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaaaaaaaaaaaaaaaaaccccaaataatccaaaaactcttgttcagatttccaaactggttcaaggtcaagatggaccaaaatttactttggctttatcttaaccaaagtcttcccaatcagtttcctaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaatgcatatgtccttattgttcatctgttgtaactttttccacaaaaagtgtgtgaaatttagattgtggacgttccagtctccacttctgagccttgagaggttgctgaaagccctgactggctccagaaatgggcagtgttacctcttcagtgggtttcagtagctgtaaacttgaaacttaaggatttagtattgttctgaatgtggaattcacctccactgcaacttggatcctgtttaacaactcctcccttctctatattacctccatccatgtctgttcttatttgtaccctgaccctcaaaagttgcgtgacaaaagcatcaccttttgactgcagaaggcctgtttctttagtgcgtttagataagcctagtatcaggtgtgtaccattaccaaatacttgaggtgttaaggattaccatcttagcgttcatcctaccatttttatattcttaaggacaattccacccttttacacactgtgaccaagatttccaccttgcaagaaggaaagagtcaaaccttcaaagtttttcagtgtttaatttatcccaggctacctaaaatggatcaaaacatgaacaggcctacttgggtgagtggtgaaaactgaacctgccctggactgcctcatttgcagcctgctgtgttcaggttagggggcatctgggcagtgctggctggctggtagggcacacggcaatgtgtcttgccctgtatgtggagatggtctcattgtgcttcagtgcctgaccaccaagcaatactctgagaacttgggaatgagggacaaggggaattcatacttgttgaagtgtattggtattgtattgttcaaaataggctgcaggtagaaggctcataattaaaacctcagagtgccttccattttgttaagatgtgggttccttacagtcagaactgatcttatttccggtgaattattgtaattattgtaaaagtccaatatggtttggttttgtgtcctcacctaaatctcatttcgaattgtaattcccacctgttggaggaggggcctggtgagaggtgattgaaacatgcggggggtggactttccccttgctgttctcgtgagagtgaatgaattctcacgagatctgattatttaaaagtgtgtagcttgcccctttgcgctctctcgttctctcctgctcctttgtgtggagatgtgccagcttcctcttctgccatgattgtaagtttcctgaggcctccctggccatgctttctgtacaggctgtgaaactgtgagctaattaaacctctcttctttataagttaccttgtctcaggtagttctttatagcagtgtgaaaacagactaacacaaaggccgtctttcatgtggaacttgtttttgcgtattggaaacattgctaatctgtgtttgggaatgaatcttacctttttatagagtatcagtgggatcaggtgtttgggatttggagctgtcctttaaaataactttgacaagtttgattctatcttggctttcttgcgtttacattcttagtgttcattgtatttttttgttacagtgctttttttgggcactaacatgttaaaaacagatgtagagcaccatcagaaggtattctcttttaagaactttaaatagaaaaaaacagtagaacaatgtattaatccaaaaggtggctctttgaaaaaaaattgaactacactaatgacatttgtaaacaatgaggtagtctcaagaaaaagatgaaagtacaaatatacaaaataagtcctgagaagaggagatcataaaaacagataatttgaagaatgttaggagactactgaactcttttaaaataaactttaaaactttgatgaaaatgataatttttaggaaaatataagtaatccagattgaccccagaagaggtagaaaatttaagcaggttgatttttatagaagaaataaagctatgaaagagttacctcctctcaaagcattgtctagtttcaccaagattatctaccaaatatttaaagagcagataattccagagcaggaataaatggctatttccttgacatagcatatctatttgaacccaaaagcccattttaggcttaatgaagaaacgttgagatttccactgatgttcagaccaagacgaggagtgagaacagcctagtaccttttacagtgtgcactgttagcaaaattttggtgttatcttagttttaatcccacctttaaaaataaattctaccttttttgtattaaggaaacttccacctttttattaagtgtgatctagtcgttgatttatactttgtaagaaggtaagattcaaacctttaaacttcttaatgtttaatttctcccaggccacctaaattggattataacatgaattggcctactttgaatgatagattattattttacattgtaggtacagccagtgtgatcagacaaagcaattcgagaactacaaaagaggaaaaaagatcagaagttcttaaatacataagggaatgcagcatttgataaaggtggtatctcaagtcagtggggaaaaggtgaaatattcaataaatggtattgggacaactgggtagccatatggaaaaaaaggttggatctctacaccgtaagccaggataaatttcagtgtttgatggaataaattccagatatatgatgataatagctcacacttgttaagtgtcttgtatgccaggcactgtagtaatttactaatgcatttaatccttacggtaacccaaagaagtagtaactgttatcaccacttatagatgtggaaactgaggcccgtagatgttaggcagtttaaacaacatacattgctaataagtagtggagctgggatatgaacgtagtcagtttggctatagagttgctggccttaactcctatactctttttccatttaggttattgttaaaaatgaaacagtatgagaacagaatgtttttataatctgggtgtgaggaaagccatgacttaaccatgacttgaaaatcggaaaacgtaagactgataaattagattatatcacagtaaaaagactgataaattagatcatatcacagtaaaattcttctgcatggcaaaaatcatcataagcaaagccaaaagacaaacgatggtaaatagttgcaattcatatcataggtgaaggaccaatctttttaattatataagaagcttctagaaataaaaacaccaacatccattggcaagatagacgttaggttatgaacagaccgtttacagaaaagtacaattggcttttaagcatataaaaagatgctcaacttcacttataatgagaatgcaaataccatttttcatgtttcagactggcagaaatccagaactttgacgatacactgtgttggtaaattcttaaggaaaaatacactcttgtacatggctggcaagagtataaattggctcaactcctatggaaggcaatttggttgtatctatcaaaaattcaaatgcatataccttttgacccaggaattcaatttatgggaatttatcgtctggacataactgctatgcatgccaaatgatgactgcaccaggttattcactacagctttgtttgcaatagcacaagactggaaacaacccaggtgcctatcagtagtggctagttacataaattacagttcattgtcacaatggatatgcagctgtaaaaaagaatgtggaacatctgtgtgaatgggtatggagggattgccaagatgtagcattaagtgaaaaaagcaaagtctcaacagtgtatatatacagtatgctaacttttctgtgaacagaagggaaaataatatgtatagagtaactttgaaaggatagctaagaaattaatggctgaggagggggctgtgtaatgaggatggatggaagacatagacttttgatgcttttttgtaacttgcttcttgtaatgtgactgcatttgtgaattacataactccactttgaagatgatctgtctcgctgtttttagtctaattgaccacctttctgtcatcttttgtcatacttacttgaagtttttttttttttcaattttgctctttcttgtcaagtacatcttttttctgcaacttgcttttgtaatcaaaatctacattttggcgtgattgaaaaatcaaaatttagagagtgaaatcggaataagttaatccaagtcattttacatttcataaatattcatttttattgaagcatcaattgtgatggcatcatttatacaaagaacagatctttgaggacaaattccttccgctattatgtagaaggcattatgtgtatttcttgtattgtgagtgatgtacgttgatttttaaaagaaaatgatagaaaacagttttccttttagaaaagttttccccaatgtgtgattaatttctaaattgtaggatacagaattgttatttcccctctttgcatcctgcccagagctctttgattttacaacctgttccagaacgtttagtgtttccctgaagtccctgggatgagggtattctgtacctcccacaatgtgatccttacctgctttcccagtctttttctccactgtgtccctgtagaaccccatcttctgcctaatgtgtttcacttttctgcctctgtattgctcacacgaccatacccatagcgtggattgcacacttggatctttttacttagtcattcattaaatgtctattaaaggcctgcttaggaaagacctgtattgtccatatatccttatcttcaaggaagcatccttgaaatttgccctgctctaattccccttctcccggaaacccatcctttttctctccaacctaagtgatctccttcttctctactggacaaatagctatgtactactttatgaatcctttctatggcatcttgcgttgctaattagatgtcttattgcacggaactcgcacaatctgtctcatctccccacgtagtgagctcacagcacttcaccaagagtgctgcccaccaagaactcacagcacttcaccaagagtgcagtcaatagtgttttatgaacgttgggaagaatatggttaatgcctgagaacaaagaccagaaatgtcatcttttcgtgtgaccatcatgatacagagaagttaacagagctgccccattgtccatggggcatgttccgagtttttccagtagtggtgatagattttggctgatttctctgaacttttccctgagttatttttgtgactttggccaggatgaagggtggggaacccctcatctttaaatctctgagcagagacttgctaggcatctgcagcagtggtggggaagaggtcattaagctcagtgcagtccacgtggggccttggcctgcgatcttcaggctcaggagttattgtgagcccctgcgttgggtgggggaagggaggaaaggaggacagctgaggcaaggagtgggagcctggctgggggaggagacatcagcctggggcatgggtcttatgagggtgagtggccgccaggccctcagcaaggaccagagtggaagcctctttgctaagcttggtctggctcctgcatgggtcccagcagcgtgccatcaatcatccgttcctccttggcagatggccaggctccttcccatgcagcagcagcagcagctggctggccctgccctcctgtttcagctgacatcggcaaccctctggggatgtatggaagactgaattctacaagagatgctttcaggatgtcagtgcatgatgaatgaaagttgtggatcttctacatgctgctcttatcttcctcacatcataaactccaagtttgagagcatcacaatattcatcgatatgtagcactacacaatgaactgagggcaggaattgacttactctttgtacccggaacacagtaagctgatgataaatacttgttgaaagactgtagcatataacctgttgagttgtttgagaggccagggttcctctgagcagtatcatgccaacagacacacgcatgttatgtattatggcacataatcggtaagtccataactgttggagtaatggggacgagcacagtgcactgaagggtacaggaagcatcggggtttgggggctccggcctacatttgtggttatgttactggtttttcctatcgcatcagaaaactttattaactagatggaatttctgcagccagatgaaaatgtatgtgataggagtggatcgtgtgataggagtggatcgtgttagctgcgtgagattgctagtgaggcactgagttgtcatcaggtagcaattccaccatttccactggaattccttagcacattttaagctaaaagaggtaagaagtcagaagggtaagagtctggccatggctttgctttcttctctcacgcttccaaccaccctcgtctgaaagctacatttcaccttgtgaaagttctgcccttctgtttccaaatacaagatgctgtaagcctgaactcagatctaaaaccaaacttagcattttgtttccaaaagattgactacatattttaatttcccaacctctctcagtggcactgctctcctctcaaatcccagaagccgcagtcagggtcatctttgagccttacctctacatttgagttgtccttcctcccatgagtcccgatgacttcttttcttcattggtctctgatctgtcttcactctcccctgcctgagctgttcagagcattatcaacatctacctaaaatttgaatttcattctctcactgtttagggaacagcagcgacttggacctgtccaatgacactcttcaatgctggacacttgctgtaatttgctgctggcctcagtgtttcagatctccacttccaccccgaggctggctcctgctctgagctccttccttgcaggttgctatggtctgaatgcctatgtgcccctactgaattcatgttgaaatcctcacccccccaggtgatgggggattatgaggtgggggctttgggaggtgattagtcatgagggtggaacacgcatgagtgggattagtgcccttgtaaaagagaccccagataactagctagtcttttcggccatgtgaggacatggtgagaaggcgctgtccgtgaaccagaatttgggctctcaccagacactgaacctgctagcgctttgatcttggacttccagtctccagtattgtgagaaagaagctcctattattgataagctgccaggttatggtaaattgttatagcagtctggcggactgagacacaggatgttttttccttgcagccctgtctaaaacatcttggggctttcaaggctaaacttggcttcttccacttctctgccgccccttggggctgtttcagcttagattgctcttagagttggagctggaactagggctttggggctctgttttgtgctttcattccagtgtctctccttggggagatgaaggtagaatccctttcctgtatttggtgcttggtggtagtcatttcccccgctgtgttttcggaactcctagcctggttatagaagctgctggcatgatcagagttctcagattccagctgctttctcctggatatcctatcaaaatgccctctccgttcagtgagatactcgatgactttgactcatgatgccaaatgattgatttttccttcaccagagacctgcgtgtcctctgggtcagctggtacctcttctgtaagctcgggctcttatgaaaggggacataggcttttgcccaatttttttttttttaaaggcatggtttcttgtatttctgtaggaattttgtatcctttcatggaagtgcatctgtagtgtttctcagcagggtatattcctaatccactaacttgttgaacaagtatattaaattggcatcatgatacagcgaaggctagtaataatgaaacaggaagaaatgtggtgacagtatatttagatgattataaatacattaaaatacaaaatttaggaacatcggatgtcttcccagagcatgtttataaaatgaattctttcaaagatgttaccataggaaagtaatactagtgttgaattttcctttaaaaagttttcgtattttacctttgatttaaaaaaattagtttaccattaggtattttatactttgcataggtcaaaagtcatgtgcaaaattaaaaagcatggttcagatgaggccacaaattattctttggcctgctgaaaagatctgatattttaacagattgtacccagaagggaagagtcatgaaaatgaaatactttgagggaattcatagctttccacgtggggaaaatgagacctgaagtaaaaaattttgaatgcactgttgttagcagttgaaaaccgcgtaagagtttgcagaatggaatggtaggctgtcacagagcccccgagaaggcattgcattgctgaaaactccattgccttacctcttcctgagaggcagtttacaaagagccacctcatctaccagtgagccctctgcagggacttctgctggtccctggggtgtctggcttaccattcagcattcctcacaccccgagatgtgtgcatcagcatgaaggagtgcttctcagagccccagggtgtccaggtggtcctgataacagagggcactcaggcagtctgtccctgctagccccatgcaggttgctgggaaagcacctgacaccaggagtagaaacttcacctggtggcccatcctcagaatgtaagaggggtttcaggagcccactctagataacttaaaaaatgttttttttcttcaggcttatgctcatactaacaagctctgtcgaattatttcaatgtgcggaataaaaggcaagaattattttctggtgcagtttagaccttggatgagtagggttatgcagctgtttgctgcagtagttttggggagacacacacctgacttaagctatgtgaatttggatatgaagttccaagtgtaagatatgaaccaaaggatttctcttaacgtaacgatggaactcaagcctgaactatttttgttcattaacaacctggcagttattttttcagaataaggagatttatgaaagagctgaagtctgggcttcattttgcgtgtacatttgcttccgctgttgccggatggttggtaaaggaaattgatagagtttttaaagtgaggactgtattgtttactttatgtgttgttttaaagtaggaaggaacacagtcgccctgctatcagcctctggtttcttgtcccagtggcgctaagagtcaactcttctgcctgacagtgcctgctcctaccgtgcctgtgctgagatagctcctcctggcttcagggcctttatggctgaaacttcaattatatatataaaatatataaaataattattaatataacttaatataataatatataataacttttttgagacggagtcttgctctgtcggccaggctggagtgcagtggcatgatctcggctcactgcaccctccgtctcccggattcaagcgattctccatacctcagcctcttgagtagctgggattacaggcgcccagcagggtttccccatgttggccaggctggtcttgaactcctgacctcaggagatccacctgccttggcctcccagagtgctgggattacaggcgtgagcccctctgcccggccaactttgtatttttgctcaaagtttgatctgtacattttgaatcatttttatcctttttccaatttcccaactaaccaatgttcagacccgagaaagcattctccaaaacctttctctgtattcataaaatcatacacacacacgcacaattgttggttttttataaaaatggaccagattgtattttctgtatcttgcttttcttgcttaatagtacatcataatatctccagttcagctgatatatctgtttttctttttttgagacggagtttcactgttgttacccatgctggagtgcaatggcgcgatctctgctcactgcaacctctgcctcccagcttcaagtgattgttctgcctcagccttccgagtagatgggattacaggcatccgtcaccagacctagctatttttttgtatttttagtagagactggtttctaccatgttggccgggctggtctcgaactcctgacctcaggtgatccgcctacctcaccctcccaaagtgctgggattacaggtgtgagctgctgcacctggctcagctggtatatctttagtatgttcttttatcttaaatgacttttttttttttttcgagcagttttaggtttacagaaaaattgagtggaaagtacagagttcccatacacactcctccctgagtttcccctgttaacgtcttgctttagttacaattgatgagccaatatagatacattattattaactaaagtctgtagtttacattagagttcatttttgctatcatccagtctgtgggttttgacagatgcatgatgatatgtacctaccattgcagtatcagaacagaatgccttcactgccttaaaagtcctctgtgctttacctatttgtccatctcccccttcccaagaaccccttgcaaccactgaactttttttattgtctccatagtctttgctttttccagaatgtcgtatatttggaattatatagtatatagccttttcggttggcttctttcacttaacaatatgatttgaggaaccttcatgtcttttcctggttggatagccaaatttctttttattatcaataatattccattgtatggatgtaccacagttgatccattcacctactgaataaatatgtgcatcacttacatggggatctataattgttttggcagttatgaataaagcctctattaaaatttttattcaagtttttgtgtggtcataagttttcaactcatttgggtaaatgcccaaaagtgtgatttctgggttgtatggtatatgtagttccataacaaactgccaaattgtcttctgtaccattttgcattgccaccagcaataaatgagggttcctcttgctccacatccttcccggcagttgttgttatcagtgctttggattttagctattccacagacatttagtgggatctcattgttttaatttgcaattcccaaatgatatatgctgatgaagatctttcctgagcttatttgccatattatgttttctttggtgatgtgtctgttcaaatcttttgcccatatttcagttgggttgttttcttactgagttttttttttttttttttttttttttggagacagtcttacactattgcccaggctggagtgcagtggtgcgatcttggctcaccacaacctctgcctcccaggcccgagtgatactcatgcgtcagcttcctgggtagctgggactacaggcatgtgccaccatgcctgactgatttttggatttttagtagacatggggtttcgctgtgtttgccaggctgatgtcgaacttttgacctcaagcagactgcccgccttggtctctcaaagtgctgagattacaggtgtgagccaccatgagtggcctattgttgagttttaagagctctttgtatattttggatatcctttatcagatgtgtcttttccaattttttcccagcctgtggcttgtcttcttatcttcttgacagtatctttgggaaaggagaagtttttaatttaaatgacatccagcttgtggaccatttctttcatggattgtgcctttcgtgtatctaaaaagttattgccaaaccgaaggtcacctagattttctcctgtgttatcttctaggatttgtatagctttgcatttagctatgtgatccattccaagttgatttttgtgaaggttgtaaggtctgtgtctagatttatttttgcctgtgggtgtccagttggtcaagcccattagttgaaatgactgtcttttctccatcgtattgcctttgctcatttgtcaaagatgagttgaccatatttatgtgggtctatttctgggctccttattatgatccatttgtcagaatagacaaatgtcttttcttttgctgattgttgaagttgagtagcatcggttctctgactttgttcttctcctttaatattgagttagctattctttttttccccctttccatataaagtttagaatcagtttgttaatattcacaaataacttgctgggattttgattgcaatgatagggttgcactgaatctccagatcaagttgggaagaactgacatcttgaaaatattgaatctacctatttgtgcacatggactatctctccatttatttagatatatttctttcatcagatttttagtcttgttcttagggatcttgcacatattttattaataccaaaatatttcgtgtttttttgatgttgatgtaaatggtcttgtttgtgatttcaaattccagttgttcgttgctggtataggaaggcaataattgactttcgtatattaatcttgtaacctgcacccttgctgtaatttcttattagttccaggatgttttctggattttctacatagacagtcatgtcatctgtgaatgaacagttttatttcttccttcccaatctgtacaccttttatttctttttcttgtcttaccacattagctaggacttctagtatgatgctgaataggagtagtaatagtggacatctttgcattgttccagaacttagtgggaaagcatctagtttctacttttaggtatgatattagctctggatttttaaaaatagatgtttgtcctcgtccattcgtgttgtgataacagaataccacagaactgggtaatttataaagaaacgtattttctcacagctccggaggctggcaagtccatgatcaccgtcaacatgtcagcaagttcagttgtctgctgaaggctgttctctgcttcaaagatggttcctctggattggagaaacagtgtgtcctcacatggcagaagaacagaaaagtgagctagctgaatgctctgtgaagcctcctttataagggctttattctcatccatgagggatgagccctcatgacctaatcacctcttaagggtacctcctcttagtaccatcacactgggaattcaatttcaacacctgaattttggaggggacacattcaaaccaaagtgatgttctttatcaggttaaagaagttctctactcttagtctgctgagagttaatatgttctttttaatggctgcatgaagttccatggtatatatgcacatagtttattaaaatgaaacatgacaaaaccacaccctctttaacgttgaaatattgatatgtttgttaatcacagcacgtggtatgtatatggtaagtgcttacgggtacctccctgttaaatcttgccaaggatataaaattggtgccaggttatgtaatgcttttgaagccaacttgagtcttggatcagactggaaaatggaaagaatgtagattctgtgatgatgaatactttggggaaaataagaggattaggtagctgatgcccacctttctatcaagggagcaaaaatgtcctatgggtctttgatctttgccagtgcatttggattggtttctaagtacagcgtggcagccgggttatggtattgttagttctggaaacttagtcaatttgcatctggagtcacctagtcacatttgatgaaatgggttacaaagttttagcacctttctgtaaaccaggggttggcaaataatagcccacaggccaagtgtgacctgctattttttcaattaagttttaaattttgagataatgttagatttacatgcagtagttagaagtaatacaaactgttgtactctgtggatctgttgtactctttgcctggtttcctcagtggtacatcttgcaaaactatagtacgtcattacaacgaggatattgacaatgacagagtcaatatacagaacagttctgccaccagagattccttgtgctgcatttttatagccacattgaccttcttcctcaccccctgcccatgtgcaacctctggcgaccactcctgttctccattgctgttatttcatcatttcaaggattttacataaacgatgtcatatagtatgtaacctcttgggattggcttttttcagtcagcacaattccctgagattcaccccagttggttaatgtaccagtgctttgttctttttcattacagagtattattacttggtgtggatgtaccacagtttaaccattcacacattgaaggatatctagattgtttccagtctttggctgttacgagtgaagctgctatgaacattcatgtccaggtttttgtgtgaacataagttttcatttatctggagtaagtgcccaggagtgcaattgctgggcacttacatgtgataattgcatgtttagtttcataagaaactgccaaactgtttcccagagttcttcagtttgatattcccaccagcaacatatgaaggatctgatttctctgcatcctctctagcatttggtggtagtgtcactgttttattttagccattctgatagctatgtagtgatatctcatcatggttttactttttatttcgttggtggataaggatgttgaagatcttttaatgtgcttgtttgtcatttgtatatcctctttcgttaaatgtctttggtagacgttaaacatttctaattgaattattgctttactcttcagcggagtcttttatatattctcattactagttttctgttagatatgtggtttgtaaatattttcttctaggctgtagcttgccttttaattttcttttttttttttttttcttaagacttgtacagagtaaaagtttttaattctgatgagttccagcttcctaatttttcctttcatggatcatgttttcatgtcaagtctaagaactctttgccttgcgttgatcctggagattttttcctatgctttttgttttccttaaagttctgtagttttacattttatatttaagtctgtgatccattttgagataatttttgtttcaggttgaggttgatgtttagtttgaggttcatttgtgtcaaacagaactctgtgtactggtgttcagttccaagggaaggctggcactccatggaggttagcaaaaaccatcattatgccaaccatcaggaatacgatccagacacttgtgcccgctgtatctcagtacgagagtctccaaggaaaacacaacacagtcaggtagtcgagggagcaatagttacacagagaagagacagagcaagatcagtttcagtagtgcgtatgggtcccctgtgtccaggggtccctcgtggctgcccgtacggggtggtctgcctacgagcacccctcttgtactgcaactaagggaccctgtttcctgggtggggaacagatagagcaatgaggttggccaggtgccatgtgacacacacccttaagcagaacaaaggcgcacacatgagcttgcagcagtgagagatacgtattccacacaaggcataagcctgccacaggtgatgagggctcttcatctgttggtgagatgtgtttcaggcccagggcccattcttaggccactgagtgggggctgaaaggctgtgcacacaagactccctttcgcaacattttttttttttttgtctatggatgaatattcagttactacagaataatttgttgaaatcctttctccattgatttgcttctgcatttttgtccaaaattagttggccatatttgtgtgggtctgtttctgggtccttactccctcccgttgatctatgggtctccctctgtgacattgtcatgctgtcttggttatgatggttatatcgcaggccttaatattagagtcatccctcccaccttattcttccctttcaagattgttttagctgttctaaggtctgtcccactccatataaacatccaaataaacatcagaataaactctctgtcaacagaaaaaccttgctaggattttgataggaattgcatttagggacaattgatgtctttattatgctgagtctttcaatccatgagcacagcatgtctttccatttatttaagttgccttcaacttctttcatcagcgttttgtaattctcagtgtatagatcttgtgcatgtttgctatgttcatacctaacctaagcttttcattttctttggagtgattgtaaatgatatggtatctttaattttggtttccacctgttcattgatagtatttaaaaatgcagttgattttgggatgttgatcttacatctttcaaccttgctgaactcactttagtagaagttttctcatagactttttcagatattctacatagataaccctatcacctggaagtagagttttaatctgtgtgccttttgtttttcttgccttatttcagtggctagaacttccagtattatgttaaataaaagtagtgatctgtggatatttccctagccttaaaaaaaaagtattgagagcagacatgcttactttgtatctatcttaggggaaaagcattcagcctttcactaaactatcacatatgatgtcagctgtaggcttttttgcagatgctgtttattgagttacggtagttcctctttattcctaacttcctcagtgtttttatcaggaaaagggtcttctaccacctgtttaaataaagttttattggaacacaggcatgcttattgctttagctgttttctgtgtctgcgttctcagtgtaacaccagaatcgagtagttgtgatagtgaccatatgaccctcaaaacctaaaatatttattatctggaattttacagaaaaggtttgctgaatcttactatagtttcaccaactttttcttttgaattgtccttttttctttctttttttccaagttcttcctatctcttgatattctaccatggttgcaaactcttactccacacactcttactctaattggctaagacctagagcttgagccattggctgcggccagcctcagaagaaagcagggaggatggatagatgtagatctagttgccttctaaaggcactttctactctttgtctgtatttctatcaacggtagcatttggggtagttctaacatgttcttttgataacttctattaattctgtagcttgacagttaccctgaacaaattactttcatttcacttcttcttgacctcaaccttctttcctgccttgattctctgactcttcctatagtttgtattgctgtgtttccttatgatggaaagatacatgacttcactgatctctaagggatttaggggagtgttgctttctatacgtgacagttcttcactttttagttacatagttccattttgttttgtctaagggaggtgcttttttttttttttttttttttttttttttttttttattaaatggagtctcgctctgtcccccaggctggagtgcagtggtgcgatctgggctcactgcaagctctgcctccagggttcataccattttcctgccttatcctcccgagtacctgggactacatgcacccgccaccatgcccagctaattttttgtatttttagtagagatggggtttcaccgtgttagccaggatggtcttgatctcctgacctcgtgatctgcctgcctcggcctcccaaagtgctgggattacaggtgtgagctgccgcacccagcctgtctaagggagttttaaaatgtttagctttgaaaagtttgttgctttcgctgaaaagagtgggatgaagtatgacctgagtctctgagttaggaaataagtgaataagtttttttgatcactgaaaggtaaaccactgtggtattgtgtttattgattattaattgatagagatattatgtcctgcatctctacattcacatttgattattttccagcttgcttgatctctccccagaacatggctttattgataatacaccccttcttcttcttttcttttcttttcttttttttgacacagtcttgctctgttgctgaggctggagtgcagtagtacgacgcctcctcacagcaacctctgcctcctgggttcaagtgattcttctgcctcagcctcccaagtagctgaggttacaggcacctaccaccatgcctggctaatttttagagattacccagagacgggggttcaccgtgttggccaggctggtcttgaactcctgacctcaagtgatctgcctgtctcggcctcccgaagtgctgggattacaggtgtgagccaccacgcccggccccctgtacttcttttttctctttgccatgcttctgtttacccattactgccaacccatttgaccctccttgcttaggaattgctagcatttattttctttactactcatttggtatgcattcatattatttgaagacttcatatattgtctttttatttaagtttataatagtgattattgtatttctgttttctctataatggcattgcaaatttaatgagagcttatttacttatgtggatccctcccacacctaggcatgtctgttacatgatgaccattagttaaatgaactaaagaatgattgagcttatattctgtagtatcgtatttggaagttgtgtgttcaataaaactcttttagtataattcaggccaataggtattaatattaatgaatgtcagtaaatggaagctatgtttttaccttctagcacaaacatctttagaaattttattacgactgtgtatgtgtgtccagtggctgactttccaagcagttattagaggagatctgagtttttagcttctgcattatgattcatgttgaatatttatggaagagaagtgtttctacaaatatgtaaaaatattggtgagtgaaagaaatggctcccagtatgacagaagaaaatatcctaaagagatccacagttatctgcagtttccccaaggttgtgtttacataaaaaagacattgttttatgttctagcatcaagagatgattttacgatataacaagttccacaaagaactctcgtaagatggttctcagtcccggcataactgctacggagatcacagagcaatattattctctggatttattgggtttgctgcattctgttagcatcattcatatttttctcccatgggtaccactttcctctcttttcctaataccaagatatggagactcatttatgccgtggagtgtgatgctgggaaatgaatgcttgcttattacctctctccacaggacctttcatgaccatacgtcgatgtctgccgcctcagtataaataggcacattcagaaatgtgttctctagtgaagggcatgttggcttggtggaaagcacagggacttcacgtctggactgcgagtcagagctgtgcgtcatgtgcttaactggctgtgtgaccttggataaatttgcctcagttttctcatttgtaaaacagacagtcgctatttctgggaatagatgagataataaggaaagaacctagaatggtacctggctcctgccagttgcacagaatgtttgttttgcagtgtgatgcgtccagtagggacacttaggggacagtgtactgtcatgctgttgccctgttttgtaagagtgactgatggctacgtgacatcaccacactccctgcaagagctgcggtgtatggcacgtggctaagctgtaggtgcacatggccttcaactccacctgagctccagccttctttttgggagaactggcctctgggtccacctatgaagcaggaaggttgattattacttaaacccatagtcttataacctcttgggaaaagattctctcaaaatgactcttgatggtcaacatgggtgtgcatttacgcagcttccattcccatcgcttcttgcaggcagtgttgttcctgattgccccagtctagtttatcgcaagggaatttctttgcggggcagtgagctcccttttggcagaagaaagagtcaagcagaggctgggaggttcccttacccacagtggtggctggctctgtagtgcctcccggctctgggttctactttcctagtctcctgcctttccgcaagtgtctccacccagctccgatagagtgggtagcatcaggagaagggagggcagggatgagtgttgtagcatctcaacatttaagagcagaggatggggggctggggaagagcatacactggggccgggtgtgaggagggagaacattagaaaaaaaaagctaatgcctgctgggcttaatacgtaggtaatgggttgataggtaaatgtgtgccatggtggtttgctgcacctatgtaataaacctgcacatcctgcacatgtacctcagaacttaaaaaaaaaaaaaaaaaagagcagaggacaaggagcctccaagtttatgtggaaaaagtagttagaaaagcaaaaagagtactcaggaaaccaagagaaatgagaacatcaggaagaaatggatggtcggccacagccattgcatttgacaaccaaaagcttttgccaacaatgatgggcaaagagagggagggcgagagccaggcaccatggccaggtgggaaagtgtggagacctgcagatcctggcttctctttcaacagcttggctggaaataaggcaacaggttcaaaaggggtagggtttttaaagatgggagagactcaaaaatgtgtgtattctaaagggggaagatatgggaagatgttgaagaaaatctaaattttgtactactgtttgtcattttatacatggattctttttcactaccttctccttttttttttttttttttttttaaatgagacagagtctcactatgttgcccaggctggtcttcaactcatgagctcaagtgaccctccctcctgagtctctctgagtgttggaattacagccatgagtccccaggactggaccccttttgttttttattcctagttacttttctgctctttttcctctcagcctccctcactcttccctccctcgctcgctttctgaggcttctgacaactcatctattaataagtttcttacagtcctgtccttctggaagccctcagtgccacatggaatctggacctggcaatttcttgctatccatttaggaggagactgttggtgtccattggtcccatttactcatccccggccatgtgttagctgtctgtaattctgtacgttgttgctacagtatttatatatgtcaagatgtatctcacagcatcttattcaccctaatattagtgaaaatattcactaatattttcagttttgtgcttaattccttgaaggttttgggatttaagcccaaccaatttctgcgaagagcagtagcataggaaattaaacacaaaaaataaaagtttaatttagaactgccctaaagccaaattgggaaaatttagtcactgttttccggtaagtacacagtaacaggtgttttggatggggagaggtgagcactataaagatgtctctgcagttctgaaatttccttttctgctttttctttccctcttcttcctcctctttaccctcctcctccttccctactcagccagtttgctatcgagtgtaatacccatggtagagaccaggatggaagctgaaacgtgagagaggtgtgtatgaatggttggtttgggtgtatgttcacattcatgcgtggagctcagtgtgatggaggtgggtcctgtaggctcactggggacccttggcgcagccccgttcacatggttgctgtggtgctggactggccactgggactctgccctcaggcaccagtgacccctgggggtgggtcatctgaccctttctggacagcgtctgcttcctgcagcttgtgtgcctgttttccagagatgggagctgtaaactgtgaaagtctagggctggcagctgccacggtgctgcaccctgcagaagatctgctttcagcaggagaggctgaggcccacgggaggaggcagaaatggtagctggtcccaagctccttagctataaccatttttctgcccttcccatggcttcagtcttcagcgtttccttggattctttgaccaaaaacaaccagtctatctccctgtttctctttgcctctctttccttaaggcagtccaagttggaatattttcacctgcagctgaattaacatggatgccttccttatccttaacaaggtttgtcttgaatggaaaataaatggggatcacatttggagccagtggtccctcgctagcttttcatgtgagccacacttagaagccgtgctagggccgcaggcgtgctggacattcgtgttgttccagtattcaccgctgtgtgctggcaggatcctacctggaggttctggggactgcttccccatcccgcagagtttagcgttgcccgcaggctcataggtgtcaagaaccaggtgagagatagcacctggctcagcatatgatgtggtacttttttctttttttttaggcagggtctcactttgtgggccaggctggagtgcagtggcaggatcttggcttactgcagcctcgacatcctgggcttaggtgatcctcccatctcagcctcccacatagctgggactaacaggcatgtgccaccatgcctggctaagtattttttgtagagacagggtttcgccatgttgcccaggcttgtctcgaactcgtgggctcaagcaatctgccttcctaggcctcccaaagtgctggacttacaggtgtgagccaccacacccgaccatgtttgttctagaaaaataaagctcattaattacaggaacatcgcagcttactgcctttctcactagcagccatgacgtgagctcctggtagaaatgaatagctcccttattaaaactgactggtcttaagtgtcacatcatgaagctttggatctctttccttccccgcagtgtccctccccgcacaacataaggaaaacctttcttagtccttcatatttggtgcttgggtgctaagcattacagcgctcttggctatccagtcatgcccataagccacaaagtgtttccctgtcaactgggcttcttctcttatcagagccaaggtgagaagccactgtggcccctgagagtgggctcaggaattctcggttttggcttgctattaatttgctgtgcagctttgagctatttacctaacttctctgttcataaatttgctacttatgaaaagtgcttgaaagcgaagttcctagaggctcttttttcctcctgacctgcggtaattttaagtgctttcttgtgttacgcttagcactttctctcttcccgtcaaaattaatctcctttcctcagaagctgatgaattagaactctaagccacgcttctttcttgcatggtctcacttgcttttctcccccatctttttctctgttctttttccccttgaggcaaaggcagagaaagaagatggaggcctagcagacgggttgctaatacagttacgacattctctttctcagtctaggggaagttactctggcaattatgaatccatatccctgcctaggaactaactttatcccccttattagtatttcatttctatgggatggcttcttgcagattttttttaaatcttttttttttttttcctgaaatttcttacagagaccaaccctgttttcactatctgaatatttgaaagtatagttgaaactcaggcagtttggaaggagaaccgtgctgtggtttcctccaggagccgaggttctttccacaggactgcacatgggccttgtgctttgtggactgtcagttctgtgtcagcctgcagctgtctctttttaattttgttgtgttttttagagaaggtctcactctggagtggaggctagagtgcagtagcacagtcccagcttactgcagccttgaacttctgggctcacgcaatcctcccaactcagcctccttagtggctgggactgcaggcatgcgttaccatgcctggctaattttttttttttttttttaatttctagtagagatgaggtctcgctatgttgccgaggctagtcttgagttcctgggctcaagcgatcctcctgcctcggcctcccaaagtgctgggattataggtgtgagccaccgtgcctggccttggcagcctcatcttgagtgtgaaatttgtttacagcttttcttgctaaagactagtgtttcttaattaccatgtgcaaggtcttccataccgcagaaggctgttgggcaaggcatagtccagataaactgtcttgacagagaagtagcaaacgggaaacaggctgaggttggatgctagggagatgcctgggcaggatgtcacaacatggattaaaatggaggcagggcagggcagggccacaggccaagccaacacagcaggcctgtctgggctgcacacgtggtccagttggagggccatccacagcaacagcaggaaggggttgatcaggaggcatcatataagaactaggcggatggggcagtggctgattccacgtggaggggcctgctctgaggctgctggtgttcctttggtggtcagaacctggcatcccatagctgacttctataacccacgtgccatttgggcctcctgctccttggcttagtccctagttcgttaccatgggaacgtgaagctatccttaatatttctctaaattctggagtgtgtgtgtgactcggggagtttgtgttctcatgattacttccgcctcaaggttcgggcatctccagatgctacctctttttcacactgaattgactccttttcatttattttttgagttggagtcttgctctgtctcccaggctggagtgcagtggcgtgatctcagttcactgcaacctccgcctcccgggttgaagcagttctcctgtcttggtctcccgagtaggtggacttataggcgcccacaacgacgcctgacaaatctttgtatttttagtagagacggggtttcaccatattggccagactggtctcaaactcctgacctcaggtgatctgcctgcctcggcctcccaaagtcccgggagatgggattacaggtgtgagcccctacgcctggccaatgtaaaggaaattgagggggtacccagattcgaagcggggacctcttgatctgcagtcaaatgttctaccccgaattctaccccctctgctgactcttgtctcattttctatcaaaacctcatccatggctttggtggctcatgcctgtgtcccagcgctgtgagggccaaggcaagaggactgcttgaagctcagagtttgagactagactggacaacaaagtgagacccccaacagtacaaaaatatattatgcaatttccttggtgtggtggtgtgcacccgtagtcccagctacttaggaggctgaggcaggaagattgcttgagcacaggaggtcaagactgagtgagctgtgatggtgccactatactccagtctgggtggtagtgtgaaaccctgctgctaaaaaatgaaaaagccaaacaaacgaaacaaaacaaaccctacaaaacctgacccataacacaggtgagaatgtcctagactttcctgaagactggggaaggagtgatgggggaggggccacactgcacacatcacggaagggggacctctaaccctggttattcctgctgccaaggcagcctcatttcacagcttctccctgcttgagggcgaagctgtccaccttccttcccagccctccttcctttcgccctcctaagaaaacatacgtcatcttttctcccacaaaacagatggagcacttctttttggcgtgggttctggctaacatccgtgcactaagggtctcatctgttacttccaaatcctaccaagttgttttctcaagcaaagatgggactttttgaacactgacctcgcattaaattgtgtaaccttggaggttggactacatgtcgaaccaaacaggcaagaggaagtggtgaccgggcttgaggggtccctctctgtgatctccattccggtgtgctgtgaccccctttgcccatcacacggttgtgtggttgtgttttattccacccgctcctcgtgtgaagggggcactgtgttcactctatcaccttatccctggagcacccaccaaagtgccgtgaacagagtaggaattcaatcaatatttaccgaacgactagatgtgctcagcacggtgctaatggatgattagaaaagttaataatctcagctcttaaggagtttatagtctagtcaggaagccaaaaataacacagatgagaataattaagcctccaatctgatggcactgactgggggtgcatttatcaagaatttggaagcacgtaaccatacttacattctttgttgcatacatagcatttaaattgtgactctcatccaacttatcactcagatacatttttttctgtgttaaaaatataaagccatatttccagagatttttaaagggcccaaaagattatgaatttgatcttaacatcagcagatgacaatctagttttaacaagttactttgaattagtcaaatctaaaactcactttagatttgttttctggctaatattctaattgagagacatttccatggaggtattaggttaaaatactgtttttagatatgtgacacatttccctgtattttagaaatctcttgggtatcttaagagaaatttaatccatctgattttgatccaaatataatttactcacaatgatggagaaatatttgatatccacggaaatctattgatgcacttaaagtttttctccagggaaataagaaatcacattttttcaagggtgaatcataaacctacagtgtctaatttttctgcttatttaacaaaacctgagttaagtatcaaattgggcagttccagatcatttgtttttaagttttttagtcttttaaactatgcagaggaaattttattcaaagaggtttttttttccttattctgacagttttatctgctatcctgtttttttccctaaacagtgatttttgaagatttaaggtaataacacaattttgatgtctgtggattaatggcgtctgtattcacgatgtttcagacctgtcagagcttggaaatagcatttaaatgtattgcttaattttaattttaaaatactttctctgagaattagatcccagtcctaagtgagtactttgaatttcaaagaggggatttaggccaaggtacagctaaattttgtcctcttgaaagacctgaaatccatttacaaataaaattgaggtcttcgtatcaatattatgttttggaagtgaaatgtgcaaggacttgtgcagtgtcacatcttaagaggctgttgggtgccatcgggagtcgaggcagggcctggcatttcagcgaccctgctgctccacatgctggttatggagtactctccgacttgtccacgcttccaagttctgatttctggcctcctgaggatggtggttttcctagcgcttctctttcacagtaggttttgcatttctgacctgggccttagcctctttctttaaggtttgccttctggccagatccctgggcaggggcccagctcctgctttgcggccctctgctgcctgcagctaatgacagtgacccctgcccggctccactgactcataggatctgatgcttggatcgttgtaatagtcttctggtctcttcttcttttagttcatcaaacagatcttaaccatgtaaaccttcgtaaatattatttcatgtggggattggctcaattttagcgggtgggtatacaaactggagacagactacctgggtttagtcccaaccctgaaatttattactctatgatcttgggcaagttacatgaccttggtcaagctagttaaggtctctgtgccttagtttcctagggtgaaaaatggggttgatgataccctgatgagaggtaggtattattttatgaagattaaatgacacagaaggagaagcgtttagaacactgtgtggctatagtaagtgctaaataaaattagttattacatagattgccctatccttttagaattttctgttttagaattttagaatgtttttaatcttcagtacttgctatcgtcttttttaatagaaataagtctcgagtttagaggtagttataggctttgcgaattgagtaacattcttttattttttaaaaaatttattttttcagatgaagctggttcccctttatatttaatacaaaatttcctttaaaaatctaggttaaaaagaagtgagtttaaaacatatcaactaaatcataaataaatcgtactatggttttaaatatggcaaaaatcgtgaacacagtgctcaaatgcctgaagtttgaggaaaatctgtgaggggtgggtgcttcgggcctctggtaggtcttagctagcctggggctcttcctgccctcctgtgggcctctgttttagccagacagcccactgatgactgccacatcctgagcattcctgcctttgggtttgttcttgagaatacccaccctattccacgtttctgatttccactcatcctcatggccccatttgagatgaacatcatctgtaaggcctccccagtgcctggctccaggcctctcttcttcctccaaactttgtcgtgctcaagaaagtgcctattgtgtgtatttggcagtcatttcttgccacgtgatatctaataacttccatggatctgtcctgtttctgcaactggaagaagatgagcggaacctcttttaggtggggacagtgtcttagtcatctcaatagccccttgaaggcatgatacggtaccttggatggtttctatgttaatattttctgttatgtgtccatattgaggtatcatttatgtaccacaaaattcacctcttctaaagtagtggaatttgctttttaacaagtttgtacagttgtgaaaccatcaatgctgtccagttttagaacactgtcatcacccccaaaagttgtctcctgcctctttgcagtcagtctgctcacctgcctccagctaacaattgatctgctttctgtctccatagttatctttttaaagataaatttcatagaaaaggaatcatccaacatgtagtcttctctgtatgggcttttccacctagcatagtgttcctgtggttcttccatgttgttgcacttactagtaattgtttcattttattccttagtggcagcagatagaccttgctgctgggtgttcagattgtttccagttttgaggtattatgaataattcttccatgaatgtacaggtctttttgtgagcccatgtcttcatttctcatggatagattttggagtagaaataactggttcctatgatcagtgtaactttttaagaaactgctaaactgtttatcatgttatattcccagcagcaatgtatgaggattcatttctgtacatacttgccaacacttgatattgtctgtctttatcctaatagcctttctagtgggtgatgaggcatgaattgaagatgactcttgggttttcaggttgagcagttggatgctggtgctaccatttaatggaggttgagaaaggaatgaaggtttttgagaaaaagtcaagaattctggtttggccaagttgagtttgaggtgccagttagcctttgaagaagcaccgttaagtaggaagttggatgtatgagggcacctatgttaattccagctttgtgaattcattaaataatgaaacctgggatggttgcttgaaatttttctaccctatatatgaatctgatggtctggacaagtcacatagtttcggatgtcagtttcctcatccataaagtaatacctattttcctccaaagcttaggtgaggagtgaatgagttaaagagtgcaaagtgtttcttattgtggcggttgttattaatacgtgatttcacttttcatttatttcatttttatgtccattgtggcttctaacctcatatttcacacatagcaggtactcagtaaatacttaataaatcaatgaatgcaagtaatgactatgtatatactagtggagaaggaaggaggggagggaaaggagaggagaggcgaagagaggtgggccaggcagaggagagaagagagggagggagagggagagagagagggagagggagagggagagggagagagagaatgagaatgagaatgagaatggatataatttgggttggccttaggaaggagggctctcagaattccacactggagctttgtgtaaaggaagtttatcttctatgacaccagggaggcaacatggaagacatgattttgggagatgtttcaataataagaattgtcacgtgtaaagcatggttgtgtttgcaaagtgtcttatcttcctactagaccttaaacatcttgagggttggagcctttctgatgtgcctctatatttcccagagccttactaatttcagcatactataaatacaacaaatacctataaaatgagtatgttggtggatgactcatgaacaggttgtttccttcctgtgtccctgggagagcatgtctgtgcttctaccacagctcatgcatggcttgtgtttataatgatttgtttgcatgtctctctgtctgtcctgagctccatgatggcaggggctccatatcccttggctcatgcctggcaagtagtggttgttcagagagtgctggagagaattgttcgagtgaatggatgtgtctaacactgaaggaaagcagggaaaggagaccagatctgtgctctttggagtttcagattgtagctctaaggatctaaatttccagagggagagaaagtagggaaatggtccataactcatttgtcttccattttctgtcccgtgggctaggtaggtctgttcttgatatggttgggagagtggttgcctgtctcagtgttcaatgtcagatgacaatattagctcacattgtaaatattctgagagtgccataccctcaaggtttcttgttaggttatttcattagggagtgttttctaagattggcttaaagtaaaggattttaaactttttctaagagagacattttaaatttattttaattttcatgggttctccaaatgcagtagactttttggcaaaatctcaggtaaacctcatacatataaatcacagaaatggaagaattaggtaggtgcaaaagtaattgcggtttttgccattacttttaatggcaaatacttcagttaatgcaggggtgatctaggacctcacctgcttatcatttctttgtcctttgtcaaagccctgaagcatctgggggactttagggctccttggaaggaagtttgaaaaaccccaggtatagaggtagtctgttcattttgacttcctgtttcttctgccactctcaagagacttctgttaagtctgtagaaagacttccccatgctaccatctgtaaccaccaactacgggaaccctagttcactgttggtgggaatgtattttggtatagccattatggaaaacagcatgaaggttcctacagaagttaaaaatggaacttccatatgacccagtaattcctcttctgggaatatagctaaaggagatgaaatcattaccttgtaaagatgtctgcactccaatgtatgctgcagcattattgacaatagctaagatgtggaaactaagatgtctatcaagggaggaactggccaggcgtggtggctcacacctgtaatcccagcacttcgggaggctgaagcgggtggatcacttggggtcaggagttcgagaccagcccagccaacatggcgaaaccccatctctactaaacatacaaaaattagctgagtgtggtggctgcatgcttgcagtcccagctactctggaggctggggcgagagaatcgtttgaacctgggaggatgaggttgcagtgagctgagatcacaccactgtgctccagcctgggcaccagagtgagacttcatctcagaaaaaaaaagtctatcaagggaggaataaggaccatgtgatatatgtatacaatggaatactagccttaagaaagaagatcttgccatttgccacagcacggacggatctaaaggacgttatgctaagtgaaatgtgcagacacagagagagaaatattacataatctcacttatatgaaatatttttaaaaagatctcaaatattaatacacacgtagagaataaagcagtggtttccatgggttgcgggtggggagaggaattggggagatgtagatcaaaggataaataaaaacagatatattggacaaatgagagatctaatgtacatcatgactaaagttaataaaattgtattagggatttttgttaaataagtaaattttagctgcttttgtcccacacacacacacacacacacacagtaactctgaggtgatggatatgttagtctgcttcactgcagtaaccattttgccatctatatgcatcccgtatcatcacgttgtcaaactcaaaaatacacagtaaaatttatttttttaaaaagaacaaagccttaaaagaacaaaagaacaaacctaacaattgcctccttttgtatttccctttttgtgttcattttcacctcctctttgagcttgaatcaaaaggttttgaggccaccagtaaatcaggtaaacagtaaaaactggagggaaaatgcctcatatttgtgaatttgccattgcacattcccatggtcagtgtctgatgtggatatagaaagcagcatcttgtccaaggacatggctaggaggggaaaccacagcgggtagacgagaggtaggtgtttgtcttaggtcattttgtgttgctataaaggaatacttgaggctggataatttatacagaaaagaggtctttttccttcacagttctgcaggctgtataagaaatatggcattagcatctgctggcctccggtgaggacctttgtgctgcatcaaaacttggtgcagaaggtcaaaggagaagcgagcacctgcgaagaaggaccaaacccaaggggcgtcctggctttataacaacccactctcagggaacgaatctattcctttagaaacagtcccgtttcatgagagtgagagctcacttgatcccttgagaatggcaccaatccgttcatgtgggatatgcccccaggagccgaacaccttccacgaggcaccacctcccaacaccatcacagtgggtatcaaatttcaacatgagacttggtggggacaagcaaaccacatccaaaccacagcagcatgaaaggggatgagtcagatcttgggttactattgaaaagggctgtgtgtgcctgctgggattcatggtgcacatggagagcaaaatgagtcctgggaagcagagacttaatgcagcgggggctggctgttaaaattttgaattccctagggcctggcagtgtgagttggaagacaaaaatgactgggtgcctctgggagggcctagcagtccaggagagcagaagctctcagagccagaaccaacagagctggcagaagggagcgatgtttggatggaatcaggaatgctggagttggctgggatggaaccaagaagtcaaaacagtaaggcactagaattagctgggcagattcctgaagcagattcaggtggataagagtttagttaatgtatagtattgcctctgtttaagaggctataaaggatttttgtgagtttatcttgggttgtaacagccgtaaatactggagagatggactgcaacttttaaaaagttgatgtaattcacatgccataaaacttgtcattttattatgtacaatccagtggtttttcgtacattcactttgttgtgcagacatcaccattaaaccgtgaaaatgtttggttcactccaaaaggaaaccccatagtcattggcagtcacttccaattcttccctctgcccaggtcccagcaaccaataagctatgttctgtgtctgtggatttgcttcttctgaacctttcatatatatagaatcatacaatatgcggacttctgtgtctggctttttcatttagcatacttttttcaaaggcccatccatgccattgcatgcgtcagtgcttccttcctttgtattgctgagtaatattccaatgtgtagcccaacaacattgtatcagttcatcagctgctgaacatggggattgtttgcattttggattattatgaacaatgattctgtgggcatttatgtgtgcatttttgtcaaatccttttctgtgtagagatgatcgtgtgggttctgaacatggttctattaatatggtattttacattgattgagttttatatgttggactggtcttcttttcctaggataaatcccacttggtcatggcttataatcctttttatattttgctgtgttcagtctgctagtattttgctcagaattttttcatctatattcgtaacgatattggtctgtagtgctttaaatttttacttatgttcattattcacatttaaaaagtgacaaaaattgtatttatggtgtataacatatttgcaaatatgtatacattatagaatagctaaatcaagctaattatgtgcattgcctcacatattattttttgtgatgtcacatattgcagaatcttatttttaaaggccaaatagtattccgtttaccatatatattttcctcgtttatctgttgatggacacttaggctgatttcctgtcttggctattatgaataatgcggcagtgaacatgggagtacacattgtcttcagtatactgatttcattttctttggatatatgctcagaagtgagattgctggatcatatggtagttttttttttttttttgagttgaaattttgctcttatcacccaggctggagtgcaatggtgcgatcttggctcattgcaacctctgcctcccgggttcaagtgattctcgtgcctcagcatcccaagtagctgggattaaagatgcgtgccaccacaccccgctaatttttgtagttttagtagaggtgggattttgccatgttggccaggctggtctcgaactcttgtcctcaggcaatctgcttggcttggcctcccagagtgttgggattacaggtttgagccactgtgtccggccggtagttctatttttaatttttgaggaacctccatactgttttccataatggctgtattaattcatattcctttcaatggtgtagatggttcccttttctccacgttcttgtcaatacttgtttttgttgatctttttcataatagccattctaacaggtgtgagttaaagggtctgtagtagtactcttgcagtgtctttgctgatattctgtgtttgttttcctgttctttatttcatttatttccactctagtctttattatttcttcattatttaggagtgttatttaatttccatatatttgtgatttttcctttctttttttggtctgtattgagttctacttttattccattgtggttggaaaacacactttgacttaatcattttaaatttattgaggttcattttatagcctaacatattgcctgctggaggatgttccatatatccttaagtatgtacattctggccaggcacggtggctcacgcctgtaatcccagcagtttgggaggccgaggtgggcagatcacgaggtcaagagatcgagaccatcctggccaacatgtgtgaaaccccatctttactaaaaatataaaagttagctgggcatggtggcgcacgcctttagtcccagctacttgggaggctgaggcaggagaatcgcttgaatccaggaagtggaggttgcagtgaggtgagattgtgcctggtgacggagtgagattctgtctcaaaaaaaaaaaaaattctgctcttgttgggtagattgtttggtagatgtctgttggtactagttgatttatagtgttggtcaagttttctgtttccttgctgatcttttgtctagttgttctcacagttgtggaatgaaaggtattgaagtttccaactatcattgttgaattacccatttttcccttcaattattttagattttgctttgtgtattttggggctctgttcttatgtatgtttatattggttgtctcttcttgatgaattaaccctgttagcattataaaacgtccttctttatctttagtagcaagcgttttcttaaagtctgttttgcttgttagtataaccattctagctctcttggggtttctttttgcatggtatatatattttacatagttttactttgaacctttttatgtctttgagtataaagtgtgtcttttgtagacagcatatagttgaattttgttttaaaattttaatccgttctgccaatctatgtcttttaattggagtgtttaattcatttaagtttaatgcaattactgatgagataggatttacttatgctattgggctatattctacgtatctttgtcttttttgttcttctgttactaccttattttatgttaaatattttttcaagtaacattttaatttccttgccatttattttcctctatgtttttgagttatttgcttagtggttgccctggggattacagttaacatcttaatttataacaatctaattcagattaataccaatgtaataatatacaaaaactttgctcctatatagctctgttctattccttctttactcttattgtcacatgttacctcttcatagattgtgtgcttttcaacataggtttataacaacagttctatgcttttgtcatttacatcagatagaaaaaagagtacatttatcccattttaaatattttagaaatgcttaaggatatttaaaaaattaaactatgttacatttattttaaaatacatttatactatttgtaaaatattcacttctgcagttacctttatacttactcctatatttcttcattgatttgatttactgtctagtgtcttttcatttcagcttggtggaaaagttcctttatttcttgtagagcaggtctgctagtaatgaactctgtttttatttggaatgtcttaatgtctccttcattttcaaagaatagttttgctgacatagaattcttggttgacagttattttcctttcagctctttgactatgttatcccactgctttctggtctccatggttttcaatgagaaatcggctgttaatcttactgaggattccttgcacgtgatgagtcgcttctccaatgctgctttcaagattctctttagtctttggctattaacaggttattggttttgaattacaaattcactgttagtctgcccacgtttcatcatccctatttgaagggacagcatgggacacttttgtcagtgctttaattcaacacttgtgatatctctgtagcattttattgatctatcaactttatggttcagtaatatgtggttttgtctttcactgttatattacttaatagaatttcagattgatatttatgtgatccgttcccataacttatttacttaatagatttgttggacagctgtatatggaaggctgtatgcaagactttgagttttcttagataaatgacacatgatcctaattgtgaagatgacacatttgattggcagagcacacaaacttaactaattactatgcaattaggatgaaggtatctatgtgcataaacgtagtagtttggaagcaaagaataggaagtcactgattttcataagtggtaaatgagcaaactgaggagattagatagattagcaatttgagaccttgagttatctaaattagaacgtggcagaatcaaggactagaagtcacttttctgggttctttctatgaaacgatgattctagaatgtggctcttttctatgttcaagcatcataggtaaaaatgatttcttaaaccaggtaagtgtgtgaagcacagactggctattttgcttcaaaaggtgtttatgttaaaaataaaagcaaacagtacttatttatgcttattatattgtattaacatgaattaagtaaacaagtgactatgctggaacttgaggtgtcaaaatatgaaaagatacttgctgttattaaattgaccttagatgttttattttcctttttattgttatttgttttatcaaaagaactcttctcccctgtacatctgtagtaaaattttgaataggtacagtttgtattagagcctccttaaaaataaagttgcagatcaatcaaaactatattcattctccataggataaagcatgacatttctgggcatacggttttaattttaatctgcatgcctccgtttctattctcccatgagtctttgcggcaggacaaggaaaagcaagtcttataaaaagaaatacagtatgtggtgcttattaaagttacatacatctcttctcacaggagaaatttgatttattgcaggttgtgcatatgtcgcatatggacatttctagggaacagattccttattgctgagcagtgaatggcttctagtactccattattgctccgggaacatgttagtaataattatgaaaggtaggataccatgaaatctgtaaggtgatttggcagaagtcgatgctgttggtgccaggatttgggtaccgtaccacggtttcctgttttcaaatgtattaattgatccgcaaaggacatcttttggagacaagaattcagacagactggcacagcctggacctccgccaagactgctcggaaggttgccatactgggagcaaaagagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacgtaagtttttagattttattttattttatttttagacatttatagacattaacttttcaaggagcctttctaagattttatgcagcccagccaggaagtcagagtaaaagttgttttatccatgtgtttaagaaaacgttttcttaaagcaacagcttttatttctgctgcttcatgctgtcctaaactacatcccccagcaattagtgacaacactgaagaccagaaaggcaagctgaagacaccagacttcgcttgaagggcaaacaagaaatgtgagcttggtcattatttttttgtgtgtctttgctctgaaccatttttgggaggtgggtggggaggtgtctatgtctaagagatgtatgcgattagtgaattctcattgtgagaaggaaatgatgaaaggtgatttttatgatgttggcagaaatggctgggaatggtagagaatagaaatttaaatcttttggagaagaagtggtgagctgtgtttgcaatacttggagaaaaatttcttatttttggttgattagattttataattaaacgattactgtagcctggctctctcaaaatgttttaagtagaaggaaaatttagaaagtttaccgattttctttttaatactacctggtgttttacttagatatatactttatatctaatttctgaacaatgaatctttcctattaggcctgattatgattggattgtgatagttctgttcttaaaaatcagcattattgtaggagaggttaactgtaaggcatgtgttactgtggatcaccctgattgtaagtattctgtttttaaagacagtttgacttgtaggattaagttatgacttcctataatcatgtattttctttttattttatatgccgaaagaatacaggaaaattgtatctattcacataagtactcatcattttgggcagtataaaagactgcccctggatctgtgcttttgtttggagtatgtaatcattgatttcttaatccttcgacaataaaaacctgtctatagctttccattattgcgcgccttaaatgattaattgtttcacatgttttttataaaattatagtgacacatcagcaatcctgaaaatggcatttaatatataaatatgattgaaaaatatatgaaatctaacagaggtgtttgaacagttaagcttaagtatgttcttcaactttttaattaatcaacattttgattttctgtaaaatgaaatcacttaacatttatgtgtgttgccaaaatgacaacctttgtttaataagctcctttatacactacgtcgctgatactcctaaaatggacgccaagacatgaaagacatgctgataggcactcggaaggaaatgtttgcctgactgcagtcttcctttttgaattgattacaggatcattcatgcttatactaaaaaacaacaatatatgaaacaaaaagaaagttcagcaaacaagtttaaattgagcttcattttaatactgaccgtcttattgccgatttatatttacttccatttacttcttaaacatttaacataacttcttgccatttaggtttgctaaatatataacttatttaatttttaagtccattttttcttgaagttaaaataatttttgctagctgatttcttaacttctttgcagcgaactcagaacaaacttatatccaaactatttcatgtccaattattttccagcagtatgatcaaaagtaggtgaattaaaaaacaaatatgtcagaatataccttaagaaatattaaatttttcgatactggtaaaactacattttacagtgtatattaaacttaaaatttgataaatactagctattatagtcactgaagtttcttaccaatagaaattctctctggcctacacattacatagcttaaaatgaaagaaaatctcccataaagatgttccttgtaaaacgggtataatagacacgtctttgtgcaagctttttttaaaaaaaagtgtgattaagaagttgcgttgattacatttttttaaaaagacatttagttgtaacataatgcatgcttctttatttttagaccttttgtactacaaacacattgacatttaggttattaactatttccatattagtatttcaaatcttattttaaagtatataaatactattggtttgattgtaaatgaaccctatctcacctcataattatggtcgtttgaattgtataatattttgaagtaaaattattgaggcagaaatgcgttaatatttaactgctacttgatacctattattaaattccattttgatgtatgtacctgaacatacaagcacattattctacaaattaatgcgaacttctcaggaagcgttagtccagtattttataattactcgctcatttattcatttattcaacaaatgtttattgagcactcacttaaatatgctaatattttattgataaagttattttgggtaacggggatggaagagggaatagatttaaaataaaatttaaacgcctagatagaaaaaggcagtactataatgagattaatttcaacaaagtatgttcacttttcttgcacaatacacatattgtagagtgtgattataaaaaatcaggagattagttgtattacacgtagctgtaagaatcttgttttatgactattttggttgttacattttattggccagaaaacttgagttgttcaagtcttctgacagacatgtaaaataagcaattcaaatcagggaggaagaaactgagaatgagccactgctcacatgctagatcttacatatgtcaaagcaggtgtaattgaaccttcgaagacgtggctgcaacgtaaacaacagtggcctgtttatgtgggatttttttctttcctttgttttctgttgtgagacaaaggaggaagataaggcccctcccacatcctgaggccagcatggccctttgaaagaaggtttgctagggggtgtggtatattttaaatggacctatcagttcactttctatattctagtggttcgtgtgtgtgtatgtttgtgagtgagagagagagagagtgcatttaactcagtggcctaagtttattccatgcagttgttctctgatacaaaaagaaggcataggttcatctttgaagaggagataaaagtcacgtgatctgaggagatgtacttgtaggctgctttggtggcccaggcgtgaggcagagctggtggcccatggaatggagatgaggagtgtctcagccgtgggtatacactgctgaggtcattcagcagatactcccagaggacttgctctgtgccaggcaaaagatataattgctgcccataggaattcctagtgtagttgggtagaggagaggataggaataattgatgaatgtaggtaccttttcaggttaccaaataccttcgcctgttattccatgtaatccaagcagccatgctgggcgcagggactggtacacaatggccacttaataagtattcatggaagaaataaactgagtggcgaaccagagtattagcttgttgagtcttatttgactaagagagtgttttttccttcatggatagaaaaacaaaaagtactgtgctttctttatcttgtttctctgttgctggctatgggtttagaggggtgcagcagagggccacattatttgtgaccacattaggctctcttgcggtggccattggagatgatatgaaacaaggacttgcctggtgtggggtggccctggacaccggctttctctctggccagccctctgttgtcttgcattccctctgtcctcattttcccaaagcatcccatattgtactttaggacttggtggtgtggcctgagcatgcagcaggccagtggagtgcccagtgagtttaaagtgtttcttttgagggcaggacaaaggcagaggggatggagacagagaaggtggtgagggcagttgtgcagagttgagggcgctgcccagcaagcagcttcagtcctgttgtagctgcagcactaggggcctttgagggagcaagggtgaatgtgggatcctgggttagactgcaatatcagcaaccgcaggcgttgagagggcataaggtgttattgaggggctgcatggggggatgtaaatgggttgctgaggccagttcatgttgaacatcgtctttctgggtctttgtcctgggaggttttgaggcccaggagagggagaggcagagtcaggagcattgtgtatagttctgtgtccaaggcggtgaggggctggaatttagcctcagctttgctgcccaagccctgtgccttgatctgctgcaggaaggtaccaagtccccattgtgcttgtggaggtcctggggtgcatacaggcttggaactggaatagcaggtattgggagaaggtcaaaggtctgtggccagggagggcagtgttccagtatctgaccatggagtctagggggctaggggatgtgatcagaagtgttctagagaacatggtgaaacaggggaggatgagtaagtagaaatttagatcaagtgaaagaaaaggttttgagagtactggagttaggagtttattctgaaactcatcagattctgaataattgtaccacctctgcaaagctcgacttaaaagtttggccgtgagttgtgctcaggttattttatttctccaaaagcaagcagaaagtgaaaaatgttacctgtgtgtgttctgtattgcacgttatcagaggagatgcacattttcttctcttacagttaagaatctctcagtcttacacaattagaataccccttatgtgtggatctggaggttttgtgcaaaatactgaagaattagtccctctggagtgatgccattcttttatccttgtctatcaatgtcatttatatctcttttcctattagcccttctaagttattgtacctcatctgaaaagatcaaattgttctcaaagacccaggagtgtttcaccttagctgtattcatgggaaatctgcctttgaaacaaatagtcctttaccgtcttgggttagagataatgttcctcagcatctccccaaactgagtttgaattttgactcaattttttggttgtgggactttggccaagttatgtaaacctaatttcttcatctgcagaacagggatcatggtatttccctcacacgattttgggaggagaaataaggaaatacatgcagagctcttagcatagtgtctggtatgtagtaaatacttaataaatggtagatattatttatgttttacaaaattatttttttaatttttagaaattgtgataaaatatgcataacatattttaccgtcttaaccatttttaagtggtatcaggtacattcacattgttatgctgccattaccgtcatcaagccacagaagtcttttcatcttgcaaaaccaaaattctgtacccataaacaataactttctattcttcccttccccaaaccccgcaacagaatcgtggcaaccttgattctgttttctgtctctatgaatttgactacttcaggtacctcatataagtggaatcatacagtgtttgtccttttgtgactggcttctttcacttagcataatgtcctcaggattcatacatgttttagcatgtgtcagaatttccttcttttatgaggctgaataatactctattgtatggacagaccacattttctttctccattcatctgccagtggaaacttgggttgcttctaccttttggctgttgtgaataatggtgctatgaacatgagtgcacagatatctctttgagctcctgtttccagttcttttgagtatatccccaaaagtggaattctgggttgacaatttcttttttttcagcgcaacttcagttgtactcccttcttttgcctttgtgttttctgatgagaaatctgctgtcatttgaattgttttgcccttcagctaagatgtcctttttctctcactactttcaaaatcttgctgtgtccttagttttcaaggaatgtgttatgttgtgcctttttgtggatttctttgggtgtatcctgtttggggctcattcaccttcttgaatatgtaggtttatgtcttttgctaaattgggaaagttgtcaggcattatttctttgaatacttccccaggtgtgccctctttctcctttccttccaagacttggaggatgtgaatattaaaactttgttatagttctaccagtgcttgatactgattattttttaagtctattttctctttactattcagattgcataatttctattgttcttaccttcagattcacctattcttttctctgtcatcttcattctgctgtttagctcactgggtgagttttaatttcggttattttatctgctatgtctttactgagactttctgtttttaaaatttgtttcatgcccatttttagttgtttgtggaaacatgtttataatggctactttcaaatccttgtcagataattccaacatctgtgccatctcaatgttggcatctcttgactgtgttttctcgtttaaattgaggttttcctggttcttggtatgataaatgattttgattatatccaggcatgttgggtactatgctatgagactggattttatttaagccttctgtgttaacaaaccttctctgacactgtgctagcaggggaaaggggggcactccctcatttctgtgaggtgggggagtaggagggtaccttattattggtaggtgagggtgaaattcaggctacccatagttgatactgttatttttattgttagttttgtactgggtgcagtaacctggacagtgtctcagctctgtattccttaaatttagcttatgttgttggtgctacttgtgtttgataacttgtttaatgatagttacattctcaaattagggactgagccttctttaatcactagctacccagagattagtatgtgtttaccactagcacattgaataaaagaatataagagatgacattgtagtttctactttattaatttagaaaaattatttttaaaaggagagaatacgctacctgggtaagatttccatttttttggttattaacatgcgaggttttatcagacttttgcaacttatttttagaagaggtcagtatattaaaaatagtcagaagaaacagatttgactgaaggctttaaaaatgtcagtgataaagtattctgtttcatttgtgaattcaaacctgtagcttcaggacagatcttaaagatgatgcatgtaactttggaataatatattgtcagggttcttacgggtcatctgtgctgtagcattgacagtgagatcccagttttgcatcacttactaactggataatcttgggaaaatctccaaaactctaaaggttgacttttcctataagtgaagtggctgtcataataccaatatcaaagggttgttcagaatattaagtgagataatgtgcctgaaagcaatttagctgataggtatcataaacatgggagacaattatctagttagtttctccagacacatgaggatgatggataaagataatgtacctaattctgtatgcttttcagctgtttattccaatagactgttttatatatatatatatttaaaatgctttaaaattgtgtaaatatcgaagaccttcaaatagatagcaaagtattaaataaagtagaatgaatacccatatacccattattcagaagtgacaaatgccatatttattttcctcagatgttaaaaaaaaaaattaaggatataactaaagccttactctctctcacgtctgaaattggtgtagaacactttcatgcacatttttctggaattacagcgtatacatgtagccataaacaatatattttacatgtttaaaaactttgataaaatattttaaactgttgctatccttttgcaaatgaaattagatatttctgagcgttatctctattgctaatgtgggtatgaggctgtagagtgtctcattttagcgtagccattcttctgtggatgggcgtttagggatctgctttgtgctacccatgctgtcatgaccctcctacacatctgggtgatctctagaggaggacttagaaatggagcccagtttctgaatatttcagctttactcagtaatgccacgccattctcccaagtatttgtaatgtgaacccaaaagtatctgagacaggtctcaatcaatttagaaagtttattttgccaaggttaaggatgcatctgtgacacagcctcaggaggtcctgacatgtgcccagggtgatgggggtacagcttggttttataccttttagggagacgtaaaacacatcattcaatacctgtaagatgtacactggtttgatctggaagggcaggacaacttgaatcaggggcttctaggtcataggtagatataaaaattttgattggcgactggttgaaagaattatcctcaataagaaggaatggctgggttatgctaaggggttgtggagaccaaggttttatcatgcagttgaagcctcctggtagcaggtttcagagagaatagattgtaaatgtttcttatcagacttaaggtctgtgttgatattaatgctggcctgcttttcctgaattccaaaagggagacggatataatgaggcatgtccaaccccccttcacatcatagcctgaactgggttttcaggttgactttggaatgcccttggccaagaggagaggtccattcagatggttgagaggggcttagaattttatttttggtttccagtacccatttatattcctgtgctagagtatcaatgttcttgtctcactgtatcttcaccaacagttggtagtaccagactttaaaattcttgtcaatctcatgggcaaggaatattttgctgttacgtttattggtatagctgattacttagtgagattgaacatcttttaatattggtaatttagatttccttttctgtgcattctgtattcatatgctttgcacagtattcttttgagttgttttattcttgctaatttgtatcatattaactaatcctttgttatgctcatcgaagataccttctcaatctttttttttctcattttccttatggcaactttggaaattaactatggaatatgtttgaaaaattggaatgttttcatttttcattttcagaagtgattttagtaataatacatgcttacaatccatgctttccgatgaggcagagagggctaatgggactaatttcttagaatgcatcagaattttatctccttaattaacatctagaggaaaaagtttctcattttccatgtaaacttttggtcaacttgaaatgtcaggcagattcttagtccccaggcatccatcattgaattaaagagtattgtggagttttactctattatttgcagggactgctatagcacaccgataatgtaggcacattcccattgcatctgcaatgttaccaaataggagttctagggcccttagaaagaatgttctgttgatctgattatagtgctttctatacagtgaataatctcggtgcaataagcactttctccttcccctaaccagtagtcttgctaacaaaataacttaattgagaaatgcacactgttggggcaagtggattgagttgtggctgaggctccttgtgtatcttttgttgtgcaatcaagtagcacttattcaccgactttgctcatgctgtcccgtctaaacaaaacccacctaatcttccaaatcactttgcaaaacaaaagaacacacagaagatatagaaaccaggaggaccaggcggctgtggagtattttaggcagcactccctctttccctgctagtaaccatgtatatgaaattgctttagtaattatacatctgttttaaaattggaatcggaaaggatactctttccacaatcctataggaaccctccttggttgttcaaacatttggcaccactgcgtgtctgctgatggtttgccacagtcataggtgaggttctgggcagatattaacagctgagggaagagtgggcttgcaaacccaaacgtggaagtcagaccttgaggtatggttctcacagacttgactttcttaaggacagtggccatacgctttgctcagtcaattccagttggccttattgtactcgtttgccatttactgcagggagtgagcctcccttcagcatataggaaccagtgaaatgtcctctcattggctagctttgatatttccttctttctccacttactgaattcttacctggaatcagcatttggctccagtcaccgtctctgcaccattcctctactgtttaaaagttttaaggaaaacttcaataaagagtatatgaaaataatgactgttgtttaattacaaaccctgttttctctaggttatctaagtcagtgcaactctgtgagagagactggcagacacacacaccacacacgtttcaggtgaggaaatagaggcccagagaagtgaagtgcctgggcttgttagtagcaatgctagagtttaaatcaagtcctctgcttccagatttgttgtgcttcttgtgatttcacatttgttcactctgtcatgggaccaccaggagaatatagtaagttggtgcttttatggtagcctctccatacacccttgggaatgtgtccttaggtcattccttctgtctgctacccacccacctacctacccactcacacacccacccacctaactacccacgcacctacccacctaccccttccctccacccgcctacccctctacccacctacccattcacctaccccatctatccaccttcccacccacctacgcaaccatctaccccatccgtccatccatgcagctgtcagcccattattcatttagtctctgagtccctcagtgctgagtgatgaggccacatcatggatagaacacagataaccgctgccatcacccagctgatgatacagtggtgaaggactacagatcagtaaatgtggccaagcgcagtgactgttaggagaggagaaaggatcctgcttttcctcaccttcttgtccctctgcaactcagagggagaatcaaaattcacattttttagagaacatggatctttcagaatatgagagtttcatgagtgtttttttttttaatttaacacttaagtatagcactctgaaaaataaacactctagagttttagtgtcttagaggtcatttagtttgcctccttgtaaccaaaccgatgaaaatctccttttctgacctcctgagaaatagatgctagaatctctgggcagcagtccttgtggtactcgtactcagtgcctagcaaagaggtccataatgagatattctgtgcgtctctgactcagaacattcctgtttcatcttccacctggattccttctaatgcttttcaataacagatcagtgtagttgagttttgtttagctatttctgtatgtaagcatttttaaaaaaggaaaaagaagcaaaagaaaaccacaaaaacccaacatgctgtttaaataaagaaaaatgagttttacttccaagagagctttcgtcattttcttaatgcttattctccttctgagagcttgttatggaacagagtgtgacagtagtttaccgtggtgagcctgtcttgtccgggccaggggatgaattagagcactgaaaaaggccagaggagtgggcagaactgtacctaaattatccccggatattgctaagtgattctactttttaaagacctccagagagagcatccctaatctcctttagtttgcctttacagtgtttaatgacctttgctgtcaggaaattcttcctcatatttaacccagctgtcccttcccaccaatcactcccatttcttttgttgtccttggtggtgacagaatataggggtcgttgtcttcttgataatatacttaatgttcctgaagggtatgagggaggcctcccttagcccagacttctgcaagtgagagaaatataaattttttctcctttacacccccgttctcagtggttctatttggacatataatctctgacgtttgttcttaagtctctgttgcaaacattcacatcaggccttcctggagatacccattggttccattttcactcacagggcaagatcctttcatgatttccctggctgttgattcattcacattaactcctgtttgttgagccctcattaggtgggaggtaccaccctagtggctgatgggatgtgaagaggagtgactcccactgacttgcacctagaaggaggagcctgaatgtcacctgccagttacagtccttgcgatagtctgtggattagaactgctggttcctctcttccacaaagacttttttttcctgatttatattttggtacatttagagtttacattgaccccatcctcagaaagttaaggcactgtcatattattcatgccctcttctcttgattcattttataaacaccccgaggaagtttgcacgtagaaactttggcctgtgagcaattggcgaggctgtttcccattagattctgtgcagtcctcacgagggggtgtgatggatctttgcaggtctctagcacttatcagaaatgcctggcacgttttaaacaaactaatgactggtggttggttgtcaaatgagttgttgggaaattttttttttttagttctctgtctctccactccttttacctcaacataaaagcagcccagagcttctgcctggctgccaatgtaggcagccctcccacctcagctgccaagctcttagcagatgaaataaaagtctatttataactggcctctgatggatttcctccctacctgggctagtgctccatcagcaggtgtactgaacagatggagaagggttttaagtttttcagttcaattagatcaactctctaggttctggccagcgcattccctttctcacttagtttcttcctcttggcattaaaattgttgagcatagcaaaacacaaattaagtccaggagataaaatgcatatagtgcctgcctttaaaaaaagcactttggctcaggaaccatatttgacatcatatgctaaatctgttttaacccttttttacctagtgcttaattttaatgtgttttaaatcaatattagagtactaagatgctaaagagcacaaatgctttctttttttacttttcttttcttttcttttttttttttatttggagatggggtcttactctgtcacccaggctggagtgcagagatgcagtcttggctcactgcaacctccatctcccgggctcaaacgatccttccacctcagcctcccaattagctggggcaacaggcacgcacctaccacactcagctaattatttgtatttttggtagagacggttttaccatgttgcccaggctggtctcgaattcctgaactcaagtgatctacccatcttggcctcccaaagtgctggaattataggtgtacgccactgtgcccagtcttttttcttatgatgtatttttagcattggaatttaagtgttttgaaactatatcacactgtttttgaagaaactttatttctgatagtagtttagtttatatgatgaagcattttaatgaggagatgaagtcattcatttcatgatggttgtttgatgtctttttttcacagtttgttgaactgttcaggacagtgatcaagtgataccacgcagtggtccaaaaccagtctgaatatggccttaggctctgggttttaacaccgctagtctgtgaaagatcagttgccacagtttttggtttccacatatgtaaagattcgtcataattagcaagttcacccttagtaggctgtatcacctcttgttccccacatcccagatttcagtccgtccttggctctcggatgggaggccactctgattgcagccacagttcatgccccacacagacattcactgagcctctgcccagcgttctgacacagacttccacaaggcccacatctggattctttgtccacgctaacaccatcacatttaattaattaatatctttgtgaagctgggtttgaaacaagaaaggtttggactgtttcagtggatgttttgttcatataactggagcaggttttctttggtggttttattttgccccattctttattatttctggatattttcaagagtgtggattatccagatttgtggcttgttctccagcctccctcccattttgttacccactaagatgcatatcatggttgtcaggggccaaaggagactccactgagtcagcctcactgctggctggaagtggggtgcatgatttaagttaggagaaacagtgcaaacaagaccaccgcttcctatttgtgtcattgtctggcaagtgcctttgaagattttctttcattgttttctgtactttttcacagactctcatatttggaggatgagttaaatattacctagaaaatcacttctctgatccttcatctccttggcaggatctgtgtcaaatgtcttgattttcacagtagtgatcgcgctttctcccaggctggctgacctgtgctgtctttggtaagttattctgttgagttgtggtgctgcgatctttctatccattactttcatctgtggcttctcctttaaccttttggggtcatacagcacaaaatctaatttcgacacgtggcagcctttcacatatttcaaaaatgacccttctgtattccaccaatcagacaggacatggttcagttacatggtttttctcctaaccatctccagtctagcaatttctttattgtggagtgggatgcaaaaaggaaagtcacatttttatgtaggttctgtctgacaagtgtggaaccattactgacctagttggaggtcaaggaagtgtcagaacttcctgtgtgcttgatttgaccaagtgtagcatcttagtctcccagtaggacaaaagggtttccgtgttatccagggacggggtggatcaactttgatcatttggacctggctttggtcatttcttggtacccattacatggctgggtgatggcagtccatgaatgtgtggagaatgatgtcaaacagggtgctggatgacaagttcgggtctccagagcacttatgtggtctgtgaacataaatcattccattcagtcaaacctccacccttgccccctccctcattgagatgctacaccactgcgtcttctctctcttggggccacttattcttgtcttgtttgtgaaagccaaaacaataggatgctaggttcttgaggcagataaaatagattcccaggttaactccatttatgatttgtcgatcttttcccttcttcactcctgcagtaagggaattatcatagggagggaccatcagacaggcctttttggggactttttcttatatagcgttaacacatttatttccaagtggtttaaaggcaaaatatatgaatgcctaggtattttgagatctttcagaaaatagaaggaatgggaatgttcttgttcatgttattgggctagtattgcatgagaagagcagtcaaaagcctaaaggaaatattagcagattgaatatcagtttttagagagaacttcttttggttcacctgggtagctggtagcatgctatgtgctgtgagatggtcacacacgctgtctcatgtaggtctcacacaactgccctgtgaggcttacattctgtcattaacggaggaggatggtgacactcaagtggggaccagctggtccttgcagcagctgaggtcataggcgcttcttcctgatgttgggtttttgtggctgctcttggtgagatttatttaccagaagtttgtcttctttatttttctttttaagactcagttttttttttgacttagttttaaattccatttgttaatcctaatagatagtctttgttctctaattttgtagtcacctctgacacccaagtcccagcttttatccacagtcctgcgctgtctccttattttaaaagagcaactcaccacaatcacgtagggtttattccagaaacaaaagaatagttcttaggaaagctagtagtgtaatacagtctattaattcattagaaaagagactgaccatcttgatagatatgcaaaagccatttggtttgattcaacacctactttttcttaaaaataaagaaataaaagctgttggtaaatgagatatagaaggctacctctctcacataatagagaatttctaggaaaagctgttaacattcttactaaagtcacggccagttaaaaatgcctgccacagtcacagttcttcaaccttgttttggaaattgtagctaatgccattaaacaatataaagaaataagaaatacaaatactggaaaaaggcaagagtcattatggtcagatgctgtgattacatggaatactcatgaaaggatatttcttgagcacctactatgtgctaagctccctgtcttgtaaaacttatattagggaagacattcaattaaatatgcaactctaatgtagtgatataaattccacgacagagaaaaacacagagacctatgggaacatgatagccatggctttctgagccctgcaggggtggggttggagaagtttttctctttctcaaacttgtcaagctcatggtgacctcaaggcccattgctgcagccattccttgtctgaagagctctcacccttgaacttttatggctgccttctttgactcagggggtctgggctcagttgtctccttttcaggagaggtcattcctgaccaccccgtctaacatggctccttacccctgctggtccataacagtgtcacccctgcagtgacttctgttggctccttgcatattctctgtctgcagctccatcacctcacaggtatcctccaagagcgtagggcttgtcagtcttgttcatggttttatcctcagggtagagaactgtgtcttccccctgtaggtgctcactaaataatttgttgagtgaatgtgctggaagacaggaggtggagacaggatatggtgcttataggctgccccttcaggaggaagcagagggtggagccctacctgggctggggaggcatggctttggtgaagacaggtcttcttttttttttttttttttttttttttttttggaggtgtgtgtttaaatgctgagcgaaaagttgatttgggagatctaaaagaagggggaagggaggatctatggcagactgggataaagggcacaggggttagcctgaaagaggaggggaaacagcttttacctgtaatgggagggtaggaggaggggattgtgcagaactgacgttcataggtttggtgatgggatgttggggaagttttcttctttgaatgatgctattgttgacagtgagaagtggtgggcttggagatttgaataaagtaggtaataaaatgggtactggccattaagaaagagaatgagacagagcagactgagaaatgtgggaggctggttgggtacccagttaaaggtggaagactgttaatttatggtgacaccaatctgtgagttcaggagattgtgcattgaagccttaagcagcccaggtatttgcatgtttttttttttaaaaaaaaagattattaattgtttagtgagatctaattcacatactgtagagttctccattttataattatacaattcagtggttattagtatattcacaaaattgtgtggccatcaccactgtctaattacagaacatttttattatccccaaaagaaactccataccctttagcactcactcctcattctcctcttccccctgtccttggcaattactagttcactttttgtctatggatttgtctattctggacctttcacgtaaatagaatcatgtaataggtggtgctggtcattagcatctggcttcttttgcttagcatggtgttcatggttcatctatgttgcagcatgtatcagtattccattccttttatggctgaataataatccattttattgacataccatattttgacattttatttatccatcatcagttggtggacatttgggttctttttactgttgggttgtttttagtatttggctatctcgaataatgttgctgtgaacattggcggacaagttcttgtgtgaatatatgttttcaattatctgggggccagacgtaagagtggaatttttgggccatttggcaacctatgtttaactttttgaagaatgtccaaactgtttttcacaatagctgcatcattttactttgctaccagtaatgtatgagcattccagtttctctacatccttgccaacacttgttattattattttttaaatgacagccatgctaacgggtgtgaagtggtatctcattccaagtgtgtgcatattgaagatgcacttagattgatccacagttgggattttgctagaaggctctatggaaaaagagaggtcttacgtagctgaggatggtggcaagtggataattgaagtgacgggtcagggattgaattaaagaaatttgcaggaccaaggaaagcaaaccacaaaaatttactaaagggaagaaaggaagccttaaattaatgaaagactcaatattgtaaagatgtcaattctcttaaaatctcatatgtaaatgtaatataattctagcagaaatcccagtgaaaaatttgtgaaggatttgctaaaatgatgattaagttcaactggaatgtttaaatgcatgaaaacactcaagatatatttgggggaaaaacaataacaatgatagggacttatttaccagatattaaaacatactataaaattagttattaaacagtgtagttttaggaatggaataaaccagtggattgctggaacaaaagagaagtcccaggttaacatgaacatgtattatagagatgacattgcctcgtcagaagtgaaaggataatttcataaatggctttgggcaactggcttactatgtcaaaaatgtaaagttatatccctgtctcacatcagctgacagcacaataaatttgaagttaaatatttgtgaagaaaaatatattcatagaacactagaagagtaactgcggtcatggggttagattttgtggaatggaagagagaccagcctcacagcgaagaggccattgaagacttggacagagctggctgtgatgcagccacagccaggaacagtaagaatggcaggggccactagaagctggaggaggcaaggaaagatcctttcctagcaccttcagagggagcagggcccctccagcacctcgatgtttggacttctggcctccagaactacgagaaaatcaatttctgtgtctaagacccagatttgtggtaatttgttgccacacggccctagggaacaatgcagtgactctcagacaggatttgatggagagagtggtcagaaccagtggcgctttctaaaagattgatgccatgagctgtgtttgtctagtctgggcagacaagagatttccattcatgattaaggagggcccacggatctgcgtgatgaatttgaggaggatacactggtcccgcagggcaaggacgtcatcttagtcactgctgtatccccagcgttaagaagagttagaagaggacacagtccacactcaatgactgtttaatgaattaattaataaatagaaaacacacaaaaatgtaaacactatccatttttaaaacaagatactaatttttgaataaaaccaggttgtggtggggaccatagggccagaatagttgccgtccccttcacctcccacttgattcacgcatggtggctcgaggggacagagatgtgagatcgtggctggaaccactgctctgagttggagctgctgaaatggtagcttggcggtctgccctcatggtgcatggcttgaagctacatgtcaaaggaaagcaccatccttgcaaccaatgacactaaaactcaagttagattatggcaagcttgtccaacccgtgggccacatgtggcccaggatgccgttgagtgcatcctaacccatattcataaacttttttaaaacattgattttttttaaattttaagctcattagctatcgttagtgtattttatatgtggcccaaggcagttcttcttccaatatggcgcagagaagcccaaagattggacaccccctggactatagtattaatgcatcacatagttcattcttttcacatagtgagtaaaaagtaattcgtttgataagcaattcttgagcacctcctgtatgctgaacgccatgctacgctctgcggtacagagaacaaagaggtggtccttgcccttgaggcttctacagattgttgtaggctggtagccatctagataagtagacaaatcacttggatatcgtgtgataacatacatgccatcgatagacacctaggatgctgcaggagcacggagcagggtctgccaacacactgggcattgtagattttacatatgatggagttttgagattacaggctcatgcctgtaatctcagcactttgggaggctgaggcaggcggatcacctgaggttgggagtgtgagaccagcctgaccaacatgaagaagccccgtctctactaaaaatacaaaagtagtcgggcgtggtggcagatgcctgtaatcccagctacttgggaggcgaggcaggagaatcgcttgaacctgggaagtggaggttgcggtgagccaagattgcgccattgcactctagcctgggcaacaagagcgaaactccaagatggagttttatttgggccatattgaggcagaggctcaaatgtaggtgaaatggttggttaactgtatggaataatgtgaagggagctgaaaatccatctgcccagagcaactatgcaggagcatgcctgaaatggcagctcatatttcttggcctcatgctttctaggagtcctctcctaaaacagagacgcctctgtcagattcctagagttcttctaagtaggcatgcctactttgttgagttcctaggtttgatttttgagggaagagaagtcacaaaggatggaacatgggatgggggaggagagaggttggagcagagcactgggcatttagggaaaagaatcgtgaagggaaaattcctagaaggggcaacaaacacagcctcaaaaatccacagctcttccctagactgggtctgccaggtgccctgatccagctctctggtcagccgcattctgcatagaaaggggagcagggctggtcttgtccccatggaagtgtgaacttggggctcgtcttttgggagcagagaaaaatagttccttgatatacatgtaagtttctatgtggggtattagaatgaatcctagctgttgggagcatgtcttttacaaatcaaattaagtatcttttatatatagatatagatagtctgtaatttgatggtactgatgagagtgaaaacaatatgtggacttgcccatttactgaaagatcaagcaaatacatttcagggtctttttgatagctgtgagtattacttgctagtattaaaatattttaattttcaagaacttggactctgtttcctttgatgaaccagttaggaaatattgtcagagaaaccctaaatttactctcattttcagtcatgaatgaatccctgattactgtgatgaagaaaaatcctgggtcccaacttccttgcccaaatcaacacaaatgtaacctttcatcttgatcaggagatgctgaaggtagaacataaacaaaaacataagaaaccgttcatcactctgagagaggtttaattttcatcagtcaggaaagatacagacaccaaatcaaaggtgttgataggatttcactgtaaggttttggcgattttcttttccctgggtgttaattctccccttgggctgatggtggttggcagagctggagcattcaccgtggcttttctgattcctctttcccatgttggagtaatgtttttagttcattgcccaaatagccttggcagctataatcagtcactggagtatatccttgattgtaggagagacttgataataatgactctttcattcatttattccacaaacataggctgagtgttagctgcgtgcagtgaaccatgggaagtgctatggggaagcacagctatgtaaatcatggctccaactatgtgcaaaggccccatgacataaataagcacagaagatgtgtctgtacctctgtatctgctttataacctccctgaggaaatgctacaggcctgatccatctctcccctctttaaagactgtcaggggctctctatttcccccaccatagagtccaaactcgagcctagtacccaacattcttcagaacctgaccccaagccatctgggtgtcctcatctcccaccgctccgcccacaccctgggctccagcatttgactcttccccagtgtgccgtgtgctccttaccgctgcccctggccttggcactttctgttctctcctctgaggacgcctggcctcatcttcaacagctggtggacttctacacgtccctcaaaaccagctcctctgttacctccaatgtggcactcttttctaagctaccccaattcccacccaaggcagaatttgtctctaggcttgtgctagaacatgtaggatacaggggttctttgggaagaggacattgggaaggcatatgggaatgtggaatatgggaaggcaacaattcttggctttcctggtccagcccgggctggtctggtcccctccagatgatctcagcgttcatgaaggcaggttctggagacttaggaggagggacccctcccctgccttccctgggacgtggaatcccctgtgagcaggatggatctagggtatgtcttttagccttctgtatatctgcatagacttttcttctgccttctcatagttcatagcttgtgtctacacaagaactctctaaacatgtgatagcgaattaaagccattaactccattatctgggatattgtttcaggtatattttaatattgctgtataatttgtccataaaatgcttatcttcataatgaaatatgaatgggtctttgtccgacagaagacttttgttgaataagatgatggcagaacgctgtaggatcctgctatttgaatcttcttggagtcacattccttagcatctagaggaggtaacagaggacatgtggacgtgctttctgctggcgattaagtcccaggcttgggagtggcttgtagcaggctgatgattgaagtctggagtgattctagcacagaaaagcaaccagggcgcaaggtatttctgtgtgtatttggttcgctgatcagcacttgggttaccaagatgattaaagcacagccttgccctttgggagagaaaaccattcaaagaaatgctgtgacaaaagacacaagcattgagtgatcaagtacagcatgtgcatgattattggagagcaccaggttgtcagtgaagacagtcgtaagggaggagagatgaggtggtgggggagacgtcttataatcgagtagagtactgagaacaatgctggggttatctctctggtgtacaaagggactaccttggtcagggtcctggcagaaatgtacctaagagggataattggagaaagctgaaggaagacactatttacaaaggtgtggtcaggattaagagaaaccaacaagagctggcagagagctttgaagctttaccatgcctagacccaaaaaggggcaagaagagagcaatgacaagtattgaaccgtgatataggagagggtcgccctgtaggaattgtgccctttagtagaggaactcagccactgccaaactgtggaaagagggctgggggaagaaataccgagtctcccatcagtgtatcccattggccaagtccaacagaaaccagagttcaagggagcccattgatacaggtcgtgcaacaggatagagagtggtcccagcagagcacacagagactgtcctgcagaaagactgattaggcaccggcaagagtcgtactcagccatgttgagagccctgctgagcttggaaacaatcactttgtgattgtaccaaataggaaggatatgggattctcattgggtgagcaagagtgctttttctgttatttggaagaggtatcactctaagacctgtaatttgcccatccgtgtctggtttttgacactggcaccctagaacatgtacaaaagggtagtgacaccacgatttaaggaccagctctctgtgtatggctcagtcacttccaaaatactaagctaaaatgttttggattcttatgttttatccagcgttacctcacgtcaattcagttcagttcaattacattcggatatttgctgaacatcaagaatttcttggaactatgctggatgtgctcaggatacccagatgagaaggcatggagttagaatacagtaggggagatgatcatgtaaacaaatcgtataattaaagcgaagcctggtgaatctaatggaagctcttaactgacctgcccttgcagactcactgtgttaattgggaagccttgttctctctccaaacgctgtggctgctgggctggctagcctacatggtttcggcttatttggctgtgtctctgtgcacctgtacacgtccatgatttgcatgtttaccaagagtctcctgtgtgtgttcccaaatcattttatgtcagttgttagtaattaaatttatacaatttaattacgttttaagtgaaccagtgaaatatagatgcaaaataaaaagctttcgtttgcgttaaaattaagtcaaacatttcagaaaaagttaataaagggtagtcacttaaaaaatgccatttgaaatgggtacagataagacagctcctcatcccttaaagctggcagtaaggatgatcttgacaacaataagtttgtcgatggtaggcaaaaaattaagactgtaccttgatggtttctcaatttttctgtgagggaggaatgagcagtgaaatgatgggggtgggagcctgaggaccgtgaagacagcttgaaatagataacttggcaggggaacgggaggttgctggctagggcctggagaaggacttgtgggcagcactgaccgtgcatccacctgaggctggagattgtgatttttgtcatggcccccacctacctaaacaactgtgcaactttcttttgcagtgcttgacaggctgacgtagaagtgcaaaaatagttgcttagagcgatccaggatggggattttgtgggggcaggtgtggcaggggtttaaggggaaacgagagttgagtttgggcaagaatgatttaaaagtgacttaagccttttggccagaattgccatttttcattaatttgcctatgtgatgaacatgaagggaaagaagagaggtacctgctatgttttctttctttcttactccctctccctctctcttttttttttgagactggatcttggtctgtttgcctaggctggcatgcagcggtatgatcatagcttactacggcttcagactcctaagctcaagcgatcctcccacctcagcctcccaagtagctggaactacaggtgcacaccaccatacgcaactaatttttaattttttttttttttggtagaaacagggtcttgttatgttgcccaggctggtctgaaactcttggcctcaagtgatcctccttccttgggctcccaaagtactggggttacaggcatgagccactgtgtaaatgttttgtaggacttttagaaaacatggggttgtgcctttggccacatgcatgcttgtggatctacaagaacagcggtcctgtaactcttcagggaaggggcaccacatatctgtcctgtcaccatggcaaagctggaagggtctgcagagctacccagcatgctgctggtgttgttgtaaccaagcagagggcaagattctcgccatgagaattgatgtacatgtctagcatgtgaagcatcctaagggctgaggtgggttcctgaaacctgtggaggaaaatgctcagtgcaagaagccaaagaaaaaggcaccaggctcagcgggagcacccgcctggagaagcatactttgtgaggatcagcagaaaggagctgagtgtggaagctgtccccaagtcatggcacaaaagtattcaaaagaaaggatttctggattgttttttaaaaaacaaaactgtgatgtaaatgatgaattgtgctctgtggtctgattaggaatgtgagtggatccagagtacagtggggctgaggcaatggaagtatttttttgtgtttttttttttaacttttaggtcagggatacgtgtgcatgtttgtttaatgggtaaacttgtgtcacgggggttcgttgtacagattattttgtcacccggataccaagcctagcaccccaatagttattttttctgctcttgtccttcctcctgccctctacactcaaggaggccccagtgtcttttgttcccatctttgtgtccatgtgttcacatcatttagctcccacttctaagtaaaaacatgaggtatttggtttcctgttcctgtgttagtttgctaaggataatatccgccagctccatccatgttgctgcgaaagacatgatgtcgttcttttttatggtggcatagtactccatggtgtatatgtaccacattttctttttacattctgtcattgggcattaggttgattctacatctttgctattgtgaatagtgctgcagcgaacatatatgtgcatgtgtctatataggagaatgatttatattccttggagtatatacccaataatgggactgctctgtcaaatagcagttctgtttttagctcttcgaggaattgccacactgctttccgcaatggtcgaactaattcccaccaacagtgtgtaagtgttttcttctcttcacaatctcaccagcatctgttatgttttgactttttagtaatagccattctgactggtgtgagatggtatctcattgtggttttgatttgcatttctctaatgatcagagatgttgaacttcttttttatatgattgttggctgcatgtatgttgtctattgaaaagtgtctgttcatgccctttgtccactctaatggggttttgttttttcttataaatttgtttgagtttcttattagatactagacctttgtcaaatgcatagtttgcaaaaattttctcccattctgtaggttgtctgtttactctgttgatagtttcttttgctgtgcagaagctctttagtttaattagatcccatttgtcaatttttttcttttgttgcaattgcttttggcatcttcattatgaaatctttgcccattcctatgttcagggcagtataggttgtcttccagagtttttatagttttgaggtttacttttgagttgactttttctatgtggtgtaaggaatcagtccagtttcaatcttctgcatgtggttagccagttatcccggcaccatttatggaatagggagtcctttcctcattgcttgtttttgtcagttttgttgaagatcagattgttgtaggtgtgcaaccttatttctgggctctctattccaatccattggtctatgcttttttttttctttcttcttcttttgagacagggtctcactctgtcacccaggctagagtgcagtggtgcaatcgcagctcactgcagcctcaagtggaagtctcgatgagatcagggaggagtaggtgtgaagacagtagaagttctgggaggctgaggttggggaatggccctttgaccttgggattgcagaggtcgaggggcttctggtgtgggtggggctgcagccttgggtggtgtaagtgaagtgataaagaccactggatcagaagacatctagaaacatagaggcaaaggggtttcaagaccttctttggggacattgagaccaccccaaactgccaagatttgtgatagataagtggacagggagatcattggcaaagccattgataaatatggtgacagctccaagaagattggcaggcgagagagaggctgaggagtgagtgtggtataatggcatgggcctcaaagggcttttccctaaggagaggggaatggtggttttcccctgtatgatttctttggggcaaaccagacccgtttttctgtaagcacaaaatttgtgcttttgattagcagaatatctgctcccatttgaggaggcatctgtctgctatccgtgtgactcttatggaaaattctaaaagtgactggtgccataattggagctaggactcacttcttgctcctatgattctactttgatattaaataagtttcctttatgagacaccagtcagtaaatagaacaggatgtatggttaaatagctaaaattattttcatcattgcaattatagtatgccttgccatttcaaaccaaatatccacttatctttcctgaaattttgcaagaaatctattattcgaggatgcagagatgatttttttttggttgagttaaacatttttatggattagatatgaattcagtaaaaataattgaattgggtaatatgaataattcatgacatgtaatttcacatcagttctaccttaaaaataaagctattggtttatgtactgggaagatgtattttattatttagaaaggtagagaacattattttggaatataactcactgtatgattaactagatacattaaatagtaagattgaaagaaagtacagaattcaaactaaggtgctttgatgcaattcacctgttccatcttcttgatgaaacactagttgctctgtgtctgtcattagcgattccgcaaggcatgtggtgataagacttccagattttgaggatatgtccagtaattgtgcttgaacattgtaatgggtgtgacggctgccaggtgcctcatttggggagtaggggacaactttctggctaggtcattctttccaaagacatgtactctctgcttcctctgtgtgtagcccagcatactgggacatccatatgactaaggcttggggagtttcttgcagagtggtgtggtggcacagatcaaaatcttggtagaaaagtgagcccaggtagtcacaggcttgacccaagcctggaaggaggagcaggagttagctatggagaagaagaggggagagaagggggacactgaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatagcgggaaccactgagcagcgctgatgacagagatgttctgtgttggtaccatagtcagccgaaagtctctcgtgaaagttttccctcttaaatgtttgtggtggtagttcaaaatggaattggtccacaaaggtattgcacaatagaagatgcagtatcttaaccattgctatcatttgttgatgaccagaagttcaatcacagaaattgataccaatacctgttattactcacaacaatgcgtcatcctttattaggctcctagtgccttttggccattttacactaagacaaaaccactaactgctttaaaaggcgttggtcacaacttttatgatttgagattaatcaaaggcaccgaatgtcagagtctcctacagaactcagccaacttttagggcaaggctctgtacttctccatctttagaaggaaagcagggaaaaccgtggaaatcatgctactttcattctcttcttggaggactatcccctgggtaaaaattcaaggttcttctaattaatacattgtaactaacacattaatgaatactgcctggtgagatgagttgtatcttaggtcacagttgttgaagccagacaacgtgaaagaagatgatgggcaaaatggatggttttagttacttcttttttaaataccgtattgtttttgttaaatgatacaagctttctatgaatgaagtaaaatagtacctgaaatgcaaaggaagtaaaaatcactccaaaatttcatcctctagaacagcagttcccaagctctgtggcaccagggactggtttcatggaagacagtttttccacagactgggggcaggggcgatggtttcaggatgcggctgttccacttaacatcatcaggcattagttagattttctttctttctttcttttttcttttgagatggggtcttctgtcgcccaggctagagtgcagtggcatgatgtctgctcaccacaacctctgcctcctgggttcaagcaattctcgtgcctcagcctcacaagtagatgggattataggcgtctgccaccatgcctggctaatttttgtattttttagtagaggtgggattttgccatgttggccaggctggtctcaaactcctgagctcaagtgatccactcgccttggtctcccaaagtgctgggattacaggcatgagccaccatgtccagcctagattttcataaggagtgcacacgtgcttagatatcttgcacatgcagttcacaatagggttcgcactcctatgagaatgcaatgctgctactgctctgttaggaggcggagctcaggcagtagtgctcgctcacctgccactcacctcctgctgtgcggcctggttcccaacaggccacagcctggtccactagctaggggttggggacccctgctctagagttaactacagatgacattctggcgaacatactaccagacatttctctagaattcataactttgtattcttagtccttcttgcaaactctggtgtgcttggtcctctctgtaggatatctgttgagattgcctagaatttttttttctttactcttcaagtttcttaatttttgccaagtgttccattattggaacgctaagcatgtgggagttatttgtatcctactcagggtcatcgccaaggtctgtttgcaaaaattcaaaaaattgcaacctcaggcataaatgggtacggactatgttcaattttgtttcttctttttacagtgtgtggcttgttttgtaaacaaatgaatacatgaattaaatctatatggagtacaaagggatgaaggagaaacagcttctgagctgtttgtaaccatccttgtttgcataacctacttattattgaattcagttcagagatcatgctggtggtcatcttactggttagctttgcctcactggactagagtcactcagatgaaatgagtggaggatgatacattaatgttttccagagatccttcctgtagcttactatttaacatccaatccatcaatggatatttgatattgggattaaggtactagttatatttatggataaaagagaattgggttaccttagctaacttgatcaaaattcaaatggttgtggttaagtagaagaaataggtaattttaaaatgccagagtttgaatgagtgcaagtaaaggcatgtagatatgaaaacctcatccttttatcttgatggtgttttgaaacttcaagtattttttttttcagacctccaggaagaatggattttttattgccttcacgtggggtggtttctttgtgtacgtgaatgtgccaccagggcagtgtttctcctggggcagtgtttcacagtggggcaagttgtggacccacctgtgaccgtggtgcatttccagagaggagaactgcggatcttgtgcattctctgtgtctccttctatttttcaagagacctttaaaaagtttctgtctaggccaggtgcgatggctcacacctgtaatcccagcactttgggaggccgaggcaggtggatcacccgagatcaggagttcgagaccagcctggccaacatgatgaaaccccatctctactaaaaattcaaaacattagccaggcgtggtggtggaggcctgtaatcctagctgctcaggaggctgaagcaggagaatcacttgaacctgggaggcggaggttgccgtgagccgagattgcaccattgcactccagcctgggcgacaaaagcaaaactcttgtctcaaaaaaaaaaaaaattctgtctaaattccagtgatgatcagatgtgaacataaacacgttcaggatcatatacattgctggatttgccatatctgactttgtctgtttctaggatattcgaaattctgtgactcctattaatgtatcattctcctggggcatcacagctgaggctggtgtaggctcactagtagcccagcctggaaaacaagctactcagcacactcctcttagcttggctttgttgtgtgtgcacttcatgagggtgatgctgcccatgtgatattccagatgtaggtgagtctccagaacggacagcagctacagtagtgtatcttttagagagcacggaagagttgcttaaaacttcttttctattcaactcttcatcagaggtactcttcatgacctcatctattcattcatgcaacagatatttactaaatgtttacgttgcaatggacatagtagaatgaatcatcaaaagcttgttattatatattaggttgattttttccaggagaggagtttaggaagacattcagtctccttggtaaacttgtacatgcctttactgtcagccttacttaaccctttacgctatataatatgctttctctcttaattttctcacgagtttgcaagccccttgaggggtaaagatggtatctcaactcttcgcagttctattttatgcaaatagaggcagtggtggctaattgatgattccatcatccagaatatcttatgcctctagcttctgactgacggagactctgttttttaacagatgatctgaaatgagtttgctgtaggttctttgctgtcttggtcacccctggacatgattggtattctgcatgactatcattggtagtggtagcatggtatcgtaaaggcaaggatgtaaagagaaacaaactcgggcttcagggtgaaaacctttggctctcctacttggaaaatggacttgacctgaaaaatgagaattaaagtctacatctttcagggttattcagaaagttaaatgaaataaaataaatataaagtgatgaggtgaaataatttcttggaataatgagtttccttgattcacccttgagcagacacctgttctcttgccctgcagcctctgatgcagggaaactgagagcaccaagcaggaccttgaggaagagaaggggaagaccagctcaggaggaggcctgattctcatgcaggcttagagcacagcatgcatgggttggactgtgcagatcagaaggggtgggaatgctgttcttacaggcttaggttttctctctttattcctccatccttgagcccctggaggttcaaaaaagcaaagataccagttattaggaaaaataaagacattctgtgtttgtaagtggctgagttgaatctgtccaaaccagcttatacttgtgcaaactctgtgtctggcttgcacagggttgacattcagcaaatagtagttccattccccatatttctcctctctctctccgtaatgataaatatgaatacatacatatctatatataaaacctgtgacataaaatatatagaagcaacttggatattaaagtgtgagtttgtatgtgcacctatccccatccatccatatgctagcagtacctacatcccttggaagtaactggataattggagacatgggtgggatgttgaaggggcatttctggtcatcttaatgactgggagtgctattggatgtatcaaggacgctaaacattcatcagactgtcaggcagtcccttatcctcaccaatagagaatttttctgccccaaatgccagtagtacttccattgagaaacactgtatactgacagtgtggaacatttctcagcaactttgtgaattagagactgctcattattctatcatacaggataacaacttttcaggggaagttatctttaacttccctgtgccccgactaatggtattactcggtgagaatgttgactgcatgttgatccccactgggggattctagacatgttaagctctaacatgtatgtgaatattatttcagatctgagggcattgtgatcattgttctctttctgttggtgtggatgaaataagagttgttgctgcttggatattttcccctccgacattctttcactgggaagctattagacaaaaattgtgtaggctttgtggacaagacatttcgacggaaaaaataatcttggcgtcactatgcacacacacagagaccgcacatacaaagcgattttggagggcccttttgaaattacatagggaaaccaacagtgccagtaatagcacggggctctatttctcacagtgcttttgaaggcatagaaagcaaatgacaattctggcggtcgctaagatgtattttgcagtggctggaaagaaactagcattcttagaggagtccagcaaattgtctttgagcctttgagggcacacagaaagctaatgacacctccgaggaatagccttctcaggttttagatgccacagatgctaaagccaggatataaaacctttcttatagggcctttaagaatcctcagtgtgcttttattagcaagctgagtgtgtatatagagatgttaatggtctgtggagcaagctcagcttgtttttgcaaactacagaactataaaagttatcagaaaggacacattcttgcctattgctttgttcctttgtttcttatttatttccttctctgtggaatgttagggcactgatcatgtgctgggtcccgtggatacaaaggggaatcctctgtggattcttctctctggaagcttgccctccaatgtaggagaaatgtacacgttcatatccacagtgcaaagtatagaaggcaatgacaatgcaaataaagcctaaattaaatggaaatttcgccacagaagaaattacttctagctgataggatcaaagaaagctacatagacaaaagagtggaaatggtatttaactattttcaaggatatgtaggatttgggcaggtagcaattagctttcaggaagaaaagaagacttattgtaggggagggcagtccatgccggggagtggcattcacaaaggttatgagtgtgaagtgagaatagctaaggttagcaggttcgtaggtgtacactcctgaccgttgagagaatgatcctggatttactgctcgttaatgaatggttaggaatcctagtattcacacattgatgtgctacagaaatccctatggagcttgttagaaatttctatccctgggaagctctccataccctgtggttagaagatctcagagatcttgccgtctctcattccctatggccagtgtccaccctgcagccagccactggggactctgtcgctgcctcttcctgagctgggaggcgatgctgggatgccagaaacacacaggagggaaatggagaacacttttctcagaagtataatccccaaatctcctcttaagccattacaataacatctcatattttatttaattttctttaaatggaaaaaccagttataccaaatgaaaacaaatgactgaagaagaactgaatgatgtttataagccttttatatgattttttaaattgagtttttggtctcctaattgattaataaagggaaagacagagaagactgacatgtgttatcttctgtcacagttcagatagagtgaaatgactcccaccttgccaatacaattctcaaggttgattgctaattttaatttatctgaaccgtgcttttcaatgaggtgatattggtcctgatcgttctgtaaattggagattttgcccgaggaagttaattctcccctttcacaaaaaaagtttggactttcagatgacttatttgacattagcaatgttagattcttgctccactgcagctctgcctggccactctctgttctttttgtcactgaattctctgaagcgtgtttgactctgcttaggggacccccatcactaagcctggggtctggttaccatggatcttaggcagtttggctgctatagcagcataccgtaggctgggtggcttcaacaacaaatttatttcctcacagttctagaggctggggaagtccaagatcaaggcactggcagacttgggaagtccaagatcaaggcactggcagatttggtgtctgatgagggctctgcttcctggtttacagatggtcaccttcttgctgaacagagagagagaaagcaggctgtcctataagggcactaatcccattcatgatggatccacctggtatatttaaaagcccaatgacagtcctgtgagacatgtaatagtaataagatactaattgctgtttatcaaatgagccttgtgtgccagggactgtgataggatcagaaaggttaaacagtttacccggagtcataaaatagatgtttaaaatagttgcagagtaggtacacaaagatatgtcttttgacttatctagatggaccccataatgcagaagaacgagtcttggccatttgcatactgacacttgggctagcaggccagaaggttctacaataggcctggcctcaaatatatttcacttgtaataagcaccatatggggtcctgccttggagctgagtcatacaagagtgcctagagtgccttttaaaggcctacagccatccaactcttagggaagggagtccgcattggacttgggtgctctgggaagtggtctggttcctggatcaattgttgatgaggtatatatttcaatcatgttttcccacggactgtggggaaggcggtgagggtggctggagacagggttggttggggagaaggggctgctgttggttgaacattagttacacagagctgcgtgctataaattctggctcactgaatcctcacgaccactctgagacttatattattaatatgtattagaaagaggacagtccgtggggtgctctgcctcctggactcctccgtcaggaaggttgttggttcagggccagccactgcttggctaacgcctcagtgcttcagcgacaaggaccaggccgtgggcacaaataaggtcttaggtctctcctctgtgcacatccaggagagagattttagggatagttcctactggcttcatcactctagggtttaaatctgggctttgctgcctaccagctgtgtggcccttccagcgtgaacctgtccagacctgagttttagtatacccacagtggggaaaaaagacctacatcacagggttattgttaggcttaaaggacgagacagatgcaaagtactaagcatgtggcctggcacaggggaagtgctcaggaaatggtagtgactgttaagactgtgatacttggaggctgaaccttaacaggatattatcctgacctgtcagtttagctctttggatcctatggtttttttttgttgttgttcttttgtttgttttttgagatggagtctcgctctgtcgcccaggctggagtgcagtgtcacaatctcggctcactgtgacctctgtctcctgggttcaagtgattctcgtttctcagcctcctgagtagctgggattacaggcacctgccaccatgcctggctaatttttgtatttttagtagagaaggggtttcaccaccttggccagcctggtctcccaactcctgacctcaggcgatctgcccacctcagccttccaaagtgctgggattacaggtgtgagccactgtgcccggcctggatcctatcttaaaggaatttctgtggtgataaattatgaaatgcctttctcgtgccatccgacctcctgtgttcactctctgcacctttctattgtttcactggaagtgtcatgatattccatgagcacgttggttgctattaccacgtaagacaatgggaaaaaagaagcctccagcttctgggtgtttaccgtttggaaacacagcacaacacttgacattctcagtgctgagctcatgtagaggcagcagacagactgcagatacgtgcctgtcctgccccattagctgcttcgcaatgggggtttcagtttatccctgtgccggtgttgctcccaaacacggtgaccgtggggcacatccatgcctgtctcacataccaaggcactgtcagcatgtgctcctgctgcaggacccttcggccaagggattcatcctgcggcacaggctcgagtctaagtttacccgtgacctgtggtcattctgtggacggcagaccaggcatgactgcacgcctcgtatcagaactcggaagcctggtggtgacaggaaacagtccgactgctttagagaggtattagtgaaatgtctaggagggcagtcttctcctatggcagaacagagcaactagaccaaacgcttggttgaagtatatctttaagtctttgattaaacatgccgttgcattttctgtttaaatgttgttttacaagctgtgttctgactgcaaggtagggtttctaagaaatcagtcccaaagagctcttgccccggagtgtttgttgtgtagcctaggtgggctgtaaaagctagagctgttgctaagggaaccaacggaggaatgtgaatttgtaaatctctcaatcacattaacattttgtgtaatatctgacctcagctttactttaaggtgaagaggaagctggtgtaggaatgatactggtcaaagatcaatgagagaggcactgtcattttagaacttgacactttgtcatcagcatttctatttcactcttgtaatacacaattctttatttctttgtaaaaagtcctatataagcaatacctgccgtggttccccacttttcaggccatgccctctgtgacattgggggttgcctattttatagagaggcagagtggtgaggagaaagtcattcggtgtttttgccgttgaaacctaaatctctaaggtgacaaaagaaatcccagtttacttggcatgagagagttttgccagttccattctacctaaaatgctcttttgctctgttttatataagagaggaagaagtcattttattgtgctgaaaaacagtggaagtaaagttaccaacgagtaatattaatgacttcaattcataatattgggataatgactaatgtgccaggtattatattaggtatttaatatacatgatgacacttaaatttatactatggtcaggcaaaggtatggttcatgatcccaagcatataacatgcacaccagctgaatataagatgaaagcaacattctgtgcattcgcgtgcccctatgctaaatatacttaggttgacccatatgaaattgccatttttatgggcaaagagagccaaatatcggtaattccaagtggttcagcccagcacatgtttgcatatacgcaaactggcagacgcagttctggaattttgttgagacatccccaaagtgtttcacaggcctacagacacgtgggtcttttcacagaggcataacgaaccatgcagaaaggtagaatcctcagatgctttatctaataatcacagaactgaagatccagaaggatccttgggggctgcgtgttgcactgtggttgtttaatagaagtaggccccatgaggtgaggggacctgcatgtcgggtgagttagggctgactgtgaggctgggacttaggcctgtgtggcatctggaacactgtattctatccattttaaattttaggccatgaaagtgagtaacacatgggctgtaacttagaagtcaactaagtgataagggcttgcagtcacgctgggcacagggaccccgggcagagaggagctctgcggtgcagagaggcacattggtgaagggagccaggcattcagccacatggtagaggagggcgtccttatctatctcaactagcttctgctatcggacttctggggagaaagggtttggtgttcaaggcctaacattgcctttcctctcagaaggtctcgttcatgttacacagctttgttcaccctgagcctagcaagctctgagctccttggagccaccattcctctctcgtacgcaagaaacaagtcccagctcgggagcccacaagattaaaaagtgcagataaccagtagccgtatggaatcatatgtcttgacaggagctatggacttgtcctcatttttaaatttatagcactttgaaaaatcacaagtgtgggcctgtacattgtagcatatctcttttgacacagtgggaacgagagcctttacgtcaagggatactggttagatgcaggccttccagaagcttctgcagtagcatcatcacagctgccctgaggcaaggcaggagcccactcggggtcaggggttcaatgtcgggtcccctccttgcaggacacacttcattgctgttgggggtttcacctgtgactgtgtgtcttgccctctccttccccattcttggtgtgtctttgtaaaattagaacttgtgtcttcttctctccacatccctgtactcagtgtccaccctgctgtctgtccagcatggacggcaaatagtctgtcaaacacctctctagtcattgtcgtcatgggcccaaaaagactgttagcctctttaccgtatagatagatcaaatatatatttttgtcgaattctgcagtaacctgtgatgtgcgttggcctgagacaaaaattcgcttccatcctcagatccttgttgtgttctgaagagggcacacatttaacagaacaaagctcgtctgctttgctgggacgatgggtggctcgcccagcaaatcatcattggagccttctttattttgacgtgagttttcaaaaatagcatttctgcttttatttctcgacttaaaagcatattttaaaaaattggttttctgcatttgtgtaatcaagtacaggaatggttttatggttttgtttgacttaggaacgtcttggtgcctgccatttttcacggccatcatctgaaaggttctttccactttcacaagttgttaactgctttctttgagagcaagcaaagtaggctgcctcaaatatacacctggaatcggtatttatttccttattctgtgccctgtttcattccaagattgtggtatactgggaaataagagaattcaatgaaaagggcttctataacaaacgaactaacccattagaaagaactgaccataagcttagtaggaatcagtcatgtgatgttgcagctaaaatagcgaatgctgtggttttcaaacttgtctaaagtgggagaccccacttcctaacagtgttctgatttgggaccttgtgcacaaagtgggcagtgggagtggtgactggggaggtataaggagcttagagcctggatgggtgcctgccctgccccttccaggtaaccccctgaaacttgaaaaccattatgttaatacgttaattatatagctatagggatcccttaagtaaatacaaagttttattactgtagaggcatgtttttatacattgttttatttgaccctgaagaagagaccgcaaaggcattatctctagtgtctgtatttttcatagaaggaaactgaagatcagggagattagtaccatgatcaagagcacacaggtaatgcataaggcagcagggattggaatgtgacttagtttagtgctcatttcactgggtcacaggcgtatatagatgaaataagagccttggcttcttggagctggtcagactctttctggattgttttgttcagtgatgggtggtaaattggagaatgttgagagaggcgtgactgggatgtatccctgtgcagtacagatagaggtgaaagattttaaaatggatatctctttgagaggtaattcattggtgtcagctggtttcaataaaggtgctatctaaagaaaaaggtgctatctacagaaaagcttgaagatgggagggtgtgggagccgcgggacacggtgtggatgtcacagtgaagggagaaggagaagaaagggaggcccaaggcagggcagaatcttgctgcaacttcgatgttgagcattctggcccacgggacacacacagcccaccagttttcaaaatacattctttgttcctttgccaggataagaaataagacggctgctttcatgtctctacttctcaaatatgtcagtcttttcagtgacattcttttattcaatgtagtgggtgatctgaattgcaagaatatttcctattttcccatgggactaaattaagttatttgcattttgaatggaatagaagactctaaacacatttatttttttcttcctgaatcatccttggaaaaagaggttgctcgctgttgatttatttcacaattttatctgggtaaaagccacttgcaaaaccactccccttatcttagtacaactgtgctagtgcagaactaaggccaaagggtggaaaattccgtgagagtgatttggattcactcttaaaatgatagcagcagcagcagcagcaagactcacagcagcagagctagctaccagaaacaggtggccctagagctccttgtccccagaaatacacaggtagaggctgggtgctgtcagtctcagtccctgaggagtagacctctgtgttgggtgttacattaggccagtctgttcttttgagatctaagattctgttattttaaaggctttcattactatcccattagaaggatcaatttgaatttcttgtatttgagtggaaaatgccgaagaatactgaggtttgagtttctgatgttttgtgaatttttcactgttgatatttcatcagaaagaatctgagaatgttatgatgtaaagtgggccagatttgctaatctattttaagaacatgtaatctgtgaataataaaagcactgatttgaatattggaatgataaagcaatattcttaattttaaatgattcttgttttaaaaatagcatgttttaaaccacttctcatgatctttattttcacttattttttatactaaattcgggggcgggggacaagtgcagttttgttacatggatctgttgcgtagtggtgaagcctgggctttactgtagccgtcacccaaacagtgtgcattgtatccattaagcaatttctcatccctcatcctgcttccaccctcccaagtccccgatatctgtttttacactctctatgtccatgtatacacattatttggctgccacttacatgtgagaacatacagtctttgactttgtttctgagttatttcacttaagataatggccaccagttctattcatattgcttgatttcattctttttcttggctgagtagtagtccactgtatgtatgtatatgtatatacaccacattttctttatccagtcatctggtggtggacattgaggttatttctatatccttgctattgtgaatagtgattggcacaggtgttgctgaaagtgtcctgagtgtaagaagtagagaaggattgttttcctcagtgttgtgtgtaaagtgcccatattttatttgtgtaggggagagaagatttctgttcttacccatcgctgggtttctggctgagtcatctatagcaaaagacagatgaacaggaaaaaagtatacatttatctgatgcaagttttctgcgacacgggagccttccgaaatgaagagcgagggaaacagggaaacctgtgtattgtatgcttaggtttgatgaagagaggacagatgtggaggagtgtggtgtgattagacaaaggaggagtgagctaatggtgataaacagagggatactcagcaagtcctgttggttctgattcttctctgtgtccctgtgtattcatagatgtggttgttccttcctccagttacagggagggcacttcaccaatgagaatcttatgacctgccataggggagaagggcaggaaaagggcatagagtagccttcctgcttctgctgctttcttgaatgccacagtgccatattttcaggtagcatgtcctgaaccccatcatttgcatagctttacaaagatttcctatttttatttttgattggttttcacatttcaggcatttgccataaatgtttagctttaccttgatctacgagatttggaatttgatggcctataataaattcacgttttagcataccaagggcctgatattacaagcaaatgaacaaacatacaacccctacatgaactgttgtgtaatatgcataatttctcggtttctctattttataatttggatttttctgcagcagggatggagagagcacattttctatcagaagttaccagtgcacaggaaaaatgagtcaagatcaactgactaaaaagaagcttaactcctttaagagagaagtacgttctactttgctttaaaaaaataagaacagggacataaatctatctaatggctaaaaatagaaatgagtgattgaggatgaaaaagagaaggaaagagaaagatcacagacacagacacactcggagacttcacagtaataaagaaaaaaaatcaaggactcagagtgagacacagacaaaacgagccatacacctaaagatgaatatatgcaaggcaggcaaacggaagtcctttttgggggctgtgcaaatactggtgtaacataagaaaaggtgatgggcagatgcagtgagttgtagagggcctgttctgtccaaaggcactcaaatccaacaaaccctgcgctcaccaaaggaaattcatctgtcatccactggccaccagcgtagaccctgggttctgaacacccacagaaatgggagtggacgttatactgagtgcttaccctgtgccaggcctggttctgtgtgcctcgcccctcacgccttataatcctcacatcaccgtcgggaggcctgtgcaactgccatttccccacttcagaggtgaggaagcagacctagaaaagtttccatgacttgtgtgatagcacacaactgatcaaggatgagttgaggtttgaacccaagaagcctggcaccagaaaggaaaacgcactccaatgcacaagacatacattgtcacccacacaggcccagccatctcccctcctgcttcatctaaccactagaagtgcggggatagttatggcagagacaaagaaacccactcagagaacacacagaagccttagagctaagcatgcatggagtcacatcccagccttctggcttctgctgtgcacataatttgtatcctaattttaatgcagtcaatgctgtagtagacctctgaaagatacacagataaatgggaccagagtgaaggaactcacctcttgacaaatgcctgctttttttttttttgttttaatttagtttgctttcttcttttgacctggcataaaatgccaataagaatttgctagagacaaaacttggcagcaggttttttgccaggtgaaaatggggttctaggattaccgtggttgcactgtgcctagctggtagtaggcactcagtcaatgttgatgactggatcacgagatttagcagttgtttaaccatcagtactctcccaattttcaggatttttttgtttgtttgtttggagatggagtttcgcacttgtttcccagtctggagtgcaatggcgcgatcttggctcaccgcaacctctgcctcctgggttcaagcgattctcctgtctcagactgccgagtagctgggattacaggcctttgccaccacggccagctaattttgtgtttttagtagagacggggtttctccatgttggtcaggctggtctgcaactcccgacctcaggtgatccacccaccttgacctcccaaactcctgggattacaggcatgagccaccgtgcctggcccttatgtacagtgtttccctagttatctcagaaacttctctaggccaacgaggtaggtaataggattcccattttccaggagaggaaaccaagacccagaggactgtctggactgcggtcttagagctggcaagtgatggagatggcacctgagggcttctgcttctaaatccgtgttctgtcctctaggctgcactgcccttcagtggtttaagtggaaagccatggatcaatctctagggaaatgtggttttcagagcagtagcatttctgacaaaggtgaagctctgatttttcccctctcctggaaggaggaatattaaatatctgcagtgtctgaatttctttaaccttccctccaatctttagtctctttaggaggttatttacaactctgacttctgtttgtttttaatgtcctctgcaattgaaagaagacagtgagtgtgatgcttaaatgtagtagatttttcccggactatttgataagatctattttgtaaaggaactgccaaagtcagttgcgataatagccataatagttttaaagtgatgttttccaatgcagattcacttattgcctggtttttgaaattattttgagtaactattagaaaataatactttaaaccatgtttttatttccaaaaactctaattgaaaattaaacattcttcagaacaaagaaagcaccttccttttcccagttcccaccctgatcctttattttgctccatttccccataaatccagataactttgttatgtggagtaagaagtagaagatttcactggggcatgctttgacttccccagttccctccatcaaagaattaagcgtaatttttatccaaagaatgggatgaaaggaggattccctgcaccgtcgttttggtttgtcctcttctttcacggggaaagaggagctgaaatgtgcttaattgtttgctgcatttcctgtgcacatgtacttatccctcacatcacccgagaccaagtgaagagggagtgtttagaaaaaagagagggaggctgatacccgttgaaagtaaaatgctggcatcttaattttaagagaacacagaaagccaaatgctttcagaaaagggtcccttcacggagtaatttgcctggtatggcatcccagtttgttgtataatttcagccccgttactatggtaacctgctttagtgtcgcagcgattgttaatcaggatttgtcgttattcccctttcatcacgaggctctatatccttatggattaaatcgcagttctcatcgacaatggcatagatcaaacattattgccagacataaaaccccgggtcgctccctgtcattttccccgttaccagaagcagcaaatgcaagctgaagtctaacttttgcaaggaaatcagggctccttctggctcctctgatatctaccctcatgacagaattccaagcaagagggccactttcgtttccaatcaccctgtgcccatgggaagggcaagcaccattttgcgtcactgcaaacctgactcttcagatacatatccagacaaaaagttgttttaatgtgacctctaactcttcctcaaaccttattcttattcttggagcagccgactttttctttctttctcatcgattttgtagattcttgtctgctgcttttctataggaagtccgtgtcaagaagcaggggagaccaagacgccactcctgttgaggatgttctgtggtgaatcacagagcctcgtgaggctcgtgggatggtggcttgcttttcccatttgtgaagtctggtggtaacagtacccagacagggaagtgaacaaccctatagtatagtgaccggatttagcagggccggatcgccaccatctttaggaaagtcaggttaaaggaacataggagcggtgaagtctcgtggtgccatgttctaggttaggtgcatatcgctagtcgtagtgtgtcttcatattgcaaattgctttgtttaggagcgagaactgttaagccacgcttgttaatagcctctggagccagtctgcctgggttcagtgtttggctctgccacctcctaggtgtgtgaccttggcaagtttttgaacctctctgagtttcagtacctaaaaccagcgtaatagtagtacctacctcagagtccgtgaggatgacgtaagttaatatttgtgaagcgcttagactggtgactggcacgccatcagtgttgtataggtgtttgtaaatagatgaaacagaaccaacattgcacgtacatgtattcaaaatatattcaagatcagattatccaaataccagtaaggtgttgaaaacagcgcttccccccctcctcccccttccctctccctgctttttttccttgatctctgcaatgtgcccaacccccaagtataattctgattggctaaattaattctgcagcatcctgctgtgaataattatgttgatccagtgtgtatctcatgcctttttttttctctttgcctaaattataatgtgacaattgcggctcacagctggctcatcagaggtgggcagttgggggattggcacatctgactgtgcttctctgttaactctgtgccttgattgcttaagacaagacacatgtaaaccccatgattattgccatttttttggactttgcaaagactctgccttcaaacataaagctgctgggctcgttttgggggagggggcatgtaggagtctcctttcccctccccccgcctctccctgcttttcctttcagacaataaatagctgtcaggcttatgtcaaggatgaaattataggtgcacatgaggccttgattacattgttttggagagattgctattagcatactgaaatgaagtctaatttttcactggcggagctgagtcaaactccagggacaggcagggcctatgcagtgcgaggcgagaaccgtccgatcggagcacctgttctatgtggggatcagcttttccttccttaagacaaacaataggaataaaataattcatacgaagaatagctttgcattagaaaagaaaggccaactgataaaggatggaataagacatttcggttagataaggctctttgtgaaatgaccgtatatgattttcaagtgtgtttaatccatgttaaggcagcatctcgcttgttgattcaggctgtgttttagcctgaagagtgtaccatctgattttttaggttgcttgccgcctgcataattcattttctactgcccggccctgcaagcaggcatcctctgaagaggcgtgtttgtgagcactccatccacggggcgggtggccttcttgtacttttgatgtttatacattctgatgatgtgaccctgtgacctgttcactttcaaaatccttcaatataaaaattattcttggcaagtggtttccctgaaatgtgtaagacatggtgcctcgagaatgatggtggattaataattatacatggcttattgtataactgtcgtggctcactgcagtgaaaatttaaaaattacacacatacacacacagatgtacatacacccgcatctgcacgtgtgtgtgtgtgtgtaatgattttggcattgtaacttgaaagcttattcaatatcattgtttcatcattactattattaagggaaaaaaataaggatttggtgtgggtggagaggacgggagcgtgtcctccaatttgaaatctgtaacagtggagaaaatttgtaaacagaccgtatatttatgtatttggagtatatactttcagtacctactacatgcaaacagtgcgctgtagtcactgcagattcagagctgagttagaaatggttcctgctgtccaggagtgtgtggtttggaccagaacaaaacaagcatgaccacataaccctagagcagcaaagaatggtgcgatcgtaaaggaagaacccatatttgctttgggttttttttcccctagctatttgggtgatgttagagtaaactgaggaagagaagagagagtgaaggtttaatggaggaggttgtatttgaagtgtactttgcagtgtgggtagaattttaaacacagaaataaaagaaagacatccccagaagggtgaaactgtgagcaaaagcagggtgaggtctcgtctggccagaggttctctccctgggatgctcttgcatcggtagagaactgtgagtaaaacagctgctgcctgaaatccagacacaggaagcaggtgagtggctgctgagggccgagggctgggggtttcgaggaaactaggagtggctggatgcaggtaccaggggtattttgggggtgatgacagtgttctgaaatggaatgtggcggcggttgtacaactttctgaatagactaaaagccatcggattgtatactttaaatgggtcagttgtatggtatgtgaattatatctcagtgaaggtgttattttaaaaaaaaatactgctgcatactgatgaaatcacactttctgggcgtggcgctggtctgagcctccttaggagccctgggctggagcagacgctggacatagcgttcagctggaaggagaggtggggctttatcttagcctggaagggcttgctgaaaggtttgcaaaacctatttgcaaaagggagccattggaagttttaaagtagggtcttggcacattcacactattgtttaaaaagctactcacagacctgtggtagatggtttctggaagctgggacgccagctggggccttgttgggttaccggcagaggcgaggtggcccttcccaggtacagatgagtgccggttgcagtgagagtcgaaatcaggtgacaaatgtaagggacacagagagcagaatgtcagcagggcccggtgctgtctggatgtggcacgagtgggagagagggtctgacgggtcctcaggtttgagccagagtagatgagaaggagcaggcctggaggatgtgacatgctcagtgttgcatgtgttggattcaaggaaccggcgatccatcctggagcaagatgggaatgtggctctgaccccagcaaaggggctggccaccgagcctagggagtgtggagggtcagcttccgcagcagctcagtcatcagctgttggcaggaggcctcagaccttcaccacgtaggcctcaccacctctgtccccatgtcctcacaacgcagtggctgacttctcccaaggcgtgtggtccaggaatgagtgaaagtcacagtgtctttatataaccctgcctgggaagtgacacactctgtctcctacgggtgacgccaaccaaccgtgtacagggtagaaggggtcacacagggcatgagaacaggaggcaggggccatggggctgtcctggggacagtctgccacctcttgatgcctggcactgctcttggcatggccatctgcatggaaaggctgtaacgagaagggtgctcaaccaccagctcacaggcagggaagcccatgctgcctggaggattcctgcattctcctagcatctgtggcaccccccacgtcccaggggctcggagacaggtcaccgtttctctggactgtcactccagcgagttcaccgcccttcgactctgagcagtgcagagaccccggaccacaacaaccgtgttcctcagactgatgcgaaactccaaagagcgggaaaacgactttagagggaccggaaaggggaagcgagtctcccatggtttgaggtgttgctgcccgtacctgtgcacttggccacagtccaaagtgactccattgcgggcacagccgtggggctgacgtgagaccccagcctggcaaagcgagcactcggaggcagtgggcagaaagggctcctctcggctctgcagccggaaaggagacatctttttagataagagttacagataatattctatttctggaaacgcaaggatgggtgggatgaaccttcttaactaatgtgatccattcagaagtatgttaaaatgtatcccttcatataatgcaccctgctttaatttttagatcagggctgaagagtttttcttttttttttttttatgagaaagggaaaatgttgtttttaaaattaggaataggaatttaggccaggcacggtggctcatgcctgtaatcccagcactttggaggctgaggcaggcagatcacttgaggtcaagagttccagcccagcctggccaacatgatgaaaccccatctctactaaaaatacaaaaattagccaggcatggtggtgcacatctgcaattccagccgcttgggagtctgaggcaggagaatctcttgaacctgggaggcagaggttgcagtgaactgagatcgcaccattgcacttcagcctgggcaagagagtgagacttcatcttaaaaaaaaaaaaacgggaatttagttatatttaacaagtaatcattttgggaggccgaggcaggaggattgcttgaacccaggaggtcagggctgcagtgagccaagatctcattactgcactctatcctgggtgaaagagtgagaccctgtcgcaaaaaaaaaaaaaaaggaaactctgtctcaaaaaaaaaaaaatcataacttgttgagaagtaattaaagacatgcagaactggagaaggtaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaactccgatgagtccgagtgaggggtggaggatctggcgattgtgtgtgtcgctggtaaatttttttttttttttgagacatagtgtcactctgtcgcccaggctgggtgcaatggttcaatcttggctcagtgtaacctctgcctcccaggttccagtgattgtcttgcctcagcctcccaagtaggtaggattataggcacatgccaccacacctggctaacttttttttttttttttattcgtagttttgctctcgtcgcctgggctggagtgcaatggcacagtctcggctcactgcaacttccgcctcccgggttcaagcaattctcctgcctcagcctcccaagtatctgggattacaggtgcccaccaccatgcccagctaagtttttgtatttttagtagagatggggtttcactgtgttgaccaggctggtctcaaactccgcgacctcaggtgatccgcccgcctcggcctcccaaagtgctggggttacaggcgtgagccaccgcgcccggctgagaaattctttatgcaacttctgtcctgctgccctccctgcccaggcccctccagggcctgtgctgattgaagggagaaggtcgcaccttattacaacttacatcgccacctcgtgatacttgccaatttcccctttttgcagagagagaagggaaacattgggcaggctaacgttttaataacattgtttggttttcactgtattaattgtgtgtctaccttctgtctgtggacagtcacaggctgtccatttgtagtggtggtatggagttctctttagaaaataaatgcatgtacatatagtggtttccatgaaatacgtaaataatagcacagttggcagaaaccacaaaggtggtatggaaatgactaatatttgagaagcactagtttgtggcacatgggacggtatatttgtgctgtagggcacagcgctctgagctcccggagagcagattttataaacactaaggtggttttttttttttttttttggccaactttatctgtcaatttacaaatagttgctggtaagtgctgttttttcctcctgaatttagttaaaccaccaagggaggctttcttacactgggattgcagttgctctgttggattggggaaaaagtgtcctaatgacccaggaacactttaataaaaaggttcagttgaaactacaggaatgccgagagctgactgaaaatgcagagaagttctaagggggtaatcggcagtgagggaaaagtacagtgcctcgtggcttctaggatgtcctttgtcctatattctcggctcttttcaaattgaaggaagtgggtgagagagatgctgctaattacatctatgaataaagtgacacagtgcaccggctctgagcagagaccaacacaactcgagagagaaaatcagtctgtcatatttgtacaaatatgtgcacttcgatgataattaccatagtcattgtttactattgctgcattatattaattatctattcagtgatattaaatacataactctaaacatcatccccgaacaaattaccttttatcaattgaaacaaaccaattaaaaatttcaaaatgcaaccatgtaatcaacggcttactacacgataattatgaccaaaatgccaattaatgtgttaatatatgacctcaaatctacagaaacaaacaacaaaaaaaagcagcctcacatagcaattatggcctcgtttgattgacagatatctgtgggtttgtttttctgtctgactcggtaatttgacttatatgaaaacagccggcctgttctgtcccgtgttctgaagcctgttctttcccgtgtgtgacaagcgcgcaggattaaaaagcacagccttttctcttcagctcctgcatgtcccttccctgcactgcccagttgcatccctttccagcatcgtttctgctgctcttgaacctgtggagtgggaagcaagacagggatctctcattttatatatcagtaaggtgtggcgtggacagacccgtgtcgctccctggacaccactggtggtattgattttatggagcagaggctggtgcatgcatgtgtgtgtcaggtgggcagtgatgggggggtggggatgaggcatggtgataattcacaacataccctctatctagttgggatccgtaaaggaggaggttaggggagggaggatccatgcctacttgtggagggtatcaagaagggcttcctggggaggtggaggtgagccgagctcaccaggagcttcaccttcctggggaggcgcagtgagccaagactgcaccactgcattccagcctgggtgacagagcgagagtctgtctcaaaaaaaaaaaaaaaaaaaaaaaaaaataagggcttcctgtaggaagcttagtcagtggaaaggatttagagaggaagggacaggaaatagagaacagcaggccgggcgtggtggctcacgcctgtcatcccagcattttgggaggctgaggtgggcggatcatgaggtcaggatatcgagaccatcctggctaacatggtgaaaccccgtctctactaaaaatacaaaaaataaaaaattagccgggcgtgttggcaggtgcctgtagtcccagctactcgggaggctgagccaggagaatggtgtgaacccgggaggcggagcttgcagtgagcccagatcgcgccactgcactccagcctgggcgacagagtgagactgtgtctcaaaaacaaaacaaaacaaagagaacattctagcaggagaaagggcgttgagtgcttgggttgggtcaaggcacaagtctggctgaaatttagaatctttgaaggaaagcgatggtgagattatttagactgggaagatgaacctgccaatcttatttcttattctgcgtgtgtcacttgatgagaaggccatgtctccaccctttagtaaaggccaaggtcatttaaaaggttacctggcctttttaagtgacttgaaatgtttagcacagttttagaaggtcagtgtctcaccacctgacccttatttccttggtttatgatggccaatttattgcgtctgttttattcaaaagaaaactgagggtgcttctgaagtagtttcttatttcaatgtgtacacacctccactctgaaacatggctcccttaactgcacaggcaaatttatcacatgtagttgtgaacatatatttgtgtgtgtattgcagtggaaaatccccttgaaaaatcagcaaattggacttcagcttgaaaagtatagacagagaacaaaactgtctgtgtgcaaatatatgtatatgtgtgtatctaaaaacatatataaacacatgtatacgtatgtatatataaataaaattggattgagtcataaaagtataaatatgtccaatgtaaaatctactagagaaggagtttgtttttatgactcagagggaatgtgtaataaagaggtatttttaagaccgagagccagtgtgtgtcagcttctttttgcccattgtttgtgtcctgggcaggaagatgactcactagatctgaatcacaaggcaattaagagccccaggaaaggctgatttcaggatggatatttagaagcttcagctaaatcaggtcttgggtatctaggtggattggggaatcagtgaaacaaatatttctcttcattgttttagattctgtggatctcttgctcagtacagaagtactttttttcccccaaaaaatcatatgaagaaagaggaagcgctgcccattctgaaggaggttgttaaaaatgagtaacgcacacttcatgttcacagcagcagtattcacaatagctccacgtgcccgttgacaggtgaacaggtagacagaatgtggtctatctgtgcaatggaatagtattcagccttaaaaaggaaggaaattctgtcacttgctacaacagggatgaaccttgaggacatgatgctatgagaaatcagccagccacaaacagacacatactatgtaattccactgagtcgaggttcctagagtagtgaaattcatagagacagaaggtagaacggtgatttccaggggctgaggagaagaggggatgaagagctgctgtttaaaggatgcagagtttcagttttgcaaggtgaaaaattgctggagattgatcgtacatcagtgtgaatgtacttaccactactgagcggtacacttagaaatggttacgatggtaaatttaatatgaggtgtctttcaccacaattacaaaagtggaatgagtgaagcttattaaggatagacagcagatggctgagaagttggcctggctggaccgttgtctggggggagcatgtggatgaggcatgaggtggggaaataaggaacctgtctttcttccagttaattgttctttcccccttgccttccaccttcctttccctcctgatggctcatcctgtctccctctcacgtgcctgctgtatactttcttccttttccctgctggtccacccgacctatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttcccaaagcgacagcagtggtagcacaggtgagggtgtcgcccaccgtctgagaaacccatgaagtacgctggctgctcttccatgttgcccccttcataacaaagtgttcgctatcacgttaagaaatatgttcgaggaggaagccgtgcaacagcttcagaaaaaaattctagagctagaacatgcagttggttttcaaatctcatattcttaatttcaatccttttatttcggatccaggctttaggatgcctctctctctgatatcactaaataaaaattatccaaatgtttaacattatatagaaataaacataatggtgtatttgacaaaatttgacaattttcatgtggatattnnnnnnnnnnnnnnnnnnnncatgtggatattcaatgccttgtggtcaaagtttaaatcaaaaccaatgtggtcttggcttcaggaatctgtaccatcatagatagcagtggagaagaggaaataatagtctggtatccttaacccataatatagattgtatatttgttgaaagtagaatgcaagggtggcaaaggcctgatcttgttgagggatgggaatttgtcaaacgcagtcactgaatctgtgtggtggacacgcgtgcttgaaaaccttgcggaagagtagccatcaaaaatacttacagttcttaccaaggttacggcaggggtgaccacccaataaggtagcacccaaatcggcttcactgcttcaatacgatggaaggctcaaggacacatttgtggttttttttttcttttctttctttcttttttttgagactgagtcttgctctgtcgcccaggctggagtgcagtggcacaatctcggctcactgcaagctctgccttccaggttcatgccattctcctgcctcagcctcctgagtagctggtactacaggcacccgccaccacgcccaactaattttttgtatttttagtagagacaggatttcaccgtgttagtcaggatggtcttgatcacctgacctcgtgatccacccacctcggcctcccaaagtgctgggattacaggcatgagccaccgcgtccagccaggtttgtgttttataggaagaataaatttccattttaaatgaaacaattctacttttttcttgtgaaataatgttgaagtatagataaaatatatcaattgtatgaagatcatttaaagaaaatcacatgtatattgaaaaagattttaatttttttttcttggaaatagtgatctattgttttaatggaaaaaggaagtgtagtttttaaatgttctttaatattgatttacagaagcttaacattacctttttaaataccacaggtacagtaaaatttaatgggaaagctaatttttaatagtttgataatgtgtatatattttatatatatataggttttaccttgcattcgcattttaagagaacaagcttattttatgattaacagaatcattaaaaattttttattgtaagcttgccagagtcctagatttaaaaagttatactcacaccacatatagtctaatgacgacaataaggataaagaaatactgaacttttttaagtaggcttatgtcggtagggatattgatgacattctgaaactattttgtgtttatttaggagagagtaaatgagcaactaagtgaattgatgtgttggacaccaacattttcactgtggaaggagacataaatatgaggaatgtgaggtactggatttgagttgaaagtatcagtatgaagtcatgttaaaatacacccacgctctctctctcactgttgtggttgtatcaactgaagagcctagaagctgtgccatcccaatacgcacacattctctctctctcacttttctagttgtatcagctgaagagcgtagaagctgtgccatcccagccattatgagcatctctcatgcccagatcttcgtttctgaatttctctttccactagaagaaaccatgagagaaatggcgagcctgagatcctttattgcaccaaaagcaaggaagtatggaaggagagctgagggcttgccaggacattggctgacatggtctctcactggtcaaacttgggatggttggaacatcaataaagaatattaatgatcatggattataagtacattaaaaaaacccatatgagtccacagtgatgagagttgggctggagcagggaggggaaagctctgctttataggaacatgccagataacaaatatagaaggagttagagaattagaaactcctcatgttataaccttaatgtaatcaactgattcaggatggatgtgaaaactattggatgagaggctgttgatgttagcacagtattctctgtgcttttgcaatgtagagattggccgtgaccttaatgaagtggtcaggtttggcgtcactaatggtgggagtcctgatgtgatgcggtaggaggatacctgaagcccctgggaagagtggcttcgatgctgccaaggagaatgtcatgaagtacagagctaagtgcaggaactgtttcagattagggagaccaagcagaaataacagccaattgcagtgaatgaaacttggtcggattccatatcgaaacaaacaaaatggctataaaggacatttttgagacaatcggggaaatgtgagtgtggactgtatgttggatgatggtattgaatcaccctttccttttttaaaggtgtgactggataggagaaggtgtttattcttgagagatgcctgttggattacttagggtgaaatttcacaaggtcttaagtccagttttggatagtttggtaaaaggaaagcatgtgtgtgtacgtgtgtgtatgagagagaggggatttgagaagatattaattcttggtgaatgtaggtggagagttatcagtattcaatgctatatcgtttgtttctgtaggtttgatatttttgaaaataaacaataagtaaaactaagtggcatagaaattaatctcttcttttcatatggacacatagagacatggtgctaggatggcatgtgggaaatagtttctgcaagatgagcatattcttcctccactgcccctaccagagaaatgtgaatgctgattcacttcttttgaccagtggtgatggaatagaattttccagtcatgcagttgtacttatttccttctggttctgtatcgataagcttcattcctttttttttttttttttagcttcattctttagaaattggattctttacttagtcaagtctataatcaaaatagactttccatggtaagtaaagtaacatgggagcgcataacaatacctgtcatttatgaagacctactgtgtgcttggcactgtgctgtgcttttatttaagtcttctccattcttcatcatccccacattaccaggaggagacaggctcaggatgacaagtggcttttgcaaggccgcgtggtgaatacatcgtagatttgaaatttaaacccagttctttctgactctaatttacctatatgttcatcctccagtatcatgctacctgtatgcctggaaataaaccattttacatagtttctaatgggattacatttttaaaggaaattcatggtagtaaagatctcgttaacactcccttgatgtatggtatttgagtttaagtgtgaaaagaagacactagcaatggacttgtactgagattcaggaaccctggcttctgcttccagttctctcactgtctgatggtgtgatttgagggccttagtcttatcaaatataatcattggttggtctggttgatatctcagttaatttgggaaactaaaatagcatgacattttcaaagaatttttaaaaagattactgtggcagaagcaagttctgggggtggaggtgcatgaggagggcttgggatagtgggaggtggctggagtaggggctgggttattaggggtctgtaggcaatgttagggcttccaactttgtaaggggcaatgaaagttctcataggttttttacactctaaaataataataataatagttctttaatatcaaatatgagagtcagagtcaaatttccctcatttatactttgttcaaatcaggacctaaagaaggttcacacattgcaattgctgataggcctctctccccctctctctgcccgccctcttcttctttctctctctccccatctccctgtctctctcttcccttccctctctccatccctctatcttttaataacagctgtattgacatataactcacataccgtacaattcatctatttaatgtgtacagttcaatggtgtcttattccattgggctactataacagaataccatatactgggtggcttatatgcaacagagataagtttctcacagttctggaggtggaaagtccaagatcaaggagccagcagatttggtgtctgatgagggcacacttcctgcttcatagatggcaccttcttacggtgtcctcacatgctggaagggcctcttttataagggcactaatcccatccattagggccccatcctcatgactgactaataacccccaaggctccacctcctaatactgtcacattgtgaggaaagatgtcaacatctggacttcaagaggacgtaaacattcagaccgtagcaaatgggtatgaactgcagtcagacagttgtgcaaccatcaccacagtcaattttaaaacgtttgcattacctcaaaaagaggccccatagctgtcagcagacattcctcacttcttcccaacactcccccagctatcggcacaataatctactttctgtgtctatagatttgtcaattttggatactttacataggtggaatcagataatatgtggcctattggcttctttcactagcataagttttcaggattcatctgtgttgtagcatgcatcagtgcttcagtccctttgattgctggtcatcttccattgcatggatgtatccataattgtatggagacaccacattttatgtattcatcagttgacagacatttgggttgtttctactttttgtctattgtgaataatgatgctgtgaatatttgtgtacagttttttttgtgtagacacgttttcctttgtcttagatatgtatctaggaatggaattgctgggtcatatggtgactctgcatttaacattttgaggaacttccacactgttttctaaagtaggtgtgctatttttcagtcccacctgcagaggattccagtttatccacatcctctccaacgcttgctgttgtctgtgtttttgattatagccactctactgcgtgtgaaatgttatctcattgtaattttgatttgtatttcaccaatagccattggagggttttagggatgaaatggcatgatctcatttagattttaggaagatcactgtcaccgtatcaaagaggatggatgagagaggtgcaggcagattaccagataccagatgatggatggcagcagacaggccaaggtagtggcagtaagaatggtgagaagtgagtggattacaggggaatctagaaatactgtccgtaagaatttgtgattggtcagatgtgaggattggggagcgctgaaactgcatttcctgcctgggcacctgcgtgaggccatccattgacagaggggacagagcagggtgggtagtggagagtggtgtgtgcagatctggaggggttgagtttgcatttactatcaagagaggagatcaggagtggtctctgggctggaggcagacatttgggaattgttaatatatatcagcagtatctccagaactgggaatggctgaggttggagagtgagaggaaactaggatatttgagcttacctcttacttctggagctttgtgatgcttttgcccttttagaaaaatgcatggaagtacagttttttactcaatatggaatacagttaaagaacaacatttccttcactttattgaaatttgttgcaggataacatctctgtcaaagcactttacaaggctttctagtaaagtaaattttttgtgtattgcagtggggagaggggagggggttgcctcttgtaaggcagaatttgattggcattatctcttaagtcttcatttccagcaacaatcttaacatgctgtttagatttaaatggtgggtggaccatatgtcatgaagaggtacagtgatagaaaacaatctctaaatatctaacccatttaagtggttcctacaggtttttatgtttttgagatacatgcctaattttggattattaattcttactggaattttgtctgttaagttaggaagaaacgacttataaagtttcctttggttttccccaggaagatacttttataacatgaaatctttaaaaaaccctttagaaaagtggtctatataattcttagcagggtgttgagatcaagtgcttttcttcttttcattttttacactttgtcagttgaagatgtgcaaagaagtccatttgaaatttccctcgggccacttaattcagcttcattacagtggaagtgggttaaaaatgataatcatacagccccaacaggtgattagaaatatagataggatggggccaggcacagtggctcacacctgctcagcactttgggaggctgaggtgggcagatcacgaggtcaggagatcaaagaccatcctggctaacacagttaaactccgtctctactaaaaacacaaaaaattagccaggcgtggtggtgggcccctgtagtcccagctactgggaggctaaggccggagaatcgtttgaacccaggaggcagaggttgcagtgagccaagcatggtgccaccgcactctagcctgggcaacagagcgagactccatctaaaaaaaaaaaaaaatctatatagatctctatagataggatgaatccatgacacgtccttaaaacagttttattttttccgtttcatgaatttagcaggaggatcctattctcactgcaacctctgccacccaggttcaagcaattctgcgtcagcctcccgagtagctgggattacaggtgactgctaccacacctggctaatttttgtatttttagtagagacaggatttcaccatcttggccaggcagatcttgaactcctgacctcgtgatccacaccccttggcctcccaaagtgctgggattacaggcatgagccatcgtacccggccgagatttcatttttaaaaaacatgaatccaagaagtgacttgagttccaaataaataaatttataaatttacttatgttctagaataaatgcaagtaattatgactgcattagtgcagcattaattaacattgctaattctttgtaattatgccaaataataacactaataaaatgtaaatatcaaatgaataaggcgagagcctcccctcctctttttaaagccactatattacagtgtcagattatgaacacacaatattatcaagcttccagatatccactttctaaatacggtctgtgtgaattctaatgaaaacatcagctctgtggtataaatctcctttgccgcctggttcaatgaggggctgcccagcaagccaataattccattcctcagagcattgctgagaatatttatataattaaatatcatctgtttccccatttaattcctggtggctatcccccaaccccctggctgtttttgctgtttccttgggcaggaatggcacaataaagttgctgcagtgctgatggattatcttcattaggtacttgggtgatgagtccccaagcactgctgaatttgatttaccctgtgcaaaggcccaaccttccatagaagcgctaagtagggcaggttttatgcagcttgaactggttggtgtgaagaagaaggaaaaaattaagttgttcttctagaaaacaattttgggaaatgctttggtctcttaggagagcctcctttgcctccttttatacaatctcaacaaatggtgatactgaaagtcctttttggtaagaagaggcggatgaagtgagaacgtggtgagctggagagaatgcaggagacccgggttctgcatctggggtcagagctgaagccaggctgaccttccttgggtctcggggtgtctgcatctgggcagcgatggaacaggactgtggctctccaaggccacttcagctttggagtgggaccttcgtgaatcccgccctgcccctgataaccatgggccctgggcaagtcaccccatctctccccgcctctgacactttgtctttaaaatgggaatacaccacttgttttgcccacttgttacagggtggtccggaggtctgaatacaagagcgcactgcatggtcctgtgcggatcccagctcgcagcaggtgcccacaggacgccgcccctcgcttccctcatgtcctagattctgtgagacacagcccgtgacactttgaagcagggccgtaggaattccgatgggaggtgattagagagaataaacaaagtgacggagttgggcctgagacaggggagtggtctgcggtggaacagtgctggagtaactcctgccactctgagccaaggctcttatttatttttattttggacagggtacttgcagaatcaaggctttgggagtctggtgagtggtcagacccttcatgaatgggattggtggccttataaaagggactccagagatgtctctttctctccttgcaccatgggaggacgaaatgggagtctggccatctgtagcccagaaaaatgttctcaccagaacctgactgctaccacgaagggtgtttaacctacattgagtgccaactgtgcttctcctttaattcaaagcctttgatttctgggggtgcctgttctgatggcactgatgggcaccccctgttgagtggggcaggtgacgggaggaggactggcggccgtcagtgggggctaccatgggggtccagggggcctgtcaaactgtggcacaggggaaacccgtagctctgtgccttactattttactataccatctcatttagtgcccacgatttcttaagaggtaggcactgaaggggaaacctgtagctctgtgccttactataccatctcatttagtgcttatgattccctaagaggtaggcactgaaaccattaccatttgtagatggggaaaccaagggtcacagtggcttgcccaaggccacacaggtcataggtgggagaactcattggagccctccccgcctcagccacgacagtcgtgtgtaaaggtgggttcacggaatatcatggggcctcctgtggtcttaaagtttgcacctctccaaattcctaggttgaaatcctagcccacaaattcgtaagttagtatttggggagggggctctgggaggtgatttgttacgagagtgcgaccctcatgaatgggaccaagagccttagtgcctgcctgaaagggacctctttgcaccatgggaggacacaatgggaggttgaccaactgtagtccagaagcgggcttgtaccagagcctgaccatgctggcaccttgatcttggacttccagcctcagaaccatgagaaatacacttgtggtgttcataagccacccagtctgtggcagttcgttatagcagcccccgccgactcagaccacgctgtaggatttgaagcaggtgtgctgagaatgtagggtagacatgtcatggtggccggtcaccttccattgtcttctctttctaaacggcacccaccttatgggctgctatgagaaggaaatgaggccagtgtgtggactggcgcacccactgttaatcagctgccgctgcttggcccgtttcatctgcccggaggccgttcctcactgacatcagctagtcattctgcccttcaccttgggagggcatcacaccttgtgccttcgtagagaaaaattcctgtttctgccccacgctggaaagtcagataaagccagcacatgtctggaagatgcaagatgaaatgtgaaatcagtatggcattgggtggaaacagaattctactgcacgataatgacagccgagatcaaaggaccgtctatttatcgataagagtgaaggaaggataacatggcagccagaggcgtcatcaaaggggaggatggctggggtaagaccctccaagggggccacaggccctacccagatggacaccgcatgctggtgtggcagacgagggcacagaccagtgtggcccctccgccctttgccccagtcggcattgtcggctgttgctggcccacagctgaacatgctacgtgtcatctagaaccagcctttctgtctccatattctgagtccacaagggacagtaataatgttgggcccacccctggaaatgtaagaagaaattctcttagcctgtcttatcttgtacttgattctttaggtccttctcttaagtttttcttttctgttctcctgttaatctgtctttctttttaaaaccgcatacttacacagctagcgttttattgcagaatactacttttaactggacctaaagagaaaagtctaaggtgttagcaggtatcattctcaccagtcatgaacgattgccattcacagtttaatgttatcctagtcttatctgtcctgacctcatttcttgattaaaatgttcctgttaaatttcctgtaaatccttcctaggtgaaaaatccctccgagggctgcgtatcgcctggggctgtcgtgtattttggcagcagatcccttcccttggctgctggctgggtttctccaagctaatgctgttcggtgcaaaggaatggccctcgttagcttcctgagctttttagaagttttaggctgtgctggttttgaccccttccttcctctctaggactcctgaataggccgaagaaaaaattaaatatttaataaacaacccaatgtcacagagaatgggaaaactcttgggattacatacttgtacccaaatcctaatagactttttatgcttattgttaataatatactatatttgaaagcagagtataatgcctaggacgtagaaggactttaaaaaatgttagtttcctttccctgtagaatagtcaccctcaaccctgggctgcacttaaaaatcacctgagccagtggctcaagcctgtaatcccagcactttgggagacctaggcggtggatcacaaggtcaggagttcgagaccagcctgaccaacatagtgaaaccctgtctctactaaaaatataaaaattagcctggtgttgtcgcagacgcctgtattcccagctactcaggaggctgaggcaggagaatcacttgaacctgggaggtggaggttgcagtgagccacgatcatgccactgcactccaccctgggcgacagagtgaaaaaacaacacaaaaaactgtattgatgtctgggctgcatcctagaccaattaaatcagactcttggagagtgaagtccgggtgttaatattttaaaaaggctccccaggtaattctaatgtgcggcctaggttgagaagatcagctcttagaagaatacagctggccgcctttttgctttatacgttttgagctgctggcttctaattagagttaatatcattacaatataatgcctttgttttacattaaatttaataagaacaaccactctgctctccaacaatatagctactttctctggcttaagtgcttctattctttttttaaaaaacaaacaaacaaacaaacaaacaaacaaaaaactgagtttccgattaaaaacccaagcttaggccagaacagaacttttgaactgcagtcaaacaaaattttagataattgttttctaatggcttcctgacaaatggagactaaagacaggcaagggggctaagaccaggctgggtggggagaggggacagcagcacgttggtacctgggtcacctgccagaaaatgagtggcagtctgtgcccaggtggcttcaatttcctgataaaatgaaaaagccatgatatctctgtagaccgagtctacgtcctaacccccaaatcaggacacatagtcttgtaagtgggagagtatacacgtggacattgtagctggaatctgagcctcagtttccccatctgccaattggaggcattgcagagtcctcctcaggattgcagcacgggtgaaaagcttgctgacaaataaatgcttcctatgtgtcaaacaccattctcagttttaaaacgtgttaaataactctgtgagcagttaccttatcacctgtcttatactgaggaggaaatcgaggcacagagaagccaagcagactggcctggtccctggaatagctgggatttgaacttggcagtgattccagagtctgggcgtaaaacatctgtgtccagtgcacaaggtacccaagaccgtgtgggcacaggatggaccctcaaggcagcgaatgaaacccggggctggtaaggtcaaaggtgtgtgagcagcagtgatcccagcttcactctggagagccagggcagtctcacactgggtatgaggtgggtgggtatggtagtggtgatggtgttggtgacaggcttctttagaagttttggagcttttggtttctcaggtagcaggggagaatgaactcagaatattattaatgaaattatctgtaaggttgaaatgtacaggagtgcattttggcataatggtgtgtatgtgcatgtgtgtttttgtgtttgcataactgcatgcacgtgtatgcatttgtatgatagtgtgtgctcatatgtgtgtatgtgtttgcatatgtctgtgcgtgtgtatgcatttgtgtgactacatatgttatatttacatgactacatatgtgtgtgcatgcatatgtgtgtatgtgcatttgtgtgtgtgtgcatatgtgtgtgtgcatgtgcatttgtatggggttgtttgtgtatgcatgtgtgtttgtgtgttggagaattatataacaagcgactttgtctcattcttcagctttgcattctgtgggctggggatctgcatttttccctccagcctcttgtattacccaagctcactcattcacttgatcatacttttacaactctgtgacatttttaccatcttagctgggcccttgcttgttggtggttttgcccatttctaggtgtgtggcctccctggccctcatctgtcagcagagcccatggacttaccccagaattgcaaccctggaagcatcttagcatcatctgggactgatgcccccatacccctaattaaatcaggccctctgctcgggagccatgatgggtctagtgtattcctagggttgagaaacaactggctgtattcacccaacctatgagaagaggatgaggtgacatggagaagtcagtttacaagagctggagcaaagtgcagagccaaatatcttggcgctgggctaatgatgcccttttcattctcccctcttcttcttccctcctctccattctcttccaacactgcttccccaggtcccctctcccatgccaggaattaaaatgttttgtctggaaacaagtgagcttgactaacgtggccgggctcccactgcagctgagttctgcatgttctgatgtcagtgttgtgagctttaactggagattggtgtccaaaggcagccgatactgctctgtccatttctgttgtgctgaaaatcacatggaaaccaatcacataatgatcttgggaatgaagtattcaatgcacagtgttattaacatgtaaaagacttagggcaaatcacttttaagtatgacaaggcttcagatgtgtttggtttgagtatagggaaaagagtttggggggttgtttatcagcagtgccatgagggaggcttatttcttccctttaaatctggatgaatatgcctgtgtgcgccgcatgataataacaatcacgccagccaggagattagctgagcttttgctctagtaattctagcatgcaaattcaaaggactgcagaggaggcaggggaggagcgtacttagcatcttttgctcccctacatcctaacctttgtgctgtgtcttaggttcatcttagggacggctgaacgtgaaacctccatgatgtcaaaagcctggagagttgggtccatgcatgaatgctgatccactttctctcatagtgagatgtacaaacagaagggtacataaaacttaataattatagaaacccatgtaactacccccacccctaaggaaaaaaacattgccactgccctagaaggccctataccctgatgttatttaagaaaatggaccgcggaagagaggcacatgggtggccaggaatggagaagctctgttaggacttgggcatggcacttcttgactgtttctgatctttatgaggcagtagggattctggaacccaacagtttgggttgcaatctcatctatgttacttactagctttgtgtccttgggcaagtccctatgctccttgtgccttagttttcctatctgtaaaatggagataataaaagtgtctaccttgtaggataattgtgagcatatcaagtgtgttaatacatgtaaaatcattaatacagcatcaggcacatacatgttaactactattactttattaataatcttggttctaaaaccttgtgttgttttatatgtggaattcccagtcttctaaacagtatctctctctatagatgactgtattatcctggtcttccacgtcgctggtgtgctatcatccctggccaactcagatgtcactgggcatctccagcacagccactgttcttccttccactccatgcagaatgtggcagcctggcacacaaataatttttaataaaattttagtgtataaatgtggtttttggaaagtagggaggagggaagtagcattgatttaatatttaaacagtaccatttaaacctagtagcaaaacccctatacgataatgagttgtagtctattttacagatcaagaaagtgaagctcagagaagggaagcaactggcccaatgtcacatagctagtaagtgactcagctgggattcgaccacacttctgttttcagaagtgcccatcccttgcggggatttgagctctcacagcccagcctcccatccttgcaggaatccttccttccacactcccaaaaactgaccatgtaggcttcactaaagtaaatcataaatttggaagtctaggacatcttgaacatgctaaatatgtatcaatacacctgatatattgtttccagtcacagataattccagttgattttcaggcatgtgtagatactcatgatataaagattgagttgttactaatcactatgaggcacgggcaggtcttgaggtagaacctcatgaggggaatgttataagtacttttgcattcgtatgattttccccataaccttctctcatgctggcaggagatagctctcttttccaaattctcaagttggcacagttatgaaaaccttctaggacatcagtgtgatgatgtccagagacaggggcagactcctgatctgtggctgtgcttggtactccctcaccccttcattggtctaatgggccagctgaagaatttacacaataggaaaattggccaaagccttaacattgttaccaacctgcatttcttcatgaagaaagcacaatacttgccttaactgagggaagtttcgcaggaaggggtattcagctgtgtgagtatgtgctctgattcttgcctgtttctcagttccctgtgtgttactgccactttcatttattactgtttgcttattttagagctatgtaccttgcaccctgtatgaaattaactcaaagtggatcataaacctaggtgtaaaacataaaaccatcaaacttcgtgaagaaaacattggcaaaaatctctgtgactttgtgttaggcaagtgattcttagataagacacaaaaaccagaagccataaaagaaaatgatagattggacttcataaaatgaaaatgttattcaaaaacattgttcagaaaaatgaaaagacaaatcttgcccatgttcattcccaagcatttcattttgtctgatgctattgtaaatgataccttaaaaactgaaaaattcctaaccattcatcattagtacataacatttgtttttaataattttattttttaataatttgttttaataagttttgtatgttgaccttgtcttctgagacccattaagctcacttatttgttcttgtaacttttttgcccattccttggtattttctttctttctttttttttttttttgagacggagtttcactcttgtcacccaggctagagtacagtgacgcaatcttggctcactgcaacttctacctcctgggctcaagtgtctaccactacgcctggctaatatttttttttttttttttttttttaagtagagacagggtttcaccatgttagtcaggtagtcttgaactcctgacctcaggtgatctgcccactttggcctcccaaagtgctgggattacagacgtgagccactgtgccgggccttccttggtattttctatatggacaatgcttgtctccctccaaattcatatgtagaaacctaatctccaatgtgatgatatcaggaagtggggcctcgggagatgattaagtcataagggtggagcccttaggcatggagttagtgctcttataagaaaggccccagagagctgccttgcgccttctgtgatgtgagaacacagtgagaagatagccatctatgaattaggaagcaggtcctcagcagacactgaatctgctggtgccttggttttggacttcccagcctccagaattgtgaggaataaatgactcttggccctccatgtctgtcagttctgcatcagtggattcaacgaaacttggatcaaaaatgtttttaaaaaaaacacaaaaatacagtgtatcaaccatttgcaaagcatttacattgtattaggtattgtaagtcatctagagatgatttaaagtatatgggaggatgtgcataggttacatgcttatactgtgccattttatgtcagggacttgggcatcctcagattttgctacctatggggttttggaaccaaccccttgcaggaactgagggacaactatactgttgtttatgagccatccatttttatggtactctgtccaatcagcccaagttggctaagacatagatgatcatgtcttctgcgaataatgatagctgatttcttcctttgctatctcaatgaattttacttccttttcttattgtgctagctaggctctccagcatgatgttgcataggcgtggtgagagtggatatcttcccctagctcttgatccgaggggaaagcagtcagtttttcaccatgaagaatgatgccagctgtaggtcttttgagagcactgtcatttttacttttatttttggcacatggatgggaaggctaaagacttgcaactgactttcctcctatacctttaacattttgctgaatggtagagaaagagaagctgggccagatgtagtctggttagaatgctgctggttgggagtgagtttgaatatgttttagaaatactttgtctttctcttctatgtgccattcctcttagtctgttcttattcctgtacactccctagtcctgaaaaaagtagtgacagacctgacattttaagagcactatcccaatttaaactgtactttttttttttttttttaacagagctttaaggaaatgaacagctctctacattttcttgtatttgtagcaggaattctgatcaaattttcaccttttagtttccgtgagagaaaacaagggccttacacctttgatgataagacatcaagtaactgttactactgagtaaaatgtaagaagaaatatactttttaatttgtcagcattgcccttccctcagtgaccaagttgctgcacatttgatagcacaggcaaccacagcaaacgactgatacggacttacccagttaattacctaaagattatattactggaaaaagctaaatcatcaactcaaccatgtgtaaacactttgaacatcatctttaaaatgtctttgcagtttgtttaggtggtagtggaatttgtacaaagtatcagtcattgtaatagcattctaataattctgttaacaactgcttgaaatcagaaagtattatttctgttgtttagatttgcccaagcatttcttgtgtaatgttataagctgtttatgtgcctcttaatagatgagagaatgcactatgtgaagtctgaagtatctgaagtaggtaatggaaccagaggaacttaggttatgagatgggggtatataggtaatatcccatatatcatagtaataacaagacatagaaactaatatactcactcccagatttccatggggactaggaggagcctccattgtagccggggtcaggaatggcagggtggcagaactacagatgcatgctccctccatgccaatgtgtggaaagggagtgacggacaaaggcagtgggatctggtcacgggagtatgggttggtgtgtgtcaccctgcatggggtatgatactgggctgctacaggagctcatggattccagatcagcaaaggaatgccatttaggaggccttgggaggtgctgatggggttggaggggtggcaaaagccagaaaagatgggactggtaggaaggacatggctcctgggcttcattctggcgctgtctctgaagcttgagcggaagagtccagctgtggtcagtggaagtagcagggcaggggagggggaggcaaaggggacgcaggtttctagcttggaactctggctgatggcagagtattagcgtaggggcggaggttagggaatatgccaattagaccagtaatggagggaatatttgacctaaaaataaaagatagacttagaactcagtcttaagggggcaaaagaaatggctccacttgatattgtaaataccaattggaagttggagtgaacttctaagaatctagggcccaaagtctcccatgatggggatagtggactcaccagagatgggaaaggaggccaggtcactgggcagcagggactcaggttgcctgtagctcaccccttcgcttactcggatcttgattcatttgttgggccatgcataccaagaaccgattatgtgccacgcataggtgctgtgttacaaagatgaaagtgagtcttaaagaggttatgtgtgagaaggggacagatgggaccagtcattctcagcataacaccgagtggaaataaccatgacacagattggagcaaagtgaggaggtgaagcagggagaggatagggaagaagaatattctaggtggagagaaagagaaagcatgtataaagaccatttaaaatagcacacttctggagggccacctttttctcacagcaatctgggtcttacagccctttttctgttcaaagtcttccttaatacaaactgttttatttaaaatcttagtgcttttggttcgactatgtgatctttagctttacagtgagaaggcggttaaatgccagggcccctctgagccgaaggctctccgtgtctgcctgcagcctttgttctctgccatgtaaaagatgaaaaattgtgtcagcaatatcacacccagttactgtgaaatcaaggaatcgctctggtgaagaatctgggggtgaagaccagacaaatcgaaacggcttggcgtcatgatttaactttgtcaagccaaagagagggctcgtgtttcaatagttagcctcaccttgcatctatactgggccaagtcttctttccgtgaatcctgaaccctgaaggaatcggcctcctctggctggttttaggcattgcccataaatcgaggctacaactgttctccaggcatctccctgacacctcaaacgtatgctcagcactccttgggccccatgcccaggaatctttccgcttgtctcttttccgggcttgcagccaggctcaacttttcaagatgttgtcttccaaatcctgccttgattaactcaatctgcagccccttctttgtcactgttttcttgtcactcttttggtttctcctgcagtcatctgtgtgcctagtctgtcccatcttaggcatttgcaattgcaaatgactacattaacatttaattcacaccaggcagcatttgtctgctgcataaagacacacctggactgcacggaagactgaggacctgggctaatggtcccagcgtgctgtgggtttggttggctgaggtcagcatccacattgaggtgggtgggcctgggcagatttctaagacaagacaagatgtgaggactcgtgtctacatggtatcttctagcttggaactctggctgatggcaaagtattagtggaggggcagaggttagggaatgtgccaattagaccagtaatggagggaaggtttcggggaaggaggttagaagcagccttagctgtctgcacattccaaacagggatttgagtatttgttcctggatattttggtgagggtgtggagaggtaggagaggggagcctgcttccaactttgtaaagagagagaagatatgaaggacacagatagaggagcttgctgacagctagaaaagagaaggtgagccgagcagatggcgtgcaggtgagcgaaggcatggctaggggtggactcgggatggaggagcccaggaggcttcccgggagcaagtctatgtgtttggtgtcacgcaaccatgcttttcccacaacccttctgtcttgggtcttgtggcactgtcttggttctcttgctgcgtccactggaggcctcttctcccatgacttcccagctcacctcccctctgtgagctcaggccccagcctgcagtcctacgttcttcgcactctctcagcttcctcccctgagctcatccaggcccccagtctctgttttcacccctctggagcagactccccagcctgtctgcagtcttgtccccatccgccctcttgctccatctttcattgctggttagacgtgtctactgctatctctgtcacctccggctcagcgtgctgcactcagacatccaactggaggagtccatgagctgacctcagagatgccctccgacgctgagtttctttgtcaaaaaacaaactcttcactttcatctcttcaaatggcattttattctgtcctctggtgtctgtcaatagatctcatctccccagacaggctgccttcagcttcccttcacagccttgccgatcttgcccctttccctgttaatccacacagccatcacttctgaacttaattcctatagcccctgacgttctctgactcatccgtcccttgtgatctacccgaacatgattcaccatccacatttctggttctactctacctgtctagcccctttcccacaacttttctgcactcaccctcctctactatggccgtcccggtcacttcaccatcttggagcacctggcactcatgagatgccacgatggtcacactgcatcccttccctgaaaccttcccagcctgtctcggtcattccattgttttatttgacttcctctagaatcgataatctctgctacacaatttagcatgtaaccgtatatgctcagtgttccctttttgaagtatattggtcttatctccgcaattggaacatgtttaccctgttggaacatacgctgttatcaagtcacaacgatcattatttttgctttccccaaagtgtcaagaatgtaacacaggatcaacaagtgttgactaattgataaccgagattccagattaaagacaaattttagtctgatgatcttaaaagtaattatgctgggtggaaaataccctcactttgggtatggttaaaatgactatcttgaatatctcattaagaggataatgtctcattgacatttatactgacagcccctagcatggagccttacgtactggctagtgtgttgaatgaatacctgacttatttaagcttttcactttgaagatgtttggtagcatttccatccagtccttgtacataggtaatcattgtcacggaggaccaaagggtcttcaaaacctgtgatgccaagggggcattttactttctccttttgtgtgggtagccacaactctattcgccgtttttaatatttacttttggctttatcactccatcaagttgtttattttttattcattccttacaatagatgtagcagaatgggataaggcagcatcattttcttccattccattttatcttttatcagcatttagttctcatgtatagcttttcctgagtcatcagtattgggctaatggactggaagggcccaagttgaatggtaattacttactctgttgctgatagcccagatgagaataggacctattagatctgtaataatggaaatctgtgtttaatgcagatcttttaagcagtttgaaacgatctcaaattcatctctctttgccatatgttaaaatgtcacattatggttttaaaattcaggatgagaactgaagtttcaggagagcctgcctgtggaaaagtcctcaaatctgtcctttttaaaatcagaagcatttgttcatctcaaatcaagcctcctcagagatgccagctctgtctgggcagtccgtgcaggcagggtgagacgaagaagaatagggcttagttcacaaggatctaggacagaaggggactgaggggatgtgaggatggtggactttgtgtggtgccaggaggcttcccagaggcttgggccatggattcagtgaatgcattcaagtcaggagctcctttgtttccttcttcatggtagggtccagggctgaatgctcacacttgtgtatcattagctcatctcctgtttcagcagcagaagactttaacttttccccaaatactgctttcttctttccccttttcgtgtgaagaataaaggtacagaaatttgacccaagatacttctgtgcaaaggccatcctctttagattccagaccagacttacgaagtgaactggtttacacaggtcataggtcaatcaatgctggaatgggtgctcagagcagaacctagtccccacccagggctcctgccatcactctcagaagtgttacaactggaacttctggtcatcaggattgttgtgtttttgagttattttcaataacctgtatcattcttcttgtctgggaaatggccctaaataatttagcttcctcttagtacagagtcttgtctggagacatattgatgggggctgtaacctcacccagtttcataaatgaagcaggttcatgatggagctcctgtttctcaatagagaccttagaatgagaaatggttctcaagacttgttcagtttattacgtgctgtttgctgtttgattcaatgagtctcttgtatctttgcaaatggtagatgtattgagtagtactagtatggtgttgaaaaagttggtactggtgaaatgttccaaccttgaacctcctgtgacttggaagagtcttcacagaattcaggacagacaggtggtgctgattcattggtgggggattggtttatttcccatagttctaaattatgcactttgacaactcaataaacctgatgtaactgacaacacactgatggatatggtggaggataaagaatatgattatttgaatcaagatgcttatggtatggcatcctagagtcgattgctttttaaaagattcttgagctttgataactttttgttgatacattttctttgagttcagcgagctggcttcatgagtgtgttgttatccacctcttctttgggaggaaaggattgtgttttagtacttaccctgatggctatagaagtcactgtttcatatgctatatcagaattgacttaaaaattgcatgtaggtatttgctacatgttttggtgacatgatgtataccattaaggaaatttaagatctttttgatcacaaagttctcagcttacatctggttatttgttggcgttttatttattggcaagctttttctagcagcaggtctatggacagccctgaaatttctttaaaaaccagtcttggaaagaagaaaagctgtggatgcttagttgaaagttcaagttacctgcaaaacatttgtttcaattgaatttgtctatctatagttgatgtagagtgggattttagggaccagggagtgtctccttggtcctaagttaagaaaacaaaaataaagtgacttcactagaattactttgaaccaggtcaagaacctgttcatctcactgtggggtttatatcctccttaccgcttcacctgcctcttttttccaggacaaatattttacatctgatcacttcctaatgagtacatctattcctgagaatggcaaactttgtgattatatcagagcaagaaatcttatttgtaaagaggctgcctaattatccatgacatttaaaatgtctgcattgtccttgagctaagagtgtgaaaatcaggagacccaggggtgtattcacttcctgatagatttcgcttagtttaccatactctgacagtaaaaatcaaatgaatctgagctgcttaacattaacattccaggccggacacggtggctcatgtgtgtaatctcagcacttcgggaggcctaggaggggagatcacttgagcccaggagttcaagaccagcctgggcaagacagcgagaccctgtctctacttgaaaaaaaatttgaaataaaaacaaaaacacaataacattccaagcaggaaagtaattgaaaaaaactgctatcatccatattgctaattttataatgcggaaactaccacagagttataagtgcagcgatgaagatataatagacatatttttgtgtaagaaaaatgaaaattcaccttagtgactgaaagcatagattgactttgcatagacatcagtgtcaataatgatcattttagtaactcaggttttgtttcttcagttgaaattcaaagtaacccaggttcataagtaggctgtgatgttgaaagattggaaactctcaattttgtcaaagattggaactaggttgagatactttggaatgttttactagataaagaggcagggaaataaaataactgttgtttcctgtgatttgagaactacaggatggcaccagaatctcagacctgcagcccagtgaagggattccttcattaaggctcttgttcatttctttcttggtaattttgttggttttctgtttttactagaggaatatgactcttaggaatcatacctgcatgcaaatttctgatgctctgttgattcgtgagcactagaaagagttaaaactccctatttctcacaatctcccccttggcagagttcagttcactgatgactatggtgagtcagtcagtgccccatcctgtgtcatggcatcccacaggacaacattatcttttaataattgaattatttttgcctctatagtaatgtgataagacagaatcatcatctattttttaacatatagcaaaattacccagttttttgaagaagctggaaatacttggatctgcatgctaaataggtaccaaggacagaaggaagacagggttcatcttctctttctaatcgtgggactttgggctgtaagggttggtgtcttcatctttccagtaaaggggtgggactgagcaatctccatggttactttcagctctgagagtcgatcatttataattataatgcatattgcatctgtgtatttcagtcattctgaacagaagggtttttgtcttggcaaggttttgtcttggaatggtgtatatatttttgtggaatggatgctttctccctaatgtctggcaaggtcttgtcttgctttcttctttgttgacattcctggtttctggtccagccctgaatcgacccagctgatggggcatattaattgggagcatgggctgtggagttaaacagacctgggtttatgttccagttccaaacctcagtttatctggctttctcatgtgtaaaatggagaggatgctgactttgtgggttgaggtaagatattcaatgagaggttgaaggtaaagcgcttagctcagggcctgataccttccgatgccttcctggtttcctacacctctccccatgtaaagatttttatttgcagaaatgtcaaccccaaagttgttctaagtgggaaaactgtttcctctacactcacaaaacatttctgacaccaactgtatagattttccacaccaagccattctccagttctctgcagacaccaactgggtgtctaataattcaattcaattctggcattaacgacctggaattagaccccacagcttaagggactcagtccttcaaggctgcccccaacttcagatgccaattgcaagtccccaggttgtcacctgcacttctctctgacttgactacctgactcagtagtccacacaaccccctccttaggtttgataatttgctggaatggctcacagatctcagaataacagtttattatatttactggtttattgtaaaggatacaactcaggaccaacccaatggaagaggtgcataggtcaggtatgtggaaggggtgcagagcttccaggccctttggggtgctaccctccctcacagcaccctgatgtgtttaccaacctggaagctctaggaacccattgtttagggtttttatggaggcttcattatgtaggagtgattgattaaatcactggcctcttccctcctcagaggttggagagtggggctgaaacttccaatcctctaatgacctagttggttcctccgggagccagtcccaagccacctggagttacctcattagcataactcaggtaaggttgaaaggggtttgctatgactaacaagatgctccccttacccccatcactcagaataccaagggttttaggagcgctgtaccaggaaccagaggcagagagcaaatacatattcctttttgtgtcataattgtatatatttcgtgtatttttgtctggtatcagacactgttggaaattgtggtttagtttacttcagttgttgcaccgaagaaatgtacaggaaatcaggtgtttttggaagacactggattaagagctgtactaaaatgctccatctatttcttcactacttccaaatgttgccacatttttgaaattggaaaattctgttttagttgacttcctggactttacctcttgtgtatgacttcaatcttgataacgttccatgctagtcttcgtctctggacttctctatcaaatccaccgttaacccatcaaatatttattgaactctaggcactatcctagaaactggagataggtgagaatgagaaaaattcgtctacagctcccagtaaatacttgtccgcagatgggaggaggggacagaacataacctgtaagcagatatattataatttcagatagtgctacatgtttcaaagtaaacttaaagcagaaggcctggcagggagcagaaggggatgctattatctagagagcaagggtttgagtagaaacctgcatgaagtcagaaagtgaaatatctgcaggagaaatgttccaggcagtaggccagcaagtgcaaacaccctgtgggggtaagaatcttgagatgatcaaaagacagcgtgcagtatagcttgtgcacacgtaccctaaaacttaaagtataataataataaaattaaaaaaaaaaaaaacaatgggagaggaaatgaggccgaagacccatcagggatagattctaggggccctgtaggccaaagtgaagactgaaatgtatcctaaaagtcatggacaaccacaggaaacatggaagctggggatgacatgattgtatttacatttaaggcaattactgaggagaacagatgggtggagaggagcccagagagagggcaagagtagagtcaggaggcaattcactagcagaggaaatagatgaacttgctgggtcatgatggaggtggtgagaagtggtcgtggtccagacgtattatgaaggtcaagctggtgggacttcctggggtcacatagaggtagtctcaccaacagtgttagtgctctggagacctcacttctacccttgggtcatgtacctgcatgggaaaagcctttatcctgaccccaagtgccttggctcaacttcgtgattggtgtgcattttgggtgagtgggggtgagcaggagattaagtaagaaatttttttttctcttcaaaatacagacatatgggtgaaatacaagggtggggcagggagaggatatagttctcttggtacatgaccccatctacagctcctatctggatctcttggcttagctctgacctcctaactttttgaggctggggactagacagggaggtgattgaaaggcttcagggacttgcttggtttatcctctaagctgcagcagctatgtcaggtttcctgattcctgaccccaattccagatattcctttatttgacttacagaatgactaagaatatgcaaagtgagagatgaaggtgcaggctgttaaggccaagagtataaactaaactgtgtgtatcagttacctcttgctgaatgatgcatcacataaacctagcaccttaaaacaacacacatctattctctcacaatttctgtgggtcaggaatccggacacagctcagctgggtcctctacttcagagtctctcacaaggctaccctcaagatgttagataaggtggagagctcatctgaaggctcaactggggaaggatctgcttccaggctcacttgtgtggttgttggcaagattcagtttatttatttatttatttattttttatttattgtgggcacatagtaggtatttatgggttacatgagatgttatgatacaagcatgcggtgtgtgatcatcacatcatggagaatgggggagattcaggtttccaagagccattgggctcagggcctcatttccttgctggccatcgcctggaggccacacccagttttttgtcacatgggcctttccaacatggcagcctgcttcatcaaagcaccagagagagtgtcctagtcacagtgctttgtaacttaatcacataagcggctgtcctcagtgttgccatgttctattagtgagaagcaagttactcaaggagaaggctctaagtgtatccagctgaaatcctgtattttctgttttccccctttacatcagcatgcctttgaagcagataatactgtgtagaccaagtctttaaaatagcacattccatgagccaaccagccacctcacctgcctataacattttcctttatcgtctccactgatgctatagctgaccatgttaggaaccctcatgttatagcttagtttatcttaaatcttgactttgtgtttgctcttagctcttgaggactatttgccttcctagacttggtactcccttgactccctcagtcccagccaggagagtgtcattttaggccattgtcacactaggatgtaggaggtgataaagacagcttagttaggcttaggaccaaggctgtgtgagaaccaaccgaagacagacctgcaatgtgtcatctggtacttacggcctctgtttgccaggggctaagtgtgataatgggtcagaaagtataaggtttacaaagtagctgagatgccacctgggacctactattaaaagccagggcagaatcctacaactaggaggtcataacagtgcttggaaggccattgaagctacagtcaggggcagaccaagggtctgggagcttgaagaagtggcggtcaaggcaaaaatggttcaaaatatagaagttcagattgtggagaatagcaacattagtaagcagagagtaggagacaggctgatctctggctaggttatttgtccccacactttcttttttcaatcttttttcccactctaccctggaagcccaggcctagatacagaggcatagtgtttttctctgcgagctaaagaggacggtgtggcatcagggtgacaagctgagctggtggtggtggtggtggtggtggtggtggtggtggtgctgctgctgctgctgctgctggtggtattggtagtgatggtgttgacagtagtgttgttggttttgttggtataggtggtgttggtggtggtagtggtggtgatggtcttggtggtcttggtggtggtgctgctgctggtggtattggtagtgatggtgttgacagtagtgttgttggttttcttggtataggtggtggtggtgttggtggtgttggtcttggtggtgttcgtgatgttgttggtgttggtagtggttttttgttggtgttattgtgagtggtagtgttgatggtcttggtggtggtgctgttagtgttgatagtgatggtgtgttggtagacttgatagtggtgttattgttgatggtgttggtggaggtggtgttgttgccattggtggtggtcgggatggaagtggttgtgttgatgattttggtgttgatggtagtgagcagttccctcactgctctcttacacagccagcctcttaaataatccccactcttaccctctaagccccaccttagacactaatacattctaaacctcttccaaagaagcagaaagaatcagtttcctgcctgggaacagtaaaccttgataactactttctctctagatgtaaaaggtttggctggtgttattctcggtgaaaatagcagaaaatccttctctttccagactgggattaaatggcttgatttacattggattctagggttattattatttttaacacttccctgatcggtttttttagaaactagcaagacatttttaaggatgaaggcatattaaaaacaactctaaggatgccttgtctgatgcattcagcttgcctcgtccatctccccatttgttttcactgatctacttaacaacttgtgtagacaggtagagcaggcatgacctaaatttggtggatgaagagatctagattcagaaaagttagtttacatgtcaaaggacacacagtcgtataactgacaactgtatgcaaccaggattcctacctaggtcttcccactccaaatccagcactcacattgtactgaaaaatagcctgattttatcacttgacctgtgaaaggaaagaaatcaagggtgaacaaagggagagaaagtaaatgatgttgaataaaacatgagaataaacagtttgcatatgtagccttttgatctttattgcagggctgagacccggttcttaactgttctttcctcatgccttctgcttttggtaaacattcccaacatttaccatgaaatcctctctctcaaggctgaagggctgctgctccttttgcagagcccctgctgatctctcatctctggagatggctgtgcccttagcgaatgcgaatccccctgtggacaattggtgactgagggacagctgtctgcaaggggcatttcatcagtatgcatcacgactggggcttggcagtcattagaattcattataaattactctgagtcccaggaatctcatttagttctccctcagcagctggaagatgctaccagctgtggatctagggtttcccccaaagattttacctaagcattgtgggtaggggcaaataggcaaaacgatctgatgatgagtgggtggggtaagatggacaaccctgtttctgcctttctacctcagagttaatgccctgaagatgccactgggggaatcagctctgggcacagcttaatccttagtgcttctggtgggccgaggaatgctcaagggtgtctttgtgagtcattgcgagaaggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaactctaatgccaggaccaagtgctttcgtgtgaatcaccccttatgattctcacaacagctccataagataggggtaatttccattcattttttttttcagagaaggaaagcacaactcagaggggttattgacctgtgcaaaggaggagttctgggttggggggagtggaacccatgggagctgcacactcagttcctttgtcccctgaccatggcactttccacacaatactgcatacgtatcggaacagcgtgcctcttactgatccttaccgtgttggaccaggacacagtggcaaggtgagccaggttggccttctgtgctcctggcctttcctcacgtggcccttttcctatcatgtattcacctcttcactgaaagaggtgcttccttgtaacctcactttgccatcctcttctcatccctgttctaggacaggggctggcaaacattttctataaagggccagatggtaaatattttaggctttgcaggccatacggttcctgtcacgatgactgcactctgccattgtagagtgaaggcagccatggacagtatataaatgaatgagtgtggctgtgttcccattaaattttatttaatgacactcaaatttgaatctcttagaatttgcatgtgtcatgaagtacttctaatggttgttcagccattaaaatatatgaaaaccactcttagctcataggctgtacaaaaacaggaggcaggctggatatgggtagctggccatggttttgccaatcccctgttctataactaattgagtagtaatcctttacctttgggtaaaatcatcactgtgttagttctcctgaaagcgcatacaatttaaacctttaactgcaggtgaaaggctttgttgcctcctaaagggatttggggtagtagtggctgtgatgggtggggcggggagaggtcacaccaagcagatagctgcctctgcctaacataacgttagtcctgccgtgctgctattgtttttttcagtggaaatgttagatttaaaacctatatgtcatttgtctttgagctctgtatggagaaaaagatcttgctttggtttttgtaaaaataccagccttagatctttttgtgtgagctgtcatcagtcattccgattgttgatcttgtaaattcatgctttttagtgttggcagagggttgcctttgtttctgtacaatttcatgaagtgtttctttcaattgggacttactttgagcttaactggagctatacttttcatctcaactagattttaaagacatgggtacctggcagcatgctacagaggattgttttagaatctttcctcagtgtgagaacttcgggaaatggtacgaccagccgctgattgagccccctttgacatttggtctccacatgatccacagtgactgagcatggcttgaaacttggccggtgatacctggagtgtcttgaagggtttcctttttactcattcttggatgtgtcctggagtaaaaatttttgtattccactatttgtggaatttggaaagaagcacaggaaaggaaatggagatttaatgaggaacttgatttacaccggtacccaagctaccttccaccaccagcttctgccgcatgttgtatgttaggaagcttactaggactgcagcagctagagtactgtgcaggtgcctgacttacacaaccaccctttcaaaaatcgttccacagcccaaggcaacattgacttaatacatttctcaacaaactgaggcctggaaatctgagaaataaataggtgggctatccactgtaatgacaaggcatgacttcctggtttgtatttcttcccatagtgttttgattacactaagcgttaccggcaggcaatagttatttgctattattgtttttaaattaatcctagaaggtcctttaagtgtatttgataaacatcatgttacctgccagcaaggaattgtactctggatatttctgtcttcagaggtagttctatagtagttctgttgtataacagaaagaactatcaattatttgatcttacagtcattatacatgtagactataaattcatgggatttaatttaatgaacaggttcctgcctcagaactttgaacattatgctgtgggaaggaaaatcttttcaatttgctttacagactttgagtatttgtaagttcaccttttaaacaattagggaatatttacatgttgaggatttctcacaagattaaaaaaaatacttcttttgaaatagttgaagactgaagagaagctgcaaaaatcgtacatagttccaatgtgcctttacaccagcttcccccaatgttaatatcttacataatcagtgtgttgtcaaagccaggaaatgcacattggtgtaatacttttaaatacagatcttatttggatttcaccagttattgtgtgcactttttttggtgtaagttctatgaaattatatcacatttgtggatttgtgtaacacagatctatagaactgttcatcactccaaagaaacttcctcatgttatcgtttaacagtcacattcctctcataaggttgtgttcagactgtttcgttaggatgtcaaaatagcaacaaaaacagaggtggattttgagaaagtatttagttttcagttgatttccacaattacggatttcgagtgaatgaaagaaaaagaatggggaactgtattcaggttgtgagcactttcacatttatagctacgatccatttaaagttaattgtcgtataaggtttgacgtaagagttggggtttattttgtcccatttagatatacagttgttccagcaccatttgctgaaaagactgtcctttcctgattgaattatctcagcacccttgtcacaattaaatcctgtcttctctattctgttccactcatttgtagaacttatgccattaccacactgtcttgattactgtaaccttacagtaagtcctgaaatcaggtagtggaagtattccaactgatagttccaaattgtttttgctattttaggtattttaatttttcacttaaactttagagtcaattcatcaatgtctacaaaaacctttctgaggtttccatcagctttgtgctgaactacagattaatttggaagataattgacatcttacagagtctttcagtttatgaacatgatgtatctttccattgatttctatatgctttaatttctctcaacagtgttttatagttttcagggtacagaccttactgacattttattaaaaatctccctagtatttcatgttatatgttgttattatgtaaagtacttcttttaaaaagaaattaacatttcatttgttgctactatgtaaaattatagtttatttttgcatactgacctacatttggtgagcttggtaaactttttagtacaaatagcttttttccttaggattttttacttacacaatcatgttgtctgcgtataaagtattttccttctttcatttttgtacgatttttatttctttttcttgccttttttgaactgactaggacctcactacaatgtcaaatagaagtagagtgagtgtaaaccctagcttcattcctaatttaaggctgagaacgttcggtctgttaccataaagtatgatgcagctgtagctttttagtagattttttttattagcttatctcccttgttgactaaaaaaagttttttaaacacaggtaggtattgaattgtatcaaatgcttttttgtagcatttattgagttgatcagattttttttcttttttagccagttaatatggtaaatgacattaattgaattttttcattgttaaaacaactttgaattccttggatgaatcccacttggccatgattgttatactttttatatattcctgaattcagtattattaaagaattttaaattctgtgttcataaaggggatctgtctctagttttcttgtgtctttgtctggttttggcatcagagtaatgtgggtcttatgaaatgagctgggaaaggttcccccttcctcttttttcaaggcgtttacataggattgatattatctcttgcttgaatgtatctagagtttctcagtgaaaatctgggagcatggagttttctatttcagattttctatttctcgtgttattttttggtgatttgtatcttttgaagtgtgtctgttattaatttgttgcctcttagctccaaatacatctttctgtgtaagctctgtgataagccaaggaatgtccttggtgtttcttgtttaatgtgagcacgacattaagcattgtcagtagagggcgctttgggggaggggggtcattgctggaggaagtctctcttgccatttcttttgtgggcatgaggaccttccgttgagcctgccccagtcatggccccagaactcagtctctgcgacctcaaaccctcagcctggtggtaatgtttctgcagccctccccacagggcaccagagcccctgggccgcccctgcctgtgccgcttctgtccgtggcagtgcccagcatccccgcagatgattccaaggcctcctgcccccgtcagtgcctggacacccccagcacgtcatgctgctagttcctgacaatctgcaatccagagggtgatgttgcctgtctggtgtctccagatcagctctggcctggccaagcccgcaaacttctcagccgtctggtggctgaagcacaccttctccaagacatctgagtcctttcatgtctgtcttccttgggcactttctgtcagtccgtgtttgccagagagagtttagatcacgtagttactattttattgtagtattctttatattagactttccattaacctactgtgtggtttgtgtctcctgaatggttatccaaaaatttcttgtaagcagtatctgagttgagacttctgtgacctatggtttttgtcattttcaagaagggtaggagacattgctatgtgttcaactggtattttttcctcctttctttactcatcccgtccttacgtgtttttgccagggacttaactaaaatctaaaatgaggaagagggagaccagagtgtagtgagactaagttcaggagtcagtaaactagggccatgactggtcgatcagcttcagcattagttttctggtgtctcatgaccgtgagcagagatgttgaggattttatgagacactataagcatagcgtcccattcttctgctgcttagactagaggtcctataaccttaagctgcttatggatgaagtatctaggctaataaatcacctagcttaatagcagcaacaattttaatgtttagattttattttatttttatagcaaaagggaaaaaacatattttactatagacatcattatgaataggaataaccccaccatctttttacttctgtctagtcagagaaaagagaccccagactcacctaaccaactgatcaacaaaacaaaaccccaccgaaatacagaatattctccccattgcagttaggcctttggcattaacttaaatttagcctccctgggaattttggaaaaacatttttcttcattgtttttgtaagccctatgaggcagaggtataacttccccaaacaaaacagcaggaaaagcaagtagcaatcccctggataatgcaaatgaataaaaattgccagaattattacaaaagtgctaaaagccctactttgatatcttacactctattcctagactttagtggttcagaaatgcctgttttagcaatgccagcacacgagggaacaaagtttgtggagaaaataaaccacatagagatagtctccaacttagaaatgggtcatgttctaggggtcgatttgtaaatcagttagactggaaatatattgttcctgtggaaattggcattataaagatgtttttttttttggcttatgtcattagttttcctttggaaaaaaattgcattatttttcttttattagaacacattactgtattaattttctatcactgtataatcaattattctaaaacttagcagtttaaaacaacactcatttactatcccatagttttcttaggtcacgattgtgggcatggcttagctgggtgcccctggatcagtgttcctcacgaggctgcagtcaaggtgtcagctgcattgtgttttctggggctcattcacagggctgttggcaagcctccgtttcctgccacatgggcctcttcatagggctgccttacgatatagcagctggtttcccccacagcaagccatctaaggagaacaagagagcacccaagatggaagtcatagtctatcatccactcacggaatcaaacccccatcactcctgttgtgttctgtttagtagcagtgaatcactaagttcggcctacactcaaaggaaagggattaagctccacttcttgacagaagagtatcagaatttgtggctatacctttagaaccaggggaggatctgctctcaagttcactgagcctttccaaccagtgagcggtagagtggatcctccccctaccaagccttcagatgagaccgcagcccagctgacaccttgattgcatgtttgtgggacaccctgagccagaaacacccagcttcctattctaataagaaattagaccacttaacttaaagtgtaccttgcaattgaacagtggttgttgtgcaacaagggagttcctcctctccatgggaagaaaactcattcctcagtgatgagtagcacaatgtggagatttctgtctatagttagtagctgaaaggcttaagcaaggatgggaaatgtattcttttcccctatcctagcttgcaaccagcttgaccagtatgtaagggtatgttcttgatgttatagggtagaaattagaatgcttttctcactgaaacagtattctgtaaatggtgctcagggtccttggaaagaattatatatgagactcattatgggctgaggaggcccttctgggcaagtttaccaccgtttataacagcatgttcatggaaaatggtttctaaatctcagacacccatttcataaacatgcttttgaaatgtgactcatttttaaattgggggtttgcccatattatattatgttctccccagaaaccttctcaacaatagtttacattttgagctataagccttttgggaagaaaaagtgacagaaaatagagattactataatttagtcttggcactaatatcctggcagacctatcaagacataattctcctcgaaatcagatttactgcaaggcctatgctgaagtcttcttatagctgaggtatgccaagtcacactcgtcttctacatttctagaattctagggtcttattcaggtgcttccaaaaacatctgatcagaattagcacatgagaaacattttgggcctgccttagaccccattcagcgcatggctttatggaggcctatggccttcccgctgagagagacactgcgcaggctccagagtgggttcagtgtgaggccgcctcctctgtctcccctgtgtttgatattttcagacactgcggtaattttattcagcaaagctccattcagtcattacagaatccatcaaagaagtgtccattgctagaatgtgcaagtttttattgagcatgtattcagggacgataaccaagcagacggtgctgctatccctaatctccatctgttagtgaagtcaggcacccagcagtgtgtttaaagagccactaccatctccactgacttccctgagttaagatgttctatttcgcctccatctttcatagaaaggcaagtgtaaaaaagcaccaccaagcgcctgtctgtgtcgtgtgtagaaccaaagtggaagattttgttcattatgtttcttaatatgaatatgcgctgggttatccaacttcccttaattagccatgggaccaagtctgctatctcagaatgacaggtccttagaagaaaatgttagagtagctgatttacatgtgctgtatctctagtaagggcaggattttttaaaaaaaatctacccacttattgaaaatcaattgagagcttcatagtaaaaacttgataatttaagggaaatatataacattccaacagcttttagaattcagaatgtgaacatataaaatagattttaagatactcttctgttatggaagaaaaattgcaagagagagagtaacagaaaggatgagagggaagagggatggagcaataattcaaacagcaccaagttccagaaaggcaaaatacttgctgctgtacgagtctcactctccccctctctcctccaaagtaaaaaaggggtgaacccacaaatacttcatttttgaataatcttttatttctatccaaaattttgcatgcttgatcctcttaaaatccttcccccccttaaaaagaagataattaaggctagcctccatggctcctgcctgtaatcccagcactttgggaagccgagacaggtggatcacttgaggtcaggagtttgaggccagcctgttcaacatggtgaaacctgtctctactaaaagtacaaaaactagccaggtgtggtggcagccacctgtaatcccagctacttgggaggctgaggcaggaaaatggcttgaacctgggaggcagaggttgcggtgagccaagatcatgctaatgcacttctgcctcctcatttccacagagtgaggaaaaaaaccaaaaaacaattaacatattactctggggactgcagcccaattttgtagaggaaatgaagtgatagctctatcttgaggccttctagggtacttacttggaattttaaagctgggttgcagtttttctaccatatgatacaaatgggatcatctttgacatttgtcctgggactggatgcagtttaagcatgaggctgatcagagctcaggggctgcttacctgcagctgccagccactcctacatcccagcctggccctcagccctgggaagagactcctgggcttccaggtgttcactgggggagcaaagactggagatgtttaaaatattttttatttccgtttctgaaaaagtaatacatcacacagaagttcaaaagtaacaagagtttttaaaaacaaattatagaatgcagtactattctcctgcactttgatttttccctcaattaactgtgtatctggtagatagtttcatatctgtaactatagttaccctattctttataacaatgctgattattgcatagcatggattattttatgcaaactgttaggaccagtatttttacaagcaatcttgtgatgactgtctttgtccgtgagcaaagcctgtgctatggaagctcaactgggatgaaccttgttaatgttccatgttaatttcctatcttttttgtttgtttgttttttgagtctcactctgtcgcccaggcttcagtgcagtggcacaatctcggctcattgcaatctctgcctcccgggttcagacaattcttctgcctcagccttctgagtagctgggactacaggcacatgccaccacgccaggctaattttttgtattttagcagagatgggggttccccatgttgcccagggtggtcttgaattcctcagctcaggcaatttgcctaccttggcctccccaagtgctaggattacaggtgtgagccaccgtgcctggcctaattttctatctctttatcactatattatttcctgtagaatcttctttgtcttctgaacctcagcaagagacaataattgaataaattggaagccttgtgtttttaatggaggccagctggcctgagcaaaactgatatctatgtttatatctacaatgattcctcttttcttcttaaagtcacatatttagctatctccttcatctctcatgtaaaaagagaatcaagacaagtttgctgtaaagtttataatgacacagttcatgctccatttttgatggggagcttccatcaagaaataaagccagaattcgttttcacgaacgaatagcagccagaaagccaatagccctgaccttaccctgcagcaggcctgctttgtaaagctgacagcagtgttcaagggtgaaaggttggtgttggtctggaacagattggaaggggaggtgtgggcccatcaggctcagctgaccattacctccgatcatttatcactgtcagagaggagagggtgcggggtgggggagccactggaccactccccgctcagctgctctctgacagctgacagtgccccttgcaacctccaggcatacgatgtgccttcaagggacagtgtggtacatgcttaaggccgctgacatgttcacaaggaagagagatgtgctgtatactgtggagcttctctagaaacgtgtgccaccttctcttcgtgctgtggtgtagaactgcttgtagaaacatttaatgatgttttggaggcacacgttgggctccagagtgacagtatgacttgggtgataggatgagcaagttcctcggtgggccttatgccttaattacatccacaatacctggggactctgtacaacactgagattttaatgtggcaaaaccagcatggacagatgctggggaggaaggaaataactttgctgcttctgtgggtcaggaagcgaggcccctacacgtctttgaaggacagtaccttttctaaaaaatgtatttatttatttttattttttgagacagattatcgctctgtcacccaggctggagtgcagtggtgcaatctcgactcatcgcaacctctgcctcctggctttaagccattttcctgcctcaccctcccgagtagctggaattacagggatgcaccaccatgcccggctaatttttttttatttttaatttttttttttaatttttagtagaaatggggtttcaccatgttggccaggctggtctcgatctcctgacctcaagtaatccgtccacctcggcctcccaaagtgctgggattacaggcatgagccactgtacctggccaggacagtacctttataaacaagaataataagtatgatttgtatatgactctttatagatatgtttaacattcatcttcaaaatgtaaaatatgttttagactcaataggaaacacatgtcttagtataaaacaaattccttttggtctatagccatgtgtttcagtacacctactttcaacgttgttattcacaagggtgtcacaggcatcaggctgaaatacagattttaatccttaaaataaccttattttcattgtcatttatattctcaagattatctaattttggtagtcattaggaattacttgtgttaatagtggtggtgagatttcataaaagtcaggtggaaaatttccatcaattaatgtaatattatatgcttatcacagacgcctaagttagacatggtacttaaatgtggcaattaataaaagtattacaaaggtgaaaatggatttcttctaaaaatggaattaatgatgatggagtgcttgtgttgggaactcaggctagtctggtgcttgccggagatgcaggatgcttggagagctgcaggcagtgctgtcaacacagaggcatgtgttgacgtgtctgatcagcaaccctaagaagtgggtcgggcattgcgggctggtgaaggctggagagagggccagggttgtctttccgtctgtatcaccaccagtaagcactgtgcaaataccagtgttcaggagccacattctaactgtgatggggtttggctgaaatgcagatccccaggccttggtggggcagatatgggttcccaggtctctctgccaacgtccatccgccctgcctacacatgcccacctgggagttgataagcttgctcagaagccctctccaagacagggacagtgacttggccctgaccagagaggatgtcaaagaccagtaatacagctggtttggtttattctggaagtccccgaacagcttgagtgtgcgtcacttggggcagtttcttagctagcaagccaggatagttcaaggtgcccacaaccctgggaagaaaagggctctgctgcaccttcctgtgatggagcaggcaagcagccggtcatgggttgttgtcatggaagagagggtgactgctttctctttcctgctcaaagaaaacagaggagtgggacttagaagagaacacgtagtattttacaacttccaaaatatacccgataggggctaactttccttttttcaagcgttgctttcagtttttttttcttttgataatttattgattagcaaagaaatatttgcttaagaaaaatttgggaataaataaaagtataaagaaggaagcaaaatcacccataaatcagcatataaatcagccacgactacagcatcaccatgcttccttcttgttattttccttgactttgttctttacttgaggaggatactttattatttttttttttgttgttcttactttttccccactcaactccatatatattattattatttcctgatgccaggaaaaaagtactcatggtcatactttaaaagttaccatataatactgtatcttagaactgtgtcacaaatttattctccatgtgtggggtcattcagcttatttacagtttttctgtattttaaacagttctgttgtaaacatctctggaattctttgtctcaattctgattatctcctacagtagctatttataattgcagtgactaggtcgaagggtggaaatgcttttgacattcttggttggttgtggtagttgtggcagggtctcctctgtcacccaggctggagtgcaatgggacagtcatagctcaatgcagcttctaactactgggctcaaatgtttctcctggctcagcctccctagtagctgggaccacaggtgcacaccaccatgcctggctaacttatttatttattttttgtagcaatgggagtctcgctatgttgcccaggttggcttttggcattcttggtacctattgtcagactgctttccaattagattgtagcgtttcatgtgccatgagcagtgtaggagaaagcttgtctcactgaagcctggtcagtgctcggcattgttttcgcaagtttgccatttgcacgaatcaaagctagtctctcttttgagactgagcatctattgtgtatttatataattaacaatttatctgcataatatcagttcccatcattcctccctttgtctttggtgatgcaacctctgtcttttgcagaatcatggatgcctgctttgggagcctggagaaatggtttccatgctgtcttctagggccgctgggttcctcttgcactctaatgggggatccctctgatcacctttcttcactccccagacagtctgcagtctcagggaatagggggcatggtaggctcaccctaggccggtaggctcactctaggctgggttttttgtttgtttgtttgttttttgagacgcattctcactctgttgccaggctggactgcagtggtgcgatcttggcccactgcaacctgcacctcccgggttcaagtgattctcctgcctcagcctcctgagtagctgggactacaaatgcgcgccaccgtgccctgctaatttttgtatttttagtagagatggcgtttcaccatgttggccaggatggcgtcgctctcttgacctcgtgatctgcccgccagtttttttttaatgaataaaaagggcttgtggttggggcatctccattcagctttgccatcctaggcttgtagtcacactagtgggcttgtgcactgagcagacttcaggaaatgcagcaggcaaatcatgagaaggaagaatgccctctatttgcataatgctttattctattaaaaatgtgtcctcatccttatttcctcactctttgggctaaaaatcctctcttaggatttttcttaataactggttgatgaaatggagtccttgagtgtaggatctgtgaaatttatctttgccccacaacactaactcctggcacttatcaatgtggagaacatccttgccagggagtgaacatgagccaaaggacccgcctctaggtaccagcttatgcctcaccaaggtgggttactgtgctggctgggctttcagcctggcctgttctgcccatcctattgtgacctcttgaagctcaggcttgttcttctgcagaaagagctgggaggtatgggggttgcctggggaggtatgggggttgcctgagctgggcatcggctccattaccagccgggaggtgtatctccgttctgctgcgtctggagcaaagggagcgggccagatggtcgtggagggcggggttgactgcggggaggccgtggtcagagcaagaggataaaatcctgaatgacacctgatttgtttttcgtgctgtgatttttcactgttgtccaattgtcctctgtttttccatcacataccttttgttttgggggcagcccccacttgcatatggtccctggtcaccatgggggagagcagtgagctgccttccccttcacctccagctttgagagtaaatctcaccttctgggtacccacagcagctggggacatttgccttattcccaccatggccttcctgggggactccctgccttgctgctcctcatcacgggtcccagctgctggttgtcgcttgccttccaggtcagggaggagcactgggaattcctgggacacaggatgagtgggcgtagtggtcagcagggaggggagaagcccctcccagtgactcacccagcaccatgtttgtccccacgtagcctctcctgacatatagaacatgctgctattgggggcaaaacccactcttggttaacttgcaccttaaaacaccatatcgcacattgtaggagctgtgagggacaaacacaaccagaacctcagtgcccctgggcatgtatgactagaggcgtgactccatcctctctcagagcccctgccccagatttgagtgacagccacctcatccttagcatctgcggagaggacctgggcaggatcagggcccagaacgctcagtcagtgtccttgaggggcccgctgcagagatgggagtggctagtctgaggccagggcttgtgggccacataggaaccttacttacttcctgactgacttgtaccctgaaccaccatgactttgtgacctggagaaggagccacaaagaaacagataagaagagggactgtgagaccatattttgttggggtgttgacagatttttaccatattactgagataaatgcactttactccagccccaccgtgaccctcctctctgctgctcagtgtagtagcagctggattagtcagtagaaacacttgatacgtcagtccagatccctcaggagcatgcggtatgggttgggttggcatggggttaataacatgacccgatgagattgtacttcttgatgaccggcagttctgagagtttagtctgatccaagactcttccagtcctgagatgattttgtgtctagtggctaaccaggactcccaagatggcagctgctgttcctggaatctccagttaggtggtgtcccctggtcacccagtccccactgctttccccaccctccttacccagaggatacgaattttaggtgttcccagttgagcacaggacagggagctcatccctgattggtttatgcctgattttgcattattgtagatgtgttaccaagcagttttactgtgcccttttcaaggaagaaagtcatacaatttgaagtgcatgagacattcacaaaacaaaataaaaagcaatgtcagtatcatcttcttaagcttttgaacatgtccccccgatccccttcaacatccagaagttgactttgacccagtcttggtctaattaactgctactctgcaagcactgcgctctcaagatgaatgaaaatctgtttcttgtcctcatatcttcttggtggaggacacgtcactgccatcagcagaggttgtcctcccagagcatgtggctttggcatgtgccccttgtagcagagaaggggctggggcatgtgcccaacccaccagttgggaggcacccactctgctatggctgggtaacagatgtccctgttggagactcttgtgtctccatttgacactctactggtaatcaatagttagggctcaattaatgaatggcttttctgtttaataaatttgtttctgtggtgaaacatgccattgattttgaaacaaatttgtaaatggtgggttaggttcccaggttagcccacccttcccccatatcttactgaacctatacgaagggtttaaaggatctttggttctttggcccccaaatacttgccttagcagaatttcaatgagaaaatgtctttaaaaactccaccttggtttctaggaatagagctggggtcatttcttggttgtaaagaacttgctattttcccattgtggagtggaaagtagctctcagatttccccttattcttttatccctagagcaatatatagtgtgggggattttcagaggtttgttatcacagtgtagaaatgagaaggaaaatgacttcttcccctgtgccatctttgttttatccatttaaaccagcaatggcaaaatgatttcatcacacatgatgcctctaagcgatgagactctatgggtactgtgttgagaaaagattctgtgggcacattcagggatcaagaaagtatgctgtgtttgattagtgatgtctgccatgggcatggtcgtggaggggaggtgactaatgtttatttgccgttcctgaaacagacctgttggaaagtaaagttcacacaggtgataataccagcctaactgttatatagagtttgttatgtactggacactgttctgagtgctttttgtatttaattctcaaaacaccccatgaagtaagtacaaatgaggaaacttaaaatgaagaaattcttacagatgaggacacagaggcatgaagaggttgagtgactaagccaagatcatatgggtaggaagtgggagagctgagagtcacagtcaggccgtcttgtcctggatcgcctgttcttagccaccagttctgtcctgtctcctgcttgtgagtgttgtgcctgcggtccacaggactgatgtaagactcagctgtatttcagtagaaggtgcaaaatcacgttttaagaacctgttatctttgggcttcaggctctggaattaaagacaagacaaagccgccagggacctcatgagtgatgagggaatagcaagtgaactccctccaccttctccaattcatgcagtatttctggtctttccatctcagccagcactgcccacctctcagttgagactaggtaaatgggaaagggaagaggggttgagatttaaggagtggaatagaggagttcccttgtatccaggtcacctggctggggaaactatttctgaggggccattttcaatgatcattttatgtaaggaacacacgcatgtacacataaagatatgtaacagtcatgtgccacataacaatgttttgaccaacaagggattatgtatatgatggtggtcccttaagattatagtggaactgaaagatttttatcacctagtgacattgtaaccatggtgacatcgtagcacaacacattattcatgtatttttggtcacactgttgtaaacaaacctactgcactgctagtcatataaaagttcagcacattcgataatgtatagtacataatagttgataatcatcataaacaatgatgttactggcttatgtatttgctatactatactttttgtccttattttagagtgtgctcctgcagttataaaaaactgtaaaatagcctgaggcaggtacttcaggaggtgtccagaaggagacattgttaccataggagatgacagctccaagcgtgttattgcctctaaagaccttccagtgggacgagatgtggagggtggaagacagtgatattaatgattctgatcatgcttaggcttaggcgaatgtgtgcatttgtgtcttagttttcaacagaaaatttaaaaagtaaaaaatgaaaattttaaaaatagaagttttcaacaaaatttaaaaagtaaaaaatgaaaattttaaaaataggaagaagttttcaacagaaaatttaaaaagtaaaaaatgaaaattttaaaaacaggaagagcttatagaataaatataaaaatattttcatataattgtacaatgtgcttgtgttaagttatgttattacaacagtcgaaaagtaaaaaatagtttaaaagtttataaagtaaaaaattacagtagctgaggttaatttagtattgaagaaagaaaatttaaaaaacaatttagtgtagcctaagtgcgtgatatttataaagtccgtggtagtgttcagtaatggcctaggccttcacacccactcaccactcattgacttacccagagcagcttccagtcctgcaagctccatttgtcataaataccctagacaggtgtaccttttttttaaatcttttatactgtatttttaccgtaccttttctgtgcttatagatatctagatcacaaatacttatcattgtattacagttgactacagtattcagtatagtcacatgctgtacaggtcatagcctaggggcaatagactataccacatagccatagcttaggtgtgtagttggctctaccatctaggtttgtgtaagtgcactctgtgttgcccaatgacaaaatgacctgacaacacatagatttccctgaatatatccctgttgttaagtgatgcataactgtatatatgtatttttaatggatcaaataagttatctttcataatggctaaagagagattttttagtaccatttacctcactcgttaatttaacaaatactcatcaaatgcccgttctgtgtccatacgctgagagaggattatggaaatggggagtcagagagctacgacccctgccctccctgagcttgcagtctactgatagatgcagtccctgtacaaacagtggcataagtgcaaagtgctacttgggtgagtgctgcagaggaaaggcccttggtcctgagggatcagggtggctgtggtggatggatgagggatgctagtgttctgaccatgcaggtgcttgcaggccatgccaaagagctttgactgtggcctgagagtcatgggatgccatggaaggggaggaggggtcttggagtttgtgtcacatgattagatttttttccctttggaaagataattgtggctaccttgggaagaatgaattggacaagggatatacaagagttagaaggcagatgtcggagtccggaaaaaggggtcatgacatttggggctagggaggcttcggtaatgaaaaaaagaagtgagggggatgctacaggtgtctggagggggacagtcgctggctgtggtggcagattggatgtggggagtgaaggaagagaagggataaggacagttagaaagcaggagcatggcaggcccattcccaaaggtgggggatgctggcacagaagctggtttgggatgggaggacatcctgtgtagttttgcggtgttcagaggagatgtcagatagggtgcactttggattgtgaacatgtgggtttcagctgggccatcgacagaccttgatggattgtcctgggaaaccaactactgtggaaaaaatagaaaaatctataattttcatttgtttgaattcaaacattttcaccctagacaaaaagaaaagaatctaacaatgagaaaggaaataaataaaaataaatgtcttgcatagtctttgtgttttcatttttatgttcttctgccagtcttttcacataaatattcatattttaattagttgtcattatagtctatgtagaagttgtaataggattgtgtttccttaccattatcccaaatattttcccacatttctgtatctctctcaaggctgcatttaaaacatgttgggtaatattccattcatttgataaatcataaatggtaattttctaagcaattcctctacttttggatatttagttgattttaagattttgttattacaggtaatactttcatagatattatgtgtatcaccttttcttctcgtgtgtttttttcttaaggtgtattcttacgagtgggattcatgggtttaaagagtttggtttctgacttgtgatatgggtcaaggcaaatgttttccaaaccactgacagggctgtgaggcaagaacgaaagggcagatctttgatctccacacggaagctcagcatgtttatttgaattcagtaaccagtggtcctaaccagatcagtgaatgcttgacagggtccttccatcacacagctgggaccttccatcacacatctgctaattgtgccagttagtggctacagacctctataaggccactgagcccaccaccttgccctcagaaccctgggctgggttctcccttttcccaggctttttgcttgtaggaatgccacaatgactttacaaccagtggaagccccagaagggaactgatggaatccctaagggctacaggcagcttcccatgggtttggatgggtgctcaagatcttccgtgacctagtctcggtctaagagatttacttgccattgcttctcaaaatagcacctccactgcaccaagacagattgttctctggcccgggaagatgactcctggccctcactgaagttgctctctcacccttgcctttgcaaacctgacttctccttcggactccaggagtggcagcgccttctggcagcacatctgacttcccacccagctctcctgctacaattacctgcactcctgcagaaccctccgtccacatggcaggacttagcacataattatatgccttctttaatgtttgtttttgcagttgttatttcttgaagataactgtactctcctcgagggcaggaactgtgtcatccttccctagacccctccaagcgtggcttcagtgctgagccctttgcctgaacccagccaatccagtgtgacccattacatcaaagcgtctctgccgatgatgcagtgtgaagcgtcttagctatccttttcttttgtgttttccacataagtgctcctattcaaaacctgctgaggatattatttagaaaatgctcatagatggggaatactcatattgtctattgatcacagtttgggggttgtaagatcaagttaatgctggaaaacaataacctggtcacttgttacttccgagtcctcagtgtttactagggtgggaagggtgactggttaggaggacctgggtggggggataaggagctgtaggaggcactggaatatctctctggctcttaaggaggctggtgtctttggcctgggtgaacagtgcttgtactgtactgaaatgacatgttctgctattgtgttttttgaaaaattgctcccaatggaaccttgccctttttacttctcactttaaatactgagtgcatcagtgttctgattgttaggagtctgcagggggactcacccccagttcagcctggaagttggagctttgcttgttttttagagatggtgtggcagaagagggactctggctgggtgtcgggagccttcaggcccggctgggtctgtagccacccattgtccagctctgcacaagctcagacctcagcctactcatttataaaatgacatacctgaactagatgatctctaggcccttctgcaatggagatgaaaaacaaaataattgaagctctcttcagagggtaagcttgggtgcatttttaactcaaaggagaaataggctcattgacacatttaatgacatgtgttagtatgtgttagaactttacacttaaacttgcatttctttttttttttttctagccaaacatcatgtcaatggcaacagaacagtcgaacctttcccagagggaacacagatggctgtatttggtaagatatcaattctgaaagaaaacccaaattgtgtgcaaagactagtgccaaatttcttagttttagcaagtgttctcagggcttcaaaatctgggctcttctagatatttacaagttgttacagccaagaaaactattgagttcctagtaatttctggggttggaaaagcttattctatagaatttagcgtgctttattttctcacgttgacaaccacgtatcaaactgagtatttgctatttcttatgtccacactgtgaattaacctgctaatttagggtttgagtttttctttgctagcacggattttttttttttccgcatagatatatcactttgttaaaggctggaatttaagtagttttgacttattattacacaaagattaatctaattgaatgatctcttccttctccatcatgaattaagcacgctccttaagagaaaacattaattaaaaatgttttcagcaaaggccaatccctgagtgatatacttaaaatgtacaattatgtggttgagcagaacttctctgttaaaattccaaactgtttggtgaagaggtcctttttaatctgtgtttccttccctccatgcctcatgtcatctaaacttccttcagaatatctctgcacatggccctttctttgcctgccttcttttctccattctttccttccttacctcttcttctgttgggcccatctcccacctcccctccccttctctctagcagtgctctggggttcatccctgtgttacccactgaaaatgacgacctctgtgctctggaatttcaactgggcattcagctgcctcccttggttccttcacctccacgtttagacaggttctgtgatgtctctcatcctaaaaatgtgaggtcccctgatttcacgcctcccgtagcttctctcctgctctggtcttgatggtaatctcctttgagggtacaaaactgctttgaagacttgaattgcgtttgaactggaaattagcctcagaacaacctggtctataaatgagcacactgaagttagattgttcccttattcccagagatggaaccagaattaggcatcagtgaggattagcagctgcagagtcataaacagggacccagttccacctcagtgttggtaaatcatgctctgtgtaggctatcaccttttaaaacatactgatcagtgatgagaaatcattatgcccagaaatttaaatggagaagttgattttgtagaaggcataatggcctctctaaaccatgtgctaaaacgtttgatttgctaactttcctgtcccagcatggtgtctgttatcatgggacagcaaatgtcacatatatcaatgttcaaaggggtcttttgatgatttatttatttattttccagtctctcagattcgccaaccccaggcatatgagaaactaagtcttatgtcatattgggaaatagtaaatgacactaacctattattagtgggtttccctctgttgtgatattgaagtaaaacttctttcttgaagggcagattcagtaccagatgggctgatgacattgtttgactacagaattcgaaataacagggaatgaggctctgtggcaagtctttcttttcttttctttctattttttattttattttattttattttgcagtggggggttgcagtggaaagatttggtttatagcggcttcctcaacattcttccccaaggccctcattgtttcactttcagcgggcaacttcccctctctaagcctccgcttttcgatgaggaggctgacaggtgaactctaaggcctctgcagctctaggcccttggcctttacctcttacgccttcaggactgaaagctcttggagcagggggcagcccctgggaggcccactgtgcatggccagcatgtgtggttttagaagagatgaatcatgtgcataatttctacaagttaacaacatataagaagcagaattctacagatgataaagtagaatatgtttgacatctaagaattcttactttagaagtgcagtttagctcttccagatgcttaaattaaggccttattttggttaagtatatgcaagcattttatattaatgtcttcaagatgatcctcactttctatcacttgtcgccctgggctagggtagagtaggggatttggggggttttgagggtggacttctgccattctgggttgtttatcactgcaatggaaaggtcaactcagcacagtgcttgactctttgggatacattgggcatttcatcctgccagcctcttgcaaagctgatggactcatatactcctcttcctagcgaggccatgtgacttatccagagccacttggccaaggaggtggttggtggagctacagtttgagcccaagtctaattgacctggaatctatgttcttgttgtgatgttccctgactctctctgcactggttcaaggaaccatgggaaggccttatagattcagggacacctttcagctgggtccacacacaaaagtatgatctgcagccaggcccatttagcaaatcgatttgtatacttgcatgccttcccggagtgctctgaaggagtcttgagaagtagcctttgctgggagaatactggttggagcaagatctcctacggctatcatgcttttccatttgaccacagtagcatgtattattaatgcacaggaggatgtcttacattcccttgactgtgagttcatcaaaacagtgatggcacttgtaattgtttagacccgttcttcagccttggaggtcttcatattttgtgataaaatagtatcactaattataatgtcattttttttttttttgagatggtgtcttactctgttgcccatgctggagtgcactggcacgatctgagctcactgcaacctccacttcccgagttcaagcgattctcctgcctcagcctcccaagtagctgggattacaggtgtgcatcaccacgctcaccttttttttttttatttttagtagagatggggtttttccatgttggccaggctggtctcgaactcctaacctcaagagatccgcccactttagcctccccaaatgccgggattacaggcatgagtcatcgcacccggccacaatgtcgttatctgttggttaatcatttgaatataccttacctttagaatgctaccgaaataagaactttgaaatgtaatccactctacagatgaccattgaacttccatgaagcttttagattagaatgtgaaatgtcaggaaagacagatagagtgtgggataaaggcattccagtgtgaaaaatgcatgaatggtcatatcaagggatcagagaatagatagatgattccttaaaaactgtcgctggcatacagtcttcacagattttcttatgtagcccaacagttagtttttctcctggtctccttttctctctggtttttctgcccccatcattcttagcttcctctgtggctctccctctcctctgcccttttggacaatgagaacgaaggtaataggcttggtcctcctggggggcttctcctacctgtgtgtgatgctgtctttcaagtcagtgggagccctctgcttgcaagctggaaaagtggagccacacattttgcaattacttcctgtctttgttcctggtagctgtgagtgcccccttggctctcacccatttgatctttagagcgcccgccctgtgtagtgggcatcattgtgctcctttataggcagacaaactgaggcacccagagattaaagaaacatggccgaggcttcctcaggtatgagaacatcttttgccaccctgctgggcctgtcttagaaaggttctctctggccgtcaatatcttaatgaaagtgacattccgttggccacggtccactctgtccacgtggagggccgggttccagcctctgcagaagtgcttgttctcagcacagaccagctactcattgccttaaaaatactccatagtcaagaagatgggtaatttcacgagaaaatcaaagcttactaatttaaaagggtggaaaatggagggcaggggattccaagcttaatttgtgaagattcttggtacaattaaaaaatattttatataaaatattagctgggtatggtggcatgcacctctaatcctagctacttgggaggctgaggcaggagaattacttgaacccaggaggcggaggttgcagtgagccgagatcgcgccactgcactccagcctaggtaacagagcgagactctgtctaaaaaaaaaaaaaatttaaactttactatctttgaacataaatttgtcatccaaactaggatacattcgagagtaaaaagagtgctgtgaacaattatactgaaataatgaaataatgagggataaacctggagggttttaggcaattaggatataatgtccccctttaacgaggttgtatattataacgtattgcaccaagaataataaatacacaccaagttaagtagaaatggaaaaataatgaacttggatagacaaagtgaacaaatggaaaaaattgcaatgacatagattggattgtatataatgtcacatccacactagtagttacgctaactttggaaattatattcaataaatattgttgtgttcttcctgaataacttcagtttgaaagttaatgcgtattcataaaacctagtttgtgatacttcaataagagtgagggaattgatctgattttacagttgcagttttaatattgtactaatactttccagggatgtagggtaatgaattctccattacttgagatattcagatggtagagtggtcatccttaaccagtttggaggtggggctatgtagcctttaaaaccctttgttctcaattactgagaattgactttgttttggaacactgaaacatttaaaaaaacattctgctaagtcaaaattctttgaacccatcattatttattttttaatttaaaagttttgtgggtacatagtaggtatatatatttatggggcatgtgagatgttttgatataggcatgcagtatgtaataatcacatcatggaaatggggtgtctgtcccctcaaacatttatcctttatgttacaaacaatccaattatactcttagttatttttaaatatacaattaaattactactaactatagtcaccctgttgtactatcaaatgctaggtctcattcattctttctcactattatattttgcatccattaacgatccccaccttctcctgtacccctactacctacccttcccagcctttggtaaccatcattctactctcatctccatgagtttaattgttttgatttttagatcccacaaataagtgagaacatgtgatgtttgtctttttgtgctggacttatttcacttaacatagtgttgttgcaacactatgttgcactatgcactatgacagggtctcattctgttttatggctgaggagtactccattgtgtacatgtaccacactttcttttttttttttttttttttttttgagacagagtcttgccctcacccaggctggagtgcagtgacgcgacctcggctcactgcaacctccgcctcctgagttcaagcaattctcctgcctcagcttcccgagtagctgggatgacaggtgcgtgccaacatgcctggctaattttctgtctttttagtagagacggggtttcaccatgttagccaggatggtctcgatctcctgacctcgtgatctgcctgcctcggcctccccaggtaccacattttctttgccattcttctgtggatggacacttaggttgcttccaaatcttggttgttgtgaataactgctgcagcaaacctgggagtgcagaggtctcttcgatacactgatttcctctcttttgggtacatactcagcagtgggattgctggatctgaaggtgtgaacccgtaccatttgggaactcacgtccaggctttttggtgaaaggtaagattctgcagtgagaaaccttaatgttgataaattgataccaagcagcaacagcagaagtacctctgcaaattctttgggttgtcgtgagtttttaggctcctagtagcctgatggcaatgtctctctgacctcaaaccactggaaaacatgttttccgggtcagattctctgaagattcttcaaacaagagtggggagcaaaagccaagccgaggacttaggaaaatgtgttttttgtcgcacggcacatctcttttgacagctaaggtgccgagtgttcgcgtgacctttttttgaacagctgtgtgaatggacaggtcccggagcaggggcccgtggctgacaggagcccagagacttgtccctctctggggtactcaccttcggcccctccaaggagagtgagatcaatgtaagatgaaccaatcacaagaaatcgtttcctgtctgacatgaatgggaggtgagttttgaatcagccccggttatttgtctgccagccaagaaaacaacattggaagcagccggcaatatgtcagacttcaaagggaagtgtcttggtgtctcactggcacatatccagcatgatgttggtaaataaccgagtcccggtgtggcgtatttctccctgaatcttgactgaaaactactgaagcccattctgtgaactctggaggggcagccactcattccaggaaaaaggccagaaagaatgacattgaaatgtgtttataattagcgaaacaatctaaattcacaagatggtcagaactgcaggctgctaactggtgcaaacttcttaaatggtagagcacttggagagataaaaataggccttcctccctgggtaatttgaagcaacttgagggggcaatggtcattggagacatagtttaagatgcattttattttatatatcttgtgcatgatttcaactttcgttttcttcttgagtgtagagaagtcagataatatagagaaggagaaagagacctttgaaaacctgtgttgaaaatctcttttggtttggaaagcattggctgggatggtgcagccacgttgacctgggctggtccagaaaagaacaaattatggagtcacagaggagggtgggttcatatgtttagagtatggaaggtggactgtaggttggaggatggcacagaatccattgtagaggggagtaagttagagaatgtttcatataataacactttacttgtatagagatcacttatccatgaacttctcccatttcggttgtaagtaagaaccagaaagtgaagccctcctcccacaaaaaggttatggaggagtctgtaaagaattcagaattcccaaaggtcactggagtcctgtaatccttgttgactctagacaagtttcttccgccttcttaagccccatctctcatctgtaacatgacaagaaaactgtttgccacctaggactgttgtcagagtgtcaggaaatgatgcattggccccttggcatggggatgacagaccagccggacaggtgctccctggcagaccacctgctctcctcactctgggtgagctgtgatcaagtccccgggagagtgacgccaacatcactaggctctatgggatccatcacctctccttcataacaccagacgagtcccgtaactcagggattttgaaggataacagacagcattagttgagaactcacctaatattggctgggtactgagaagcccatgttattaaactctctatcaggctcactctcaccatgtgtccaagtgagactggttgtttgcttctgtgtcaatacagagctctcagaaaatactatatttctcttttggcctcaactgtaaagctaatcagatgtggctaattttttcactttttgcagtagtgtacagcaaccacccacttgactgacgttttttcctttaagttttgacaacgagaaagatttattttacaaatgtggcggacatttcttaaatttctacagagaaaatacattcaacaggatgttcaggagaaacaatcaaatattttctattacttctctgttaattaacttttttaagaagagaaacataggtatagagaacaactaaaaggaaaaaagttactcattattaaatttaacccaactagcatttttaagaaaaatacggagcaatcaaggatcaaattcagataatataaaacctaatattctttttcttgttctcattctccccagccatttatcttgggacttgttataaaatggattaaaggaaaattaaaatatatgcaagacacagccaactaacatgcattagaattaggtaaatattaggccaaaggaaaagaaagtgaaatgaaatacacaaagaatgcatgtcataatcttacataatttataaaacttgctcataaatttggctctatgtttcctagcagcaacatgaagaaaaatcagttggttgcatgatggacttcatttttaaaaaattgtggtaacagatacataatatgaaatttatcattgtaaccattgtttaagcgtatggtccagtggtgttaagtaccttcacattgttttgtacccatcaccaccatctagctccagaattattttatcttctcaaagggaagctccatagacactaaacaccgtctagtcctccttcccccagcccctggtaacctctattctacttcctgtctgtctaaatttgactactctagggacctcctatagatagaatcatgcagtatttacccttttgtgactggcttattctacttcgcataatgtcttcaaagttcatccatgttgtactgtgtatgaaaatttccttcttatcccattgtatctatagaccacatttggtttgtccattcacctgtcaatcaatacttgagttgcttccaccttttcgctgttgtggataaggctgcgatgaacctgagtgtacagatctctcttcaagtccctgctttccattcttttgggtgtatacccagagatggaattgctggagcatatggtaattccatgtttaattttttgaggagctgccatatcattttccaaaacggctatacttttacattcccaccagcgaaccacaagggttccaatttctctgtatccttgccaacccttgttatttatttatttttaaaaattatagccatcctaatgggtgtgaaatggcgatggatttcagttttacttactgattctaaaaatgtacacgtttgggggaatcacacatattttggattctggaaccagaaagaaatttttcaagggtacttaggaggacactatatgtactacaaggcatttaggcagcactgctgatggcaccctaggagtgagcggcgcgcaagtctcgtggctgtttgccacactgctcttctctttgggctcgtgaccctctccccacaagggactatttggtccttgcatctctgcaggtgctagcgtgcttgtctgctggctctggtttaacccagaagttaattgcgttgtatctaaaacaagcaatggaccagctgtcttctagaagattttctgtcaatatcatttctctcagttgagttttaaaaggtatttgttttttactttgcaattgtgaaagatttcaaacaaaaatacagagcttagtataatgaagccttgctcgctcagcttccacaggtctcagttatggctaaatgtgccttgtctacatccccactccctccccctcttctatcctagcatatttaaagcagatctcagctgccctatcaactcatccatgaatattttggtatatatctctaaaagataagatggattttttacacctaaaataatactttttaaatatcatcaaatctccagtgagtccatttcccctgttgcctcataaatgttttttaaaactgtttatctgaatcatgagccagatcgtgtatacattgcaattggttaatataaatagtttcttttcatctgtaagttcacccttctttctctctttcccttgctatttatttaagaaattaaataattcagcctgtcctatttcctttagtcttgaccgaacgatcatgttcatttgtcctcttgtattttctacaaaccgagagtgagagggctgatcagcatctgtaagtggtggtgtgtttcattcaggaggcatttaacacccggttccttttctatttatttatttatttatttatttatttatttatttatttatttattttgagaaagagtctcactctgttgccgaggctggagtgtagtggtgcggtcttggctcactgcaacctctgcgtcccaggttcaagcgattcttttcctcagcctcctgagtagctgggattataggcgtgcaccaccacacctagccaatttttgtatttttagtagggatggggtttcaccatgttgccaggctggtgtctaactcctgaactcaggcgatccacccgtctcagcctcccaaaatgctgggattacaggtgtgagccactgcgcccggccctggttccttttcttttggtgaagttagcatccccttactgatcattgcctcagtccattattttcttagaaactgcaagatattctaattctagcattttttaaatttgtgagctgaaatatttctataaatagagacttctctttatcaactgtatggttactgtgagatccagtttgctgaagaaagcaggataagtggtgattttccttatgtaccattttgctccatgtatctgagcatggctctaaacgtgtattcccaagtgtcagtgtatatatggatagttgtttaagtcaaaagccatttaacaagggatagaaactgccttaatttgacggaatgaccattttcacttgggcgtttaaccagattattgaaatttgtaaccagttgggtgaatacttgaaaatagagccacagtacagattgctgcaacagatttgagtaaagcaagaagcaggcacactgtcaggtggcagaaggcaggttctcaggcaaagctctctccacggagcagcgatcttctctctcgttctttccccagatcttgtgaccaggggatgtgctgcagtgcaggtttgagtcctgaccctcagtagctcaggtttaaaaaagcaactccagagagggcctgagggttggaggaggtcttgcttctagatgtgcaatgccttcaaactgttgaaatgatagaaatggagaagcagtcaagaaattacaaagcctgctcagggatgctgcccatagcgaagattaacagctgggccatttcacctggagcgctttttcacgcctctgcttaatatcgtgaatgagtttgagggtagcagaagacactccccagagtggattttccatacttccagttctcacagaaggtgtaggtaaaactgttcgtggttatcactgccaaatttttggggattcaagaaggggagatatttactgacccacttcttttttaatctcatacacatctcgtgtatgtatttttgtaagtggtctcaaattcttttttggaacagtgttgtgtatgaataaggtaaataaaaataaaataattcccatgaatgaaatttggctgggtgcggtggctcacacctgtaatcccagcactttgggaggctgaggtgggtggatcacaaggtcagactgagaccatcctggctaacacggtgaaaccccgtctctactaaaaatacaaaaaattagctgggcgtggcggcggacgcctgtagtcccagctacttgggaggctgaggcaggagaatggggtgaacccgggaggcacaacttgcagtgagccaagatcgcaccactgcacttcagcctggacgacagatcgagactctgtctccaaaaaaaaaaaaaaaaaaaaaagatatttgttaggtccagtacaatgtacacctttttggtttttttttgtttgtttgttttttgttttcccctggtaggcaatcaaaatcaaacagtgccagttcttttttttcaggaataactggaaatgttaccactgaaagcctaagaagtgggattcagttgaagcaacatggttgaaccatgtggagaaacagacgtttagcttggcataccttaggcccaagtagtgtgaacagtgatgcaagaacctgtgaactttccctacattcttatgtacagagtcttaaaagcccacgatcattgtattattctatgtccataaccactaggtgttattaggaaaaacacttttcatcttcctgggtcatcagtgtcccagacttacacaaagaattatatttgaccaagaccaagtttccttgctgagctcactgaccttgggagcaacagtggtgcctgcagatggatgtctttctgatggaggtcccaccctatatccttccagatttcagctgggattccaacattcatgataatatggaaataatcagtgatacatcatggtagacattaccatgaagaaactcaaaacaatctttcaaaaatatgcttagcataagctgagtgaacacatagtcagatgtggccttccagaaccaagcctactcagggtgaatcagcactgtgttttcttaggaaaagaaattttattttatttttttgccatatgcctgttgtctcctaaaaagtcctttgaatctcattcatgtttttatgtgatgacccttttccagtttcctaatttccataattctgccacttgtcaggtcacgatggagctgtttctagtgggagcctgcgtccatctttcttccagcacccttatatggattcagtgcttggtgacattcttattaccctttctttcaccagcattctgtttcctcagcatatgacctttatcagggtggcagtgggcactcacattgggaagcatggaagagttttgattcatcttacaaggacattaagggaggaggactggggagggtcgtctggggaatttcaggaatgtgatgacactaggagcaggaagtgacagctacctgaggacagatgagcccagaaaccctttcccgttccttgctcttggctgaataacttgtgcctggcgggtgtgtctttggccaggcctcacactgacagctctgcagtacagatatgcagtgggatggccacatgatggggaaagcccaatagcatggagtctgtgtggggctctgctttcccacgtgcagaaaatgagagccgccttcccgagcaaatagccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcaatgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatatggcatgtcagattatgataagtgctgttgattaaaataaagcagggaaagagaataggaaatgctaggctaggttgaggggttgtaatttaaaataacatagtcagagaagtcatgaaggaaaaatacctgagacaggttgttttgcacagatttatggaaaaagtgtcccaggcagaaggaatgcaagtacaaaggccctgaggcaggagtggcggaggcctgtgtggctggcgtgtaatcagcaagggaggaggaggagcagctgaggtcagagactacgagatcatgaagggcaattcacaggtaattcgtgggtaattgtggggactttaacatttattttgcacactataggaagtctagagggtttaaggcagaggtatgacgtgacttttttttttttaaagccaccgtgagtgctctgttgaagatggcatgtttaggttggtgagagatgcagcaggaataccacttaggaagctattgcctcctagttcaatacttttggcttttgaacgtaactacttttaataataatacaaaaaaagctttaggcctttatagaccttctcaaatgccatattttcatagttttgtaaggttttctatccctctgttttgagaatttaaatagcccttttaaatgacacattagcttggctattatcaaaaattcaaaagatggcaagtgttggtgaggactctcactgttggtgggattgtaaattggtacagccattatggaaaacagtgtggaggtttgtaaaaaaatttacaacaagactattatatcattcaacaattctacttcttcatatctaaaggcaatgaaatcactatctcagagatattcatactctcacgttcattgaggcactattcacaacatacaagatacaatgtccatcagtggatgcatggattaaaacctgcggtatatatacacaatggaatacgattcagtcttaagaaagaaggaaatcctgtcgttggcaacagtattgattaacctggagaacattatgctaaatgaaataagccaggcatagaaaaacaaatagtgcacgatctcacttgtatgtggaatgtttagaaaagtcgaactcatcaaagcagagagtacaatgatggttaccaggggctggagagatgttggtcgaagggtacaaagtttcaattggacctgaagaataagttctggagatcttggtgactatagttaataataatacattgtacacttgaaaattgctaagagagtagattttaaatgttctcaccacataacagtgttaagtgtgtaaggtgataggtatgttacttagcataatttacttattccacagtgtgtatatatatcaagacatcacgttttacaccataaaattgtgtttgtcaattaaaaagtaaatttataaaaagtgacactagcaaaacacagatacacgtccttcctagagagtatttaggtattactattgctttacttgcaggtcaatattacctgcatttttagatagaatggtttgatttaaaccactcagaatcatgttgaaagtgtgcattggatctcatacaaaatgggtcacttcatgagagttgaagttgagaagcacttcagattgtacttctggtatacttggaatggagcacagggcaaaggaacattgtaatgtgatttagaatatgaaatcagtgcttgaaataagactataatgtatcgatgaagtacatcagcatttgcgtctatctcttaactcttttacctccacagaccactgggatagaatgtcagatattggttatcggccaaatttgggcttcagtcagtgaatttgaagacaggtcagtagaaattctccaaactgtagcacatagagaaaaactattgttatggaatgaacagatcgtcagtgattgggagagaatggcaggtggtgtaatgtatgtgcaattggagtgtcaccagaagcccagacagatactgggacagaaaatgtatttgaggaaataatgaccataaatttgatgaaaaattgtaggggtgtagttaagatgaatgccaaatctagatggttaaaggcaggggtcaaatcaagaccatggtacaaaagattttgggtggggagaaagatgggtataaaacgtgaagacccatcttactcaaagaccgcccctgtttcatttccccactccgaattccttttagaacaaatgggttttggtgacagtgtgttcagatggaatactcacagacttggactcacacctgggttcaaatcccagctctacctaatctaactagttctgggtccatggcaaatcactatagtctgcatcctaggatcatcatttgttcaatggagatagtgatatctctttggcaaggcaggtctaaatggtgtagaatatgtacgttttatagggtggtgatgcgcacatcatagctaggcccttaacagatagtagcttcttctcccaccaaaccagttctttttgtggttatctggtgtcaccgttcacccacttagctataaaccagattaagaaaattacactttttacaaagggcgtgaagaactatggaaatgataggatcatctttgcatgttagaatgattgctccagcctgagtgtgaagaatggcatgagggtgtgagacaagatttgaagaaaccagattgaagtctctcgctacagcccacacacctcttcatacccttcccaaacaaacaacagtattctcctttttcacaaaagagcttgattttcctatttaaaccacagcctcaactattaccagaagaaaaaaaaaagaccaaataaaaattatctgggtccccttttctcaagagcagagagggcacactctttaatgggttagagatgggggctggaccaggtggtagtcttgtgtatggagtccagtggacagagctgagagtccctctactgacagtccctggattcatcaccaccacatttctaagaaatctgattattacctccccatcagagagagacactcctcgtggtacagctgtgatcatatcattcctttgctggggaaatcttggtcactagaaagattcctgcactccttagtctgacatgtaaggttctgcagaacctaatttcaatctactctcctagccttttttaaatgaacactactactagggccgggcgcagtgggctcacacctgtaatgccagtactttgggaggatcacctgaggtcaggagttcaagaccagcctggccagcatggcaaaacccatctctactataaatacaaaaataagctggccgtggtggcgcatgcctgtaatcccagctactccagaggctgagggagtagaatcgcttgaacccagaggcagaggttgcaatgagccgagatcgcatcactgcactccaacctgggtgacggagtgagactccatctcaagaataaataaataaatacatgcatacaacttctcacccaacctgtgttgaggccttgtcatctcatcccttactctaaccactgcacaccctcccatatattcagttgaaaccctactcttccttgaagtctctgtgactttcctcagtccttccccctcaacccttctttgtgcctttgtttatgggataaggtttatcgccttgcattatgattagagattgaatggattacccatctctgcctgtgctctaagctttttgatgatagggcctggtcttggattacttggggcctagtctcaaatataagccctgaatataaatacttgttagatgaatcacgttctttacattgtcgatagaagtgggaaaaattctttttattcatttatttaatttgcccagagttgcggaagaactaattttaaaagtttaggtttgaatagaggagcaaaaagtcatagagagggacttaaagaggaagtctcaagggaacttctgaaaacttctttgggctttagctgttgatgggccgatgttctttatggtgccagctctcgttttgatgtagatgtctgacgagcctagttttctgggtactcgttggatgagtgacactcggagcctcagagaggagggatgcagggtgcaggtgctaggtgaagggaactagtgtttactgaccatctaccgggtgccaagccatgctgaaaggcagagatttccaagggaggaaaatggttgggagataggaaagtgacagaggaagtattctatccatgccagaaagacgtaaggtgtaaatgactgtgtggcatgccataggaaaaaatgggaagtgtgaaattcctcagattcactgcacagtaacttggggaagagctcatgatgctagtcaagttatttcttagcctctggacctcatggttcctgttatgagatttggctaagctagtggcagggaaccacggcttctagtgttttcttcaccccatttctacagcaggtgactgttcaggtgactataggggaggggtcacatgtgatgaaaacactgagtatctcaaaccagctgtcttgcctaggcctcagttttgaatgtggtagatgaaaggtttaactttccactaatagccctcccagctctgctgttccttctgggatgaaatggagtgatccaggctgatctgctgatgttttactgcttgtcaagaatgctaagaagagggtccccttgtggctgcagattgctttggggacctttcatgaagatttcttcatctgggacctctttcccacatccatatgtcctacattttctcttaggattgagctagagctgagatcattctactatattaatcaacacctactgcagtgtcatggtcattggctcattggaattccatagatctcctacccactctagtagggaaaagcaaattgcagaaaccttagaaaagtcagtgcccatgaacagacacatttaggaaatagaaaattactaaaggatgcctcttcggcaaactgggtgccatatgtgtgcatatatgagtatatatatatgtttgtttgtttgtttgtttgtttgttttttgtttttgttaaggctttctttactttgccccaggccagctggtgtgcatatttgtcaggtcctgttagagctctacagctcattctcagcctgcctgatctcagccttgctctcaggtcctcaggaggagtttgattcttttggaccgtggtgctactggctatttaatcctttatcgtcaccatgtccagctagcaaccacttgccttccagcagctgggagaactgtgctggtccagggagctggttttgagaagcctgggcttccacgagcagaggtcattctgtctagagatccatggctcaccagtccatccctggggagcagctgtggctccactgtccttcagagatacagacacagtgaggcacattctgaggagagcagatagtgagtagatcctaaaatgtgttgaatgaggagcagatgaaggagcttggattctgcttggtgacgacgaggcccgtggagttaccagagttgtcttcaagaggtcagagtgttggcaggttgtcataaggaagaggggctaaatttgtcccttgtgacctcaagggagagaattagagtgaaggaagaaacataccaggggtttgattcagtgtaggaatagctttcaagctctcattagatctgtaaaggggaatgggctacttcaagaggcagagggtaatttgagctttgactgaacacttgtttgctgtaatatgaaaggggttatgaagatttccagggcattgaggctagatgagaaggaaggtcccttccaaccttggaattctgattcttgacccctcttggtaaatacatacctggtactcttcagagaatattcccggggttaaggctgaaaaatagcaatgtgtataaagaacctggagctgcattaatcacagtgcagaggtacagtggagtgtacacgtgcatatgagcacattttaaattagggaaggggctgaaaagaaaaattaatcaaattaaagcagcattaggaatgatgtggacagaaggtaattagttgccatcaaatactgaaaatatcaatcaaccgctaattgctatatggtttcttttattagcagaaggtattttcaaattttgtagatttcaatcaagagtagggataaggaaggtgtcttgttgcattatttaacatgatgtagattttcagaaaagtaaagagcacagaagataaattgaaatgtttacattttttgccacgtattcatcttccttgttcctagcatcgtagagctgaaatctgtctttgaatcccccctcccctgctctcttctttgctggatagctgaccagaagagacttactccaggccaccaagatggtgtctgggaatgtgtgtccgtggccagggtctggctgtctctcgtccactgagctacctttctagagttgagctcaggatatttctggtctctgcctatgttccaccttctgatcaaggacctacagctatccagctgtagccggaattgagggtccttttgttgccctggtcagaggtttcatcaaggtgcgcccttttgcctttgaagaggccagggagccgtggagaggagcaccttggaaatgcgctgcatgtggtttgctgtttctgtgcccctgactctacgtgtactttattgatatccagtaaatgcccagtacagaaaatgcacctctaatagggtgctccataaaattatgctcccttcccgagatccacgtgaactgcatgtcatttatcaggtgccactgaatctatgtaatgaataatttgatcccacagcaccatccttcaaaccctgtgtctgcacggggaggctgttaattcagcttgcttgcaggcatccgtagtggtccacagagaccagcttctgacgttgtttccagggaggtatagcagaaaggacgtcggctttgaattccaggccttccttcatgggaatccagagtctgccttggttctatctatgtctttgggcaagtggcctaacctctctgaatctctgttttctcatccttaagttggggctagtagcatcttccttgtagggttatcaccggattccacatatacagatatcagtgtgtggctcacagcaggcatttggtggatacaaactcatttattcctttcccttaacttcctttttcttcatactctttcctagaaaacgatactcagttacttgctgtttgtagggaaaattttatttactcactgatcacaattgtaatgtcacagttaaagttgaggagaagaaaaaaagacgaaaaaagatcttgattctctttatcatttccttccacagagccatcagatcattctatgaccaagtgagatgttataaataatttagttctactcattttttacatgacagattaaggcttcagacatcctgctgtgtgactcagagacacacactcacctgcccttggttgagactaggtgtctttgcaggttttgggtgacaaagacctggctggtgatactgagccaggagatggtgagaaggtcaatatatgaagacgcattaagcttttgcaaagctgtgggttcagaagtagccattagagagggatcatctgagttgggtgataaccaaagagttttatgcttgagaaatggagaaactggctcaggaattctgtaggcagcgtccagagaggctgctatgaggctgcagtatggtacgtttcatctgaggactgggggccggctctgaggctgtaccacagcatgctgtgattctcagagatcagggtgaccagaggagcagctctgacctcgagtggactgagaggggatttagagggtgtgcctgcgcatgtggggagggcagaggtggtgcaggcagggagcctaagagaacagagtggacacgaacgcttactgagtacctcatagatgaaatcccctcagtgactgtgaataatattctctttactcctagtttatagatgagaaaaaaaagggttagagagtacagagaatttgcctgaggccacacagtaagtgtttcagcacgtaagtctgatggaaatatgccccattcaacacttctgaatccacgtctataatctaggaatttggaagaggaaagggagaggtgaaatgggagctctttttctttctgtgtttgactctgcattccccgtcctccccatataatcagtgaatttccactttcgaagcctcaatggatgggctgaattctccataaactggcattcttctttttaggaatccctccattatgaactacactacattgataaagatgctctgtgaaaatttcaaagtgttacagtttaattcagcagattttttccacccgaggagcctcatacgtgcaaggtgcaatgcatgctgtgctatgtgacagaatacagtgtccagggaggtgggccccatgttcagagttctctgcagagagggggttacagggaagccagcaggcattccatagggtagactatgtacgtgcctgagttaagggggtttggacatgctttggggttttaagaagagagctttgtatctgattgacattctggaaagacttaagggagaaggttataccggaaatggcactgggtggatgggcagggtttcctcaggtggagatgggggtgtaggaagtgaagtatgcacacagtcaggagggtggccataggacaaaggttcaggttggctgatggtggggtatggatgttagaacttcaacaactgccctcattttgtgggttataaaagtaatgcatgctcattacagaaaatatggaaaatatatgaaaatacaaaagaaaaccagaggcaaccattattccaatattttattgtattttcttccagactatctgtcagtctgtataaacatttttgaaaaacttcttttgacagttggaatacatacttcttatagaaatttggaataaactgaagagcaaaaagaagaacataaaaatcacctgtaatcttagtcagtaagattcttaagactgtttaagattcttgcatcttacctatttgtgggtttgttgttgtggtggttttaattgagatggagttttgctctcgttgcccaggctggagtataatggcgtgattttggctcactgcaacctccgcctcccaggttcaagcatttctcctgcctcagcctcccaagtagctgggattaccagtatgtgccaccacgcctggctaatttttgtatttttagtagagatagggtttcaccgtgttggccaggcgagtctcgaactcttgacctcaggtgattccccccaccttggcctcccaaagtgctgggattacaggcatcagccaccgcacccagcctgttctgtagttttaaagaaggaagatgacaggtttgaaagtgcatgagatggagactgactggaagggatgagaaaggcggcaaggagggagctgaggcgggcggacagggaggagggctgcagtgagggagctgaggcgggcggacagggaggaggctgctgtcaccgtctagctgggaaaagaaagtacataaaatttgagagactggaaacggtttcatttgagatgagtaagagggaagcacagaggggactcccagcttttctgtgaaggatctaggaaaatggtgatgctgtgaaaacagagacagaagatattggcttggtagtcagcttggtggtagctgtattgaatttcacgtgtcagggagccccccaggtggggatccccagcaagagttggaaatgcctgtcttttttaagctttctcaggtgggtggttaggggtttgacatctcgatttaagtcattctcagatggatgatatgtggtttgaactatatagaaagaggctgctctaagaatgtgaaaagggtcgggtgcagtggctcacgcctgtaatcccaacactttgggaggctgaggtgggcagattacctgaggtcaggagttcaagaccagcctggtcaacatggtgaaaccccgtctctactcagaatacaaaaattagccgggcgtggtggcgggcgcctatagtcccaactacttgggaggctgaggcaggagaattgcttgagcctgggaggcagaggttgcagtgatccaagattgcatcactgcactccagcctgggtgacagagcgagactttgtctcaaaataaaataaaaataaaaataaaaataaaagggtaaacaggaaagcgtgaagtgtatactttacagcaagctaaaacaggcaaagccagtttgttactttgaacagtcagcagctgtgacggcactggggaaagtgtacagtctcagggtggaatggctgtgccactcctcctatccagcctaactttctaggatcccaggggtggaggctgccctggaaattgttgtgtacgtggctgtgttctgagtgaagtctaaaagcaggggaaagagctggaagagagggagcatttggataagacactgaaggaacatgcggtaactgcacatgttctaatgggagcccagcctccctgttggtttccactctgacaagacagactgctcttcctaccccatctgttgttggagggtttgttattcagtggtacccttagtaggcagaggtggagagtggggcattctagttaacaggagtgtgctagttagcaagagaatggagtgtactagttagtagaacttgccctagccaatttatgtagtgaacccataggacatgtcagatctggaaaactgcctttcatgagtgcggaagatgtagtggtcggcctcttaggtatttttagagaatcacatttgaacaatcacaatcacagatctttaccagtcaggtcaaaatttggagtgtcaatgtgtttggaaaagggctttatgaaaatttgaactttctttaaagttcttcctgaagatttcatatgagaacccaaatcttaagggaaactaaaatctcataataaaaaatctcatagacacagatattcatgagtaatgacagattaaaattgtgagtagaaatgcaggaatcttaaggtaattctaaataaaaacaatccagtaggactattggaaaattcttaccaagtaatgattttgtaatgattgtgtcaaaaatgtaaatttgattcagtgacacagttgtaattttgatatgttctttaagtctcttaggtgcttaagtcatgatgtaagtttgaatatttttttccttcaatttaaaactttatttctacggaatgtagatgtccttcagaagttcctaggggaggtggtggtggtgacaggtaaattcattgtgtctatgacttccaaaggccagttttcagaccactgtcatcagtatcaccttaggttaaatattttgtaaggaacaattcagatatatcccggaagaggtaccttttatgctttagtccaggccctctgggttttacctgtttcttgttgtagccactgctgcagcagggaaccctggaaactctaatcaccttcgtgtaggtacaacttgaaagtgcttctctcttcttgccttctgcccaaggtgacacacccatgtgtgtgcaactgtgaaaatgagcctgcaaactcaaattctaaagaatatgaataatgcaaagaaaggaggcaacaatatgaagaaatgaaatataaattgactcgagttaattttttataacaaacaaaagcattttaaaatgtgtgtttaggatgttcaaagaggtcagtgaagaaataataaactatgacagaaaataggcaaaataaaagaactaaatataaaacttggaataaaaaatagctactgaaataattccatacctggaactcttagattgaacccagttgatgaggaacttagttaatgttttagtgaatagttctgatgcacatagagcaggaaaaagaagaatgtatctatcaattaatcagcagttaaatgacacagaggataagttgagatgtgtcaactgacatgtaaagggagttctggagaaatagaattgcgagaatagtggagaagcaatatttgagaatataatagctgaagactttttagaaatgaagatgtgaatcatcatattcaaagtatattttaagccctaagcaagataaataaaaatgaatgacatctagatttataataaaccccagaatattaagaataatgaaaaaatattaataactgtagaaagaaaagacattgcctacaaagaaatgaccatcagactgacagcaggcttatgagtgccaatgatcgtgagaagacaatggagtaacatcttcaaagtattgatgaaatgtatacccagctaaacttacattcgatagtatagacataatagaaatatttcagatataaaaagacttaagagattttataactcatagacagttactataaaacccttttaaagatatatttcagtaagatgaagaattaaaggagagacctgaagcataagaaacagtaattagttaaacaatgattaaaatgttgatcactgaagcaattttaaaaaaataaccctctgtgtgtgtgttagaagaaaataaaaaaggcaaatctttacactgcggtaatgagatagagattgttcagtgtggcgggttttgagtttgggagaaggttagaaatactaactttagacttggtttggaaaacatagtgaagtgggtatgtaacaattgtaagggtaaacactagaagaacagatttttttttcgttttgcctccaaattggccaagggtcaaaggcagtcagaaaagactaataggagagagaaaatgagggaaaagaaattaaaggaagaggatggtaagtagaaaacacaaaatgaggttatggaaagaagtttaaatagccagagtaaatatattaaaattactaattagaggaagagattatcaaattggctaagaaccaaaatcctgttatatgctgcttacaagaaatgcacctaaaataaagacacatggaaaggttaaaaaagaagactgggaaaacatacgcctggtaaatgaatacaaaaaaggtaatgtaggtatcttaatattagaaaaaataattttaagaacaaaagactttaatagcattaaaaatactaaacaataacaaaaggaatagtagcaagaggataataagacttgtgtatgctaatagcatagcctaaactgtgtaaaagaaaaactgacagaactaaaagagaaatcaaaaaattcacaatcacaggaggaaattttaattgaatctctaagaatcagatgtctcaatttgccagaaaattaaacagatatagatgatttacataacaaattgataagcttgtccataaatgtctgtaaaaccctgtacctaagaaacacatagagagaaattttatgcttttcaagcacacatagaatagttacaaaaattcaccaggttgtaggtgacaaaataagtctgaacaaatttcaaaataatgaagaccacattctctaacatgatgcaatcaaatcggaaataaaattgtgaaggtagtataacaggccatatgtttgaaagcaaaaatgtatacttttaagtaattcatggattaagaaggaaatgaaatggaaattacatcagaagagaatggcaatgaaagtactacatatctatacgtgagatgtatctagaacaaaccttagaggttaaaaacatgtattagaaaagaacacttgaaaataaataagctaataattcatatcaagaaggtaggaaatgagcagactaacagaccaaaaagtaaactgcaaaacaagataatagtaaagaaagagcagaaatagaaaacagaaaggaaagatgataaagaggatcagtgaaacccaaggtttgctctgcaacgaaaacctctaaaaagagagatataaaaatatgaatacatgacaatgaaacaaagcatcccctaatgattctcttccttctctccaaagtccaggtgcttcaggaaattttattgtaacttcacggaacaaataattttttttctaatgcggtgttacataggagagaaaataagaaaggctagccaaccaattttctgaggccagtataaccttgataccaattctggacaaggacaatataagaaaataaagttataataaatcttcataaggaacgtaaatgacaaaatctgaaataaaatagcacaggtagttcagtgttaaaatgctctatgagtaggtaagatttactgaaagatgatttagaaaaatctgttaatgtaatatactaccttaagagattaaaggagggagaacatatgatcatctcagaagaaagcatgcattgttaatattcagaactcatgcatgataaaaagcttttcaaagtaagaatggaaggaaactttctcaacctgataaaggatatcttgcaaaaacctacagtaaatctcatatttattggatccttcccactaatattaagatgagacaaggattcctagcattgtcattattcagcattgtatggaaggtcctaggccaatgcaatacaatgagataaaggcaggagaataagaatgggagagggagacagaaaactcatttgtacagaatataactttctgtataggaaatcaatgagaaggtggagtcaaaccattagaactaatagaattctctactctttctggctgtatggaaggcatactaaaatcagggtgtttttatacaccagcactaagtaatcaaaaagtatagtagaaaaaacagtatttataacagcaccacaaatcatggggtacatagaactatatgtaatacaaatatttaagatctttattttcttgcgatggagtctcactcgctcactcaagctagagtgcagtggtggaatctcagctcgctgcaacctctgcctcctgagttcaagcgattctcctgcctcagcctcctgagtagctgggactacaggtgcacgccaccacacctggctaatttttgtattttttagtagagatggggttttactatgttggccaggctggtcttgaactcctgacatcaggtgatctggctgcctcggccttccagaatgctgagattgcaggcgtgagccaccatgtctggccaaatgcttaagatctttatggagaaaattataattataacatggtattgaaggacatccaagaagacttgaataagtggagagctatgttattgttttcatagtagtaaaataaaaccttgcgtaagtcctcattctaccacatgttaactaaccctctagctgatagtacaaacactcactgcgggattttatttataagggctctagaataaaatatgagttattcacactaaaatcacctgttaagtaatattctgaactagttaatgcaggttttcattgtgttgtggttggtctcataactaggttgagtttttctcctctgctaagaggaaacaatactgaagttgtttttcttgtggcatttgtattataaaaacttggtgtgggggtggagcgcaaagctccagcccactgaatgtctgccagttaagatgatgttgggttaggttacatctggctactgtcctgggaaaatcacttttatagagatgggcttccaggtggttttaaaatttatctttctattgacatttgtaggtcaattatatatgttgactaaatttacaaataaacttgtgtgtccaaaccaaattactaatatgacaaaatatttccaaattcatctaagttcaataaaattctatttaaaaattttaaaggatatgttatggaatttgacaagctgatattaaagctgaatagtaataggccaagagtaacaaagaaaaatttgaagaagtataaggtaagaagacttactctactaggtattttgactcattaaaactagcctgattacaaccgcctgatcttttcctacacgtctgctccatccacaaggttccccacttaagccagtaatcttcgagtcagccataaccctctctttctctcaaactctgtgtcaaatctgtcaggaaatccttttggctctatcttcaaaatatatccagattctaatcatgacccatgacttcctccaccaccacttggtctaaaccaccattatctctcacttggattacagccatagtttcttaaccattcactgcatctgtgcttggttcactctagtctattctcaaccgaggacagccagagtgattttgtaaaacataagttttatcatttcctctcccgctcaaaactccaatgtggctacccattttactcagagtaaaatccgtagtccttaaccatcccacaaggtcctacactatctggcttatctgatctttgtcctgctacttcctccttgtttattccactcaagccacactggcttccttcctgccccttagaaatagcaggcacattcttgttgcccctgtaggactgctttctctaccccttgctggggatatctgaatgggtgagtgcctcactgcctccatggctttgtttgcagtcaccttcccttggaggctcaccctatttaaaattgtgctttcccagcccacctgatctctctgacctgctctgcttttcttttcattttttatagctcttgttaccttcaaactatgtcatctacctaggatttttggtgtttttaatctttttcccactagagtatacacactaaacagggtaggatcttgtttgctttgttcactcatttatcctgggtgcttagagcacttcctggcatatagtaggcactgaaaaaatatttgttgaataaatgatgaaaaaacagtataggattggtgcaggaatagacaaatgaatggagcgtaacagaaagcccagaaacgggactacttacaacgatgtcatataaaggtaacattggagataagtgggagaaataatggattatttaataacaatttatttgggattcttggttatgaatatggaaaaaagtaaactgaatccccacctcaccccctacataaaaattatttccatatggtctaacaacctaaaattaagcttaaaattttaaagcttctgaaaatataggatattatctttatctttatatatggatggacttcttatacaaggtacagaaaacataaatgataaaggaaaagatagagaaatttaagaacattcaaatttaaaacatctgtatgacaatagacataagtgaagggaaaagcaaatcagatatgaggtaatatctgtaatcatataactggcaaaaaatagcattcaaaacataaaaattgcaacaaaccaagaaaaatagaagaacccaatagaaaaatgaacagaggcactttataaacgagtgtacgtgagtggcccatatactatgtgaagagatgctcaacctcagtggtgattagctatgtatatgacataatttttttttttttaagatggagttttgctctgttgccaggctggagtgcagtggtgcaatctcggcttattgcaacctctgcctcccaggttcaagcaattcttctgcctcagcctcatgagtagctgggactacaggcatgtaccaccatgcccagctaatttttgtgtttttaggagagacggggtttcaccatattggccaggatggcctcgatgtcttgaccttgtgatccacctgccttggcctcccaaagtgccgggattacaggcatgagccaccacccctggctcgaaatatgattttaagcccatccaattggcaaatatttatatactttgtaacaccaaatgcttgcaaggctgtggcacaacagagatcctcctacactgcttataggacgattgtacctggcaaactccttttgcctacttgtccctgtagcagtgatcccagagtgcccaggcaatagctgtatcttataactcaatggagtcttgctatattcccagataaaagtgtactgttttggggactaggacctctaactctacagagccaagagtgtgggaacaaaagctacaaagtctcccgatgggtccctgagatagtaaatgaagtcaatcctgtttctctcctttgctttccaaacacgtgtattattcatttggggaacatggtgtgtccctacctttggagtgtttgattcagtgtcctggagtccggcacccacctgcacagtttgttcactgaactggtgctgtggctgtgccttggggctattccagtgctttttcaggacggcagttcctggtgacgtgcagtaaaataaaacaggtggaaaccagctgtgggctcactgctgcattttccttgctgcaaagtgagttgcttggtctgatggatgttatttaggggacagaagttggccaagaccctgaaggcaggaaagtcaaacacgtgccaagaatacatgtatgtgagtgtaagaacacatcactggccctttcagcatggaaggggcccggtgtaatcctttgccaccttatggtgggttggtcctctcaaggagtggtgctgtgtgaggcacttggtgacagtctctgttgctggccatttggacatttggtggtggcagtagctaggtggaccttggtgagcgggtgtgcatgctgttgggccatgtgtaacctatctctgccattgtggccagttcgttcctgcatccattacgcaggtactagggtagccagtgaagacactggctggcatcccctggctgggcccctttccatgctttgtggatgagtgcctctttcatggtagatgccctctggctggcattatcatgtggtaaagagatcttcatgctgcatactcactcccacatgtccacctatgtctctctaccccagatttcctaattcttcctcttccagtctttgtgtttctggcctctgactaggcagccaagccacttgctgctgcccttgagtccacagctgtcctgaacttgggctattcttccctctctgaaggaaccagttgggaggatttttcccttacccctgtctttcctggccactctagagtaaggctgcagtggagctgccctgcatttccagcctgcacccatataacaaaccaaccattcaacaccccaccccccgcacccccatcccccaaatcggcctttctctctgcccccagctggttttacaggatcgccacacagccgtaggtgcgaagtgagggagggagttggtgcagcctggtgggtgctgggggagtctggcttcctattcgtgcagctcacgcgtgccctctggtcctgcttgtgcatgattcccgatgtacaacttcctctttatgatagactgtggctgtagccccttgaccttataatctggtgggtctgatgggacttaccttttgatgggaaatttcagccacatcatcccctagtgctccatggctgccatggtgtgcactgtgcagtgtgcttcattatcacccatgtcatgatcttgaagtgctttttcccattaaactaggcttcttggtgaaatggtcgattctgggactggggtaggaaatgtgcaaggtgagtctgggacatcctgtcaaaccagagagcaaagaagctatgagacaactgaggagaaggagccaatttgaagagggtctcactggccaaagatatgactgctgaagcttacatgagagcagtcattgaaacgatcaaatatgtttaaatgaatatgtttgtgatgatgtttaaaaaactcttcgattagcctgggagatagcaagttcgtcatcttgaagacactatgtaaatggatgaagcaagcatttatcttccctgtcccatgtgaattgtaccactgagtaacaaagtagtagctgaggggaagcttttcattataaggtatgaaaatgaagtgatagaattagaagatcactattttgcaactctccaggaattaatacatctaggcattgagcacccatcaatgctaactagacatgaaagagacaactagacattttgtgctttctaatcaaagaccatccatagccccacctctagtcttgccagaggatcaagtctgagtctgatgaagcctctggatccaattgtcaacttgcagaaagttgtcctctgaggacggttgtgtgaattgaattgcaccatgagaacacagtcctcagaatccacagtgtgagaaactgaacaggtcaagtagactgtgatcttcaagggataaggtcaaaggaaaagaatggagacaatgtgttgattaaaatgacttaaagacagccggatgtggtggctcacgcctgtaatcccagcactttgggaggcggaggggggcagatcacctgaggtcaggagttcgagaccagcctggccaacatggcgaaaccccatctctactaaaaacacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaagacgtatcaaatttaaaaaaatgagcaagactataatgtcaggggtggacacttagatgataaagtgtaagaaacataggaagtgattactgtgaaagtcagataacggttgctttttgggctataaggtttctgttgggattggagtgtagcacacagggaggcatgtctagggtagatggcaaacttctgattcttgacccaggtggtggttgtaagggtgtttgcctaataacagtgcattgaaatatatgtttgttttgtgtggtttttttgcatcagttttgttttataacaaaaggctaaaaataagtatttaaagaaaatagtgcatactatattttatttgctgatattcataatgatcaccagattattgaaatttatgagtaattttgctataaataagcctgttttctttgtttaaacacacacacacacattttcacactcacaccttcaaagccacataatagaatgtttagcttaaacctgcagccgctagttgaaatgttgcttcatggagttttatcctcctaacaacctgtgtcctaagtcacattcctctccagaaatgtggacattgaccatattccagtccctgagacgctgtttcagccacacgtggcaccccagacccttgcccacctgcatcctggtcattcatcctcctcctcatggggtcatttcttgatccctattaagcattaaaaggggattaaatatctctctacttgcagctaatgttttgcttggtttggccaagaacattttaagttttaaaaacctggggctattggagtgggaccatgggcaaaggtcaggacaggctagctactaaaatggcctgccacggaccttgtacgtgaaggttgaaggattctggtgctctctggtgccatcgctgttagtcgttgtgcagcacagaaatattttattcaacaaactctgcagactcctgaactttaggggtgggctgccttctgcctggtgctctgcacagatcctggagctctcgtggtcatttatgtgcagtgaagctgctccactcacctacagcttgtccttttccagagaatccctatcatcctcccctcatcccaaggaatgcaacaaaggaaaattaatagtgaatgcttttgccggagacctgtggatacttaatttttatagatactcaataaatatttatttatattcactagcagcaagcaattcacttgtaaactggtatagtggcgggtaacataagcataagcagattcttatgttatttctttgaatattttgcttttctttaaaaatgtaaattttttattcttaaagtaataggaatttattacagaaaaatttgaagaatgaaaaaatattcctaaattgtcaccactgtaatacagtagtggttattatcactttagtatacttagtatattttcttccagtctaattttggtgtgaaaatctttagtagttataataaaagtgcatgtaattgtgttttttcctttttactttagccttaggtaattatgatatcacaaacatatttccatgttgcaatattatcacaaaataattttttactgcattaaattttattatttggccttatatttttattttaacctatttttgattaacacattttagcaaatagaatatctttgtataatatataactttattcaaattactttttgggttttgttgctttggatttttagagtagaatattaaagagtgtcaagaatttcagtaaacttctaatttatctttcagctctgtcgtcaaatctggtaaatcgagtgagtgtaggagtgggaggtgtatagtgtatattaatttgccaactgttgttccactcaggatctcagttatacgtaacttcataaagccatataaaatttgagtgaggcagtaatcttttttacatctagaagtgggccatagaacaccaattgtactggacagtttagaaacttatggtacaaaatgaaggttctgtatttggagcccaaggaagtgcatggcaacatttgcgacgtgcgtgagtgtgtgtgctcttgggagatgggttgtgattttcatcagatgttcaaagagatcctgtgcccactggtatacacacaatgtttgctagttgaatggagtgctacttttgtgagtttgtttattgttgtcattctctccctgcctcccttccaaacccttctcctgcgttcattatatccagaaataaaactcagaaaaatttacttttgggtaagcagtgatttatcacatgcaagtttatagtgattaaaaaaatgaaaactaaacacatatgtgacattgttaattggaaatatgcatgaatttatgttgattttggaagttttcacattaaaatgggtaacttagtgctatactttggtaaaatatttttttaaaaatatgtgaccagggagtggatcattcagtaaattttctattgattcaagttatgaattggatgtggaaatatgaaaatagttacccccttactgtgttatttggaaatgtgtagatttactaactcctttaaatttgaggccttctaagtttttgcacagctaaagcaaagagatattctatgcaaataattgtaaataaaattatttaccaatgttaagaactctccttctttaaaagataaaatcttagtcatttttggttatcaaatgacaggagcaactttttttttttcttcatgtaacaggtgtatgtggatgtgcaatgaccactttgttttgaataatcagtatcctttttttttcttttttcttttttaaggaatgggatgtttctggggagctgaaaggaaattctgggtcttgaaaggagtgtattcaactcaagttggttttgcaggaggctatacttcaaatcctacttataaagaagtctgctcaggtaggaagaatttgctttattgtattactaggagaaacaagggagggcttgtcactactgttgggtgacaggctctttaaaatggaaatatgtttttttaaaaatgtttcttcaatctttattatttgtgtatatatacttgtgagcttctcactttatatgtttagaagatgataatcttcctgtggagtgcaccatttagcttttgctgtggaacaaccactctaaaacatggtggcttaaaacagtcattttattagcttgtaattctgatgatcagcagttgaggctgggctcagctttatggttcttctgttagcctcacctgggatttgctcatgtggctaaggtcaacctgtgggttgcctgggggctagtcagcctaggctgctttactctttggcctggcagttggtgctggctgctggttagcactaactgccagctggggtaatggggatgatggaccatatgtcttcagcacactggcctgagctaattcacatggtggtggatgcagagaacctaagagcagcaagagaggatgaggcccattctctgtttgtgttacgttcacttttataccattggccaaagcaagtcatatgcgctagctagaccagagccaatatgggatggctccccaaaggcaaggatataggaggtatcaagaatcgggaccattatttcaacaatctaccacatgagacagacatttcagatactggttgtgttttctgtaaggaaaaacactgaaagccgtgctataatgcagggatcagcaaactattgacttgactcataggccaaatcccacttgctgcctagcaaactattgacttgacttataggccaaatcccacttgctgcctatctatataagtaaatttttgttgaagcacagctattctcattgttattattatatattatctatgagtgttttcatgctacagttacaagagttgagtgcttgcaaccaactatgtggtctgcaaagcctaaaatatttaccgttgggtgctttacaggaaaaaaatttgctgacctctattctaggctaacagggtaggcagatgccctcatggcaaattctgtctcgaataccagattacctctctggacttgtttctgacctaaaggatttcctttcctttcctgccagctcagatagcatttgaaatgtttttctaaaaaaaattatattcaccattttaagaggtcttaatagggagggagtatctggagttatagtccactattattgatgaaaatggggtgtaaaatgtaaacagttttatctttctaaaataaagtcttaaataagtgtggtttgtggaggatgcgctcagccctccgagggcaccatgaatgatggaggggaaaagctggagtttgggagcttggtgaatagtgagcatgttgatgtgtttgctacaatatgaattctattttgaaataaaaattgagctgtacaacaatgaaaatattataaaaatgtgcatgttcttattttttcttgctctagagaaggattgaaatattctgattcgtatggagaatgtggtgtaacaaacaaatattttaatggttatcctatttttttttaacttctgtttcaaaattaaacgcttatgcatagctataaatagactcaaatgaatcctggagatcacccaggtgtatcctctcaagtcttaggaatggaaatgagtagattccttcctgtaattccagacgtgacttaatggcctaagagaaaaaggttgctaagaaaacctccaagtatctattgctttatacctattatcctcaagcagcaaaatgttaacaatcagttagaatattgtgattccttgtttgctcgaacccttttcagttcagctgtttaccttaataacaacatgataattgccatgtgttaaactcatgctatatgccagacactgtaataagcactttttctgtctttgcttttctctaagcagttccatgaagtatgtcagcttctatcttttacagagggagtgtagaggctcagagaggataaataacttacctaaggtcatacctagcaggaatccctccctcattagctctcagctcaaagtctatgccattgaccatggtgtaagtctcccagctgtcatcatatcccagccattctccattcatccctttgcactttcttccaccaagtcacaaattctctttcatatatgtccctctggtatatttttaattatattagtgtgcttttaaatgattaaggagaatgccaaggaaattcttttgtctttcttatgtttagaaggaaaaagggccaagccagttcatgcaaacagctggtatgttagaggcctctagcaagtggtaaagtatggaaaccacagagactggtaaagaactcgattggatatgaacactacctgctaagttaacagtagcattgggaagcatggttgtcatggaaacttgttcctgattggaaagggatagttatagggtcttacccatacacagaaggagagacgatttctttccctaggcttttttgttgttgttgttctgatcataaaagggaaaaacaaaaaggcagagaggagctatgatagaaaggtccctctggcacagaagtggtacagccttcagatccctgggaataacagggaaggagaacaaataaggtccctcgctagagtaattatggtaaccagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaacaaacaaacaaacaaaaaccccaaggctctggtaagatgcatagtaattgctgaggtccattgtgggagaaatactagtctgtactctagtatctgcttgcaattaagtttgtaaaactttgatcacaatccgtgaatattttgtaaagatttttacttttattttgtcaagaaaagaagcatagagacctggattgtgtgcagattccttctctcataaagcggtatgcttgagcttaaggtaccatgtggtttcttggggcagatgccagaaatataggaggaggggttaacagaatccacagggccagctttaccaccgctctgtgcaacctcttatgtgatgacgcacatcagagcttccacaagcattatctcagcacacaggtgggtgaacacaggccaaggaaccatcggctcaagtttgctacccctgctgtgccagtgggtctgcacagcctcaacaggggagaagtgagcgagagagtgtggatgtgagtgtagaagcagtgtgtgtccagagagggtgtggattcatgtccgaatggtatttctatgtggaaattgataggccagtgactctgaaccccaaatcggagttgtgactaggcatatagaaaagataacatggcttctcatagtagctgagagaggaggtgtccccatcgtgggctcactaatggggctgttcatggtgggcagtctccattgcttggtgccacttgcacccgacatgcgtagagaatacaagggggcggtctcttaggaatttagaataaagtcgcccattgagagtggcagtataaaatcagcctgctctgaatcacagtggagatggacagtcacttggaagagagattggtttctgtgtctgtaggatttcagagtaacctagtggaatgccctgactgtgtaaaaggagcataggtcctcagtaggaggttggtgagctagaacagcctgggagaggggaggtcctggccactctcttgggtgttctgggcagacccacagagcctgataccctggcacttttaagttgtatcactaacctcgtgttctgatccatactctgtaaaactttctaatcttttgtcctcctgtggggattatttacagaaagaaaatgcaatgaaatcaggttagtcaggcagacagttctaattcttatttagaattcaataaaatgcctctctgagatacatatctcagtctattgtgagtttagtctgcacaggtcattctctccaaattgagttaacctcgggctgagttatatgacaaaaacagagttttggtcggacctccatgatcttccaaggcttcagttgcctcctgcatttccctggagatttcctatcccttgcatgtgcccataatttcatttaaacctgttttaaaagtgtatgtaacttttaagtaacctataatcttcccttcctcaggttcattaagcactgaaccaatagtgcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtcatccatccatttctgtttcctacaagctcagcatctggctggcactagggaacccagaacgtggactggaatagccatgaggagcctaacttgtatataggccttacttgaataaattaaatatgccacttactggaaaggtgccacatgtaaagcattgcaccaggtcctaggggaaggttggttttgatgtaaagaatactagttcctgtcttccagaattttctctatagtcaaatgaaagcttgatctttcacatttgttttaagaagttgggctgacactggttttctctttacacatgcacacacacacacacaccctcaaacagttgttatgcaaaccaactgattaactggcatgctgttgctttactacattgattttagaagtaattgagctattcagattcctgaatactctgatagagaattattcttacattttgtaataacgactgtacagatgaaaatatgaaaagacattctgcaatggataagcattctgggttaatttcagtgcattagcctaatatacaaataccccatttctggcaagaaaacccaggatgttcattcactgggtaatatcttttcatattttgcttacagatgttcagaacaattccatgtttattagtctattcaaaagcttttagaaatctgcacagccaagtggcactgaatccagaagcatgaaaggagctgcacaacttttcctcgtaagatttacacaagcagcacgggaaatctgaggcccagacatttccttatcaacagaatactccggtggattttcaagcaggctgttcagcagaggtttcgagcaggagcccaggtgtgggaagagcggagtgtgggagtcctcgtgtgaccctctgggggtggtgatggaactgactgtatggtctgcaaaacctaaaatatttactgtcaggtgcttatgtgtcctgtcctgagcccgtttcctctcttgtaaaatggagcaatgctgcttgatgaaaccagtcaagttgtggttggattcttatatgtaataaacctgcacattgtgcacatataccctaaaacttaaagtatgataaaaataaaaaaaattgttgcaaatctgagtatttgagaaaatctgggatacacactttctagctcttgggctcgttaaagatgaacatgatggatcatgaagcattgcttggcagggctggggccagcttgtggtaagtatgcctggcacagcacacggaacccgttttcttctcttcttcatctgtgttcttaggaggtcaggtcatgtcacccccttttccaaatgcgtgtgatttttttccttgatgcttgagagctctaactgagcaaggaataataatttccccactaatgtaagacaactcagtatacttttttttttttaagtttgacttaatttctgaagtgtttgggtggaagcgcatgtctatgtatcttacatgagatgaatgatcccattcttcagagtagggatgagttctcttattaacagattttatcaagcaatgtaaaactcattctaaattccttgcagactgcattaaatctctttttagtgcatagtcagtcttattgtactcatttcaatgtcagtcaaggtaaattactaagttattgacatactcctgaaaatgcaagaattctggtgttcagttcttgctacaagcaatttgatcgctttttattcctcttattttaggcgtaaaattggaccttaaacttgtagcaggcaggataaaaacgcttatctctctcaaaccaagaggcagaaagcaggcttcaagagcagagacccttgactcatacccttaggaccaaagatatctgctcacccaaccatcttccccacacccacatccaagcagctatgcaagacagattagttcagtgaatggacccattgcctgaagaaaaagtataggtaatgagaaaacagctggttttgtttattgtaaacctcaatcaccagaaatagcaagcttggcttctctaccatcggcacccctctgaagggttgacatggtggggggggggggacataggtcatggggacgtcaaagcatttgagacctagaagggccttaaccatcttccaatacaacagctttcaaactgggtgaccatggaaccctcaggctttcagaagggttctgcaggagctccagaggtaatgatgtttgaactcggtaagattcaagctgcttggagaggccattcacagctttcagctgtattatatgttgatgtcctgactaataaccttattttgaaaagttattaagaatgttgggaaacctccaagactgctttctttgtcgagtaagggaactgaggctgagagagatgaagtgatttgagagattttattagaagggttgaaaatgtgcttgtcttctcagatcacagtgtgactagaacacccaaaagaagttcgaatcgtacacccattctgctcctctcagtgaggtggacggtcaaggattcagagtaggggtggctttggagtgggaaatgttaagatgtgaagagatcatagttttgtcatttggttcctgtttatcatttctgttaggctggattttttcaccagtattgagtcctggggtttcctgatagatagttcttgtgtctgctagatgctttaagtcctgtctgcgatggccagtagcagagctaagggtgtgacagtaaagagcgcctgcaggagcccaggacttaggactaagaaaggaagtcattgaactggggagtggtatccttgctccctcacctccctccctttcaagcttctgcaaattggcttcctggcctgggctggggactgcctgggcctgcagaatcagggcaagtggactgcaaattgatttgtccacgaagcatgggctgcagaccttacatataataacctagtacgcacctgctccagtttacagtatacaagggtgatggcattgcaataagtaaaacatgcactcagccagtgctattgaattcagagcaatttttcaccatcacataggtccttcatccaccggttctaaaatttgagtgactctatgggggttctctggcagtatctaggcgaaatcatgtggtctctcatactcacgtaggtatgaaccctgtatgctgataggtagttcaaagttgaaaccaaagagacgtgcacattttgctagaggtatcccaagtttgcccagttatttaaatccagcattagacatcagagagggtgaggattttctatagcttcaaataactgaaggctggcaagcagcaaaacatagggccccacaatcctgctgtcctcgaatggtaaaaagaggcatttagtgcctttccttccccttcaggccattggctaaagactccaataatgtcagggtctgttctttgtcattgaagggcaaggggtgagtgaattggatggtttatggactctctaaagactattgcatgtgctacgtgttcttcatatgaccttgatattttaatattctatagttggtttggctgttcaactcacgtctctccttgaacagcttaaatcactgctgaggaacaggtgcagcggtcaaaggtcaacagactgacagactttaagtagttaaatgtgtcaatatttcagcaattttggtggtaaaattcaaatagggcatttaagtagaaaacaaatggaaaggaacaataataaaaacatccttttacccattcaacactagaaataggttattctttcattgttttaggattatattctcaaagacttagaagggagattaagaggaatttgatatagcaagcagtttttaaaacataattgcaaaagcagttgatgaatgtgcccacactgatgttttcaaatcacatctaatggagccataatgtaatatgagaaaataaccttatggggggtcagggggttgagcttctccaggaattttatgggatatgctgggtcttaattacttcataatgactgacaatttttagagccttagaataaaggtttctttttttttcctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcagcctgggagtcatttacaaaccaccgaggcccctcagctgcgggagaagctttgcttaataaatcctggcctctgaggcgtggaattgtgaagtctctcagggaatgccgagggacagaactaatttcagcgtcttcgttctttgagaatgggaggtagcatcacgtctctgactggagcgttctgatgagggtgaccacctacccacaacgtgttttgaactcttttatttatagttgttgccttcctctttctttcttgacgtttcctcttcctcctgcttcccctctcttctcttttgcttcttctttccttgagttaaggataagttgttttttccactctggtttattgttataaggcttaaaagaagtcacagaaactggtgacttagcacataatacccatcttaggtttagaagagcaattgaaaacataatgttctcaatgggtattacaatagtagtttcttgccatgaccactttgtaatccacaactcattctacctactaatctctgtcacagtcccatgagatagagcagcatcagtgctgccccttacacaggtgccaggggtcagagacacttgcacagttagtcagtgtgccacctggctcattagaggttttgacaatctccgctggtgggattgaaaataaaacagggtttatgtttaagactgtctccttctaagccttcactcatttccagcaaatgcattttcacatgtctttcgtgagcattttaggataatttaaaaatattaagctatgctagagctgtgccaaagttttgaaaatggcttataaaaaataatctagagatctggaagcgtttagatggatgtgatctacagaaacacgggatttccttttctttagccggatggactttacaggtcatctgttccggtgatttgtttgaaacttttattaggcattacaatcttttcttcaggcaaaaattttgcacagaagtctattaaaacagtgtgcaagatgctgtgattgggagagggggcttcccccagcactgtcctcagtattctggccctagagtgctgcctcaaaacctaccaggagcttagtctgtaaagcagttgaggactagggccaagttaactttgggctgaaacacgcagtaacatgagaaggccttccacacctcgctcatcactagcccactgcaaggctgcactttgcatgctcatggaaactcgcaggattattgaggaggctgtgcagagggaaggggccttttaattctctgcctccttagaggtgcaccctggcaggccaggagccccaggcagagatgtttctgtacaggtcccaggttttgcagcaaggtcccagagcatcccgttctcccagtgaaattccgttttcaatttcagcctgattccctgagtgaatttaatgtaaagctgtcccttccccctcggtcccggcaggtaaggagctgctggcgactgtcacaccagtgcccctgtcagcagacctgcttggctctggaaggatgggttgacaaaaagccataggtacctgaacttgtgtgtctttgtgcacaagaaaaaataatctgtcaccttgtttaaggcgtgttcggttgcgtttgatagtttgaaaatgctctggggaacaatcatctgtctggttttgagagtcaggtcgtaaaatggtgaaatcacatactgggggctggagtggggcggtgggcagtgtgggggcattgggaagctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtcctcagcagccatagtttgcgttgagttcactcttgatgttctgacatgtataatgagtgacctgtgtccaccatgaagttattgtacagagtaatttcgctgccctaaaattctctgtgctcagcctattcagcccatcctccccccccaacccctggcaactgctgatcttttcggagtcttcatgtgtttgcctttttcagaatgtcattgagttgaaatcacacagcctatgtccttttcggattggcttctttcagtaatatgcacttaagtttccaccctgtcttttcacggcttggtaggtcatttctttttagcactgaataatattccatggcctggatgtaccccagtttgcttgtctattcccctgccgaagaatatcttggatgtctccaagttttgacaattacggatgaagctgctgtcaacataggaaactggttttaaacgttcagtagagattaatgcaagaactctggagtgggggaggcctggaggcctgggttgaaatgaagttctaccagagaggatttctgctagctgatatcaggcaactgggggcttcatccatcaaaagcacttaacattgaaacttacttttcttttctgagccacataagtaagaagaattcagacggcacctctgtctaggtgggtggctggtgaaaacttccaacagtacttttctctctccagagtgtaagagttcagatttgcatgtgtccattcttccctttctgtggggcagagatacatgtatttctctgtccccccgaggcgaagctatagtctctgaccccctgagtttcagcccagtgggagtgtttcttgtaagatttctcagtttgggaggaccttgggcttcatctcctgccctccttctcctgccccaaatggctaccaaggtgggtccagaagaaactctcagaggtctgtagtttgtttatcttctaggctttttatacatttctttccttcataatagctcagtgaaaaatgttaaaatattttaaaaatatattgtacccagcattttagttatatcaggcaggaagattgcttcagatgttgatgtgccctttcttggccagggcattgcaaggcagggttagtgctcgtagacaaacaaggattttttaggaggtgatgacaccatttccatcaggggtggccaggaatgggcacgtacagacagaagcattcaagtgacttgagaggatccttaggcagcctggaagtaagaggaagatgacaggccctctccgtctccacaaaaaacagtgtaattaaatgtggaatacccttacccccggaacatttgacctcagagaccttgggtctcaatgcattggacactgacagcccatgtattctactctgtgtgtgtccataaaccttcttcatttagtttatttattttttgagatggagtttcgctcttgttgcccaggctggagtgcaatggcgtgacctcggctcactgcaacccccgcctccctggctcaagcgattctcctgcctcagcctctggaggagctgggattataggcacgcaccaccgcgcccaagtagttttttgtatttttagtagagatggggtttcatcacgttggccaggctggtctcaaactcctgatcccaggtgattcatttactttcaattaacggcacctcaatggcctcccatttgactatagatgttaaataagtacagttgtctctccgtgtttggactaactgctcaaggctttgatgagcagcagagtctcatttagaaggagacttgccttggttcaagaattcactctcttacctaggatgtaattctatttttctgacaggacatgcttgatgggactgatgtctccagccaggtcagcgcagcagagaggtgaacaccagcatgtcttgttaagaagcaggagatgagttcatgagatttccacacacacacgttgatggcctttacatatgagcttggagatagaaaataatagctaataggttttagtcgtttccaagtgcatggcataattctaaattctttacatgtgaccacttcttctattttcataacagctgggggatagggagggggtaggctagtgtccctgtttttaaaatgaacaaatccaggcataggcagattatctgacttgtgtaaacccccataattagtaagcggcagagccagaatggacgcagggacggtctatgtctagagtcgttgttttgaactcctatgctgtgtctctctcaaagagaacaagaaagtacaagtcactacaatgaaaagaactccattgtcagtgagacatacaacacccttccaaagtgagaaagacaaaacacccagctaagactcactggctaattggaaagcaggacctgttattatgtaaaggctcctgtcctactaggtgagattttccttgagggtagggactatgtcttttcatctccctattcttgtgacacctggagcaggccttgctctcaataggctcctgatcaatgccgagttgtcacatcccctcatgcgttaaataaggccgtgtctgaggatcccactggaaagtcttggaagactctgggactcttgtaagccctgcacggtgcttcctgattatatgaggagttggagaatatcatgagaaaagtccaaagtctctcctaagttctgaactatagctcccttctcccacgtggcaactcttccctgatggtttaaagagcagaggtcttggcaaaaccaggctttccctcagattgttcagcagagggctgtcagttatctaagacctttttaagaagcagatagacagcgaggtgcggaggctcatgcctgtaatcccagcactttgggaggccaaggcgggcagatcgcttgaggtcaggagtttgagaccagcctggccaacatgtcgaaaccctgtatgtactaaaaatacaaaaactagccgggtgtggtggtgcaagtctgtaatcccagctacttgggaggctgaggcaggagaatcacttgaacctggaaggtggaggttgccgtgagctgagatcttgccactgcactccagcttgggtgacagagactctgtcaaaggaaaaaaaaaaaaaagaggcagttatatatgttcatctgttgcctttgaccttgtcaaatctattgaagttctcaatgccctgaaaacaaatggacttagatctatggccactctctggcaaaactgagggaattttaaactctagcatcttttgggctgtagcaaggtgacaaaattaagtttctggagtgccccagaggctacataaatgcaattttgtcatttctggagtgttctgtaaatatcgagcctataaaacagaatgcagttacaagaagagttaattcacaggttggtgaaaggaacactgctcataattagagtcaggtggtaaaggacatacttcctggtgaagcaggtgtgtagggacccgtgacattctcccatctggagttgtctcctcctctctccctgctcctgtggctgggggtgggattcctaagtcactttccctccctttccccattcccatttcttctgagtacttactaggtgcaaaacatttttctggacatttgggaaagctcagaaaataatatgttgatattcccctccaggaaggtagaccgtcctgggaaacccaggactagggtttcctggggaaacaagggaaagcagtccaggcgtgtgggggagagattcagggtgctttccaccctctcccggacctcagcttccctgcacctggctttgcttttgtaggctggggctgctgctcctctcggcttcttccatggcagtcggtgccacccagctcgctggtgttcctgactcgggctctgcccgcctcaccccctctgtaggctctccctggtgggtgttctgctgttcacagtcctgatttggcacaggccctctgaggacctcaacacagacgctccagagaagaggcctggacctgcgtcactgagaatgcatcagagggagcagttccgggaaagagaaaacaaccaagtcatttcggttggacgggacataaacactgcaagacaaaattgatgcacaataatgatatgatctgtcagaagaagtggcaaagaaagggaagaaatgagcggctgtgtgtgggcgagccattgatgcaggaggctctccttgccatttggtccagttgcagcagaataaaaaaagctccacttctggatgagggatctcacatgacaagtatgcaagagctgtttaataccaccacgcctggccagtgacaggggcacggcatcctggttagtaatgaaagtggagtgagaaagctgcaggagcctgagatggatggaacagggaaggagcaaagtttccacagaggagacagaggaggaggaagcgggggacagaataccccacgactctagcggcacacgtacacaagcgaggcagcacgcagagttgacaggcacagatggactggtcacgtagcctggagttagggcaacagatggacaagtcattgcataaattggctacccagggaccacaaatgcctgctaggaaatccaaggacgtatcatgttgacccagtgacaacatacctgggcagaggtagacacaggtgcccctgatgtgaaagggaaatgaacagcagtttgcattggtgggggggaataaaaagcaaacgagattaataaggaaaggaaggaaattacattgtgtgcgtgtgtgtgtgcttaatgtcttttgtaagaggacttacctttaattcatctttgtaagacctgactttaattatgtcacttctgaatgttgtaatcgtatgactttcagagcagtgggagaggaaaataacatttggatatttgatagatattcaaaatatagctgaaataaattttctaaacactgaatctttagtctaagcacaaagtgaaaaacaataactttcatggaaatagttacttgtaaaatgttgttcagctttcagaatgaagtataaaatacaagatggagttgtcatttaaaaaccaaatagtactaaactaaaacaaaagtaattcttgctagatatatttaggttgctgtaatagtgtacccaaaaaaaaactatagtctgctgtgatggtattgattacctttttatttatggtaaaaatggatgaattgtcatgtctttaagttgctatttactcaatattttaatatacatttagtatatacatttgtgttaattcttttttaaagctttaaaaattaatcacgtaatctttgaaagtcactatgctagggaccggatacagtggtgaacaggataaaattgtttctgtcttcatgaagggtatataatctattacttaaaaaaaaaaaaaaaaagactataaggccagatgtggtggctcatgtctgtgatcccagcattttgggaggctgagatgggaggattgcttgaggccaggagtttgagaccaggctgggcaagaaagcaaggcattcgtttctacaaaaccttttttttaaggactttaatttttagagcaattttaggtttaagcagaaaaagtaagcaggaagtacacagagttccgatgttaccgcctgccacacatacatccattttcttggctattaacatcttagtgtagtacatttgttatcactgatgggccaatactgatatgttattattaactaaagtccatagtttacattcgggttcacttttggtgttgtacatgctgtaggtttgacaattgtataataagtgtatctaccattatagaatcatgcagaatagttcactccctaaagattccctgcgctccacctgttcatctctccaccctcacaaacccctggcaatcactagctttttacctttgatagttccgccttttccagaatgtcaagcagctgtgtgattcgagaatgggtggaagcatacagtaaatagcatgtttagataggtctttttcacttagcaatatgtatttaacggtactccatgtctttctggggcttgatggcttatgtctttttatcactgagtaataatccactgtttggaggtaccataggttattttatctattcagctcttgaaataattgcagttgcttccagtttttggcaattatgaacaaagctgctattaacgtttgtgtacaggtttttatgtgcacataagtttttaactcatttggacaaatatttaagaatgtgattgctggatcatgtggttagcctatgtttagctttgccataaattgtcaaactgtcttccaaagtgactgtaccattttgctaccagcagtgagtgggagttcctgttactttacatccttgccagcatttggtgttgttggtgttttggattttggcaattctgataggtgtatagtggtatctccttattgttttaatttgcaattctttaatgacatatgatgtggagtatgttttcttatgcttatttgctatttttatatcttcttggtgaggtggctattcagatcttttgcccattttttatttgggttgttgttttcttattgatgagatttaagattgttttggcctttatcagatatgtgacttgagaatgtgtcctcccagtctgtggcttgccttttcattctctgaaaaatttctttccccaggcatccattatttgtgaactgtgtgggttgggcactggtggaccagagtagttctgggaaggtgaattgcaggcctccacagccaggctctgttagtcccaatattctcccagaaagtcaggttggactgttgcatgcccgaatgttggcactcacacctttcttgttcacttgcttctattgaccttgttactgggttgtacctatggttttggcctctcattttttgccgtgttggtcattttgtgcttctgatgactttagtagctgactctggccctggtcccttgacttcctgcaagttctgttacctgactgtggccatccaccctcccacatgggtgctgattgtcttgtttgtgtaccggcttggcctttgccagtgacagtttatcctgaccccagcccgaggcctagtgtctagaaaaattatcatattttcagtggttgattataaaaccagcattaggttgggtgtttctcagtttaatggctaaactcaaaatctttattgctgtcacccccaaacgaagttgccttgctgactttcccatttcttccctactggcctcaccattctcccagtaactcagactgtctgtcacagggccatctttgatttatccttcatcacctgtagacagtcagtagccttgttctcagagtgcttcagtgcttaccattcattctattaaaggacttgagttctaccatgataggaaaaaagactacatcattccaggaaggtatgtgtgcacgttcagacaataggttaatgccatatgcatttttctgaaaaccctgtatctccctatatggcagcctctaagagcctttgtggtaccaaaaccgggaatcattctttggctttgtttttaaacactgaaatccttcttcagtcttctctcttttttattcccactgccaccgatgtgaaactggccctggcttcatggctggccccttgaggcttcgtgctggactcaacaccttgggtctttctgaagggaagcctgctggggacaggaatagggaaagagctgagtaggacaataaggtggagagaaccagaaagcctttcaacccatctttagagtgagatcttcacagtgtgatttcgttattgtatttgaagtgaatgctagaatagctgatgcttttagaaatcaaatatagatacagaacacattacaaaactaagatttggtcattttaaaagctttgttatttgctttttcatcctctcctttcctcctattcactcaagtaaataatgatgtgaccacagttttctttacttaaaaatattttttttcacaggcttcagatctgtgtgtctacttgtcatgaaaagtatattttactttaataagctaatgatttatttcaacagaggaagcagagccctccaagtttatatgagattgattactccaaagctttgactagagacctgttcttgtagaagccagtctttttgtgaaagtcaggtgaattttagattgccttctcaaactctacctgtgtgtcataaagtcactgctatcattgttttcccctcatttccagtagcttatgagaactccagctattagcatgtagcatttaacctcctatactattaggtcgtttctttgattgcccagaacaatcttatcattggatgaaactattataaattatatgcacatagttttaaatgattgcaagatatatttgattctaggtcttttcagaagtttagcattgaatctttttcaaaattttctctttttgcaacatttccagctatatttcaacttgtttatcagaacgatggctgcctgggctaaaaccagtgctgccaggcaaagctgctcccagtggagcccaggtgggtgcaacagggagctggctgtcgggcagggctgagctgcttggagagcaggagtgagcaggtgggcatgatgagggagatgctgggggtcccaaggtgaggaaggaaaagagcaaatggccttctggtgcacgtggtcattaaggtgagatgactagtgagaagccttgagtcttgatgaatgggcgagggagacaatcctttatatcaagtcccaggaactaacttgagagcccaatgtggagggcactggaaagtcagttaaacagttagatagtcccacctgctgaggagatggaagcaagggccaaatcgcagggtgggggtcaggttggcctagagccctctatgcgatgagaagcttgaaacccatctctcagtatgtgcagccactggagctggggtacagctggggtcttggtgagtcctaagtgactgttcagattaggtcacaacagactgaggtatttgtctttaattcaggaagcaagagcattgagagctcttgttcacattttacctgcagctgattcaatatcctgtctgactcttcaggtggtgttttaccaaattatgtcctggaagaggccagtccatattccagaagttagaccagatgctaatatgctctgcagctggctggaggagggctgggtcatataccacgtgatggggagagaagagggaggcagaggacacagtccagcctggagcagacatggagtcaaaggctgatcttggctcttggaagatcctggggggagattgaggtaggacaggtgtgtcacaggggcttctgggcagcattcagctctggggtgctcacaaagtgtggtggctgctggaaatagtgacctatgcctctcattagagtatttcagctgaaagggcctttggaatcttctcttctcccagggtaggaaatagaaactcaacaaaggtgatgactcagcattgtcaggcagctagcccatagcagggactagaccagaaccctggccttttcacttttcagagttcttttagaaacagttgaattgggctgtaagtgatctatattaaagtacatattttaaagtgaacagtatacgttttgacataggtagacactgtaaagccctcaccacagtcaagataatgagcagatccattccccaaaaaaagttacctcgcatgccttcatcattcctccccctgccttcctcaccccgcaggcctggtgcccaggcaacctctgatctgcttcctgtcatgacaggtgtgtttgcattttgtagaatttttttctggaatcacacagatttctttttgtgcctggcttctttgattccacctgttttgagatgcatccatgttctcggatcagcagttcactcctttttcctgctgaatgatattctcttgtatggatgaagcatccttttccctgctgatgaacagtcaggttgttttcagtttggggctgttacaaataatgctgccatcaatattcatgtaccagtgtttgtgtgggtgtgtcatttcatttctcttacattaatacctagaaatggaatgaccaggacctgtggtaggtttatgtttaactttttaagaaatttccaaactgttttctggagtagttgtaccattttatattcccatcagcagtgtacgagggttccagtttcttcacttgctcattagcagttggtatggccagtctttttacttctagtgattgtaacaggtgtgtagccgtatcctactgtgtttttcacttgcattttcctgacgaccgaattatattattttgtcatgaacttacttgccatgtgtatgtctttcataaattgtctgttcaaatctcttatgtatgctttttattgggttattttctcattgtaattttgacagctcttgatatattctggaaacaagtcctttatcagacataatgatttgcaaatattttatctgagtctgtggcttgtcttagcattctcttaacagtgttttttgaaaagtagaacttctaaatttcgatgagatccagtctatcggtttttttttttatggatgaaacttttgtgtcatatctaagaactatttgtctaacacaaatattttctcttattttttcagaaattgtatagtttaagatgtacatttaagtctgcaatccattttgattaatttttatatatagtgcaagtcatttgacacgtgtgtaatatagcaaaaggcacatattggatctgtggattaaggtcactttacccaccgatggtgacagaagtcttctaccagtactgtcatattaaaatgcaaaggtcaatcatacattatatatgtacatcactcaataaacccctaaagtacattgcccagttttcataatacatttaatgaaagaataataaggtcattaagggcaatcagtgttttgttatattcctgattatattcttgattatagtttgttgcatttctcgaacgaacatggatggagcaagaagtattcctcttccccctttaatgcgaaccaacatagtctcagactccagtttaaaaccttgtcaacagcagtgattgcacattgtttaccccacccgctcccggttgtagtaattatggtactttagatttcctggagaggacacagtgcttaatcatgtaattatgtctctggacggctatcccaaacaatgtggagcacgggctctgccgttcatgacaacagccaagagagaagtttgtttgggttcttattgtgcagacacagtgggaggggaggctgcagtggctggggagagcaactcgtggagggaaggagttgattttggaaagacaaaatggggttgtgtagggatatgtggctttttttcttcccccagttcttgtccttataattattccaggagtaggagtccttagcaccactgcattgactgtggtatatggctcagtctccacaccacagttatctagggctggggcaagtggatttgtcccggggaattactatgggtcctagtatttagccttccattgtgcttctagcccagaagtgtgcttgctttacaaaagtcaggagagagatacaggaaggagcaccggagttggagtctgacagtcccctacacctgctgggggatcaggaatgagtcacttagtctctcccgacaccaatttcgctatctgccagaaggggaagagtatccttctggtgtacccaagtggattcagtgagaggacatgctctccatgtacataatgggccaaaggtcatgcattttttcattttatgtggaaaaaatgacttgcacgtgttcgtttgggaggcaccatgaaaactggctttaccttctctagggaccttccctaaccccatcccagaccctgaggcggggttgccacattcattccccttgcatatttccctcattgcatgtcctgcgtcacaatgatggctttgctccctgctgtgagagcaggaatttcttcagggccaagacctgtaatttttatttataactctagtgccatttcataagcatttgatgaataaacaactaaatgaatacatatgaagatgagcagagcagtcctggtgttgaaggaattcataacctggtggaggagatggacacgtgtgtgaataattgcagcacaccgttctagctataacaagcagtttattcacttttaaacaaaatgggaacgcttctttctcatctaataaaattgcttctgtgggcactccagacatttgggtagaaagtatgttgctgaaaaatgatttctaagaagagtagaggagatatggggagactacactcttttattccagccattactcatctgcaggctttcactttccatggcacctgaacttctactcccgaggttagggtggggcattcattacatattttcacagcaccatccttctcttttctgacactaatgatttgtttcccatctgcctcttctctccctatcatccagactagcgcctagcacatagtaagacctcaataagttgctgctaattgactaactatacaatcaaacaagttcacaccataaagactttcttaaaaaataaccctggcttcagaaattttctgaagaggggaacgagttctttccccatcatgggatttgaatatgggcctgtggccccaggtttcttttgagcagggctacagtctgattttcttaatagaacacattacaccattaaatggatctccacacacctggaggagctaacctattgaagagaatgatttcctgttatcctcctggaattcaggtacaatttaacttcttgccattaaaacacaacttgatagtggtaaccttttcccacctcttgggacgcttatttttagttttctggagaagatgcagattggaacacaatgactacagatagataaggcatagcccgcaaacccatttgcaggtgcgctgtgtttccttgcacagtcgtttgtctccaggtttgaatgcttctccaacgcctttattggcagttgaaaatagagttctagccaatgtcgatggattgttaccacaaaatgcaatttgctgctgcacgttgtgctcagataatgggcaagagtagaattcatccaaacaattgtgctccaacaattgtgttcaaagaaatgataccacagagtgagccattctcagttttctgaatcatttaagtggtttcattgtaactcatccctttgtcaactattcttcagtgggaaaataaaggcttaaaggaatttcttttcttcaagaaacagaacttatagcagaatcagaaatatgtcatgatatataggcctacttatggaagaaacaacccgtgttaccactgattactcgatcacttctgtagggctgaggcaacactgttaattctttgaattttctggctgcaccaggcataggtttgtgtgaacaacagggaagtgttacctacagagagccggcagggcagagtgtcaaatgcgtgggattcagaggcagaaaatttggacatcagctttgctgctaccgcttactctctcttttggttttttgttgttgttgttgtttgtttgtttttttgttttttgagacagagtctggctctctctcccagcctggagtgcagtgactcgatctcggctcactgcaagctccacctcccggggttcacgccattcccctgcctcagcctcctgagtagctgggaccacatgtgagtgccaccacgcccggctaatgttttgtatttttagtagagacggggtttcaccgtgttagccaggatggtctcgatctcctgacctcgtgatctgcccacctcagcctcccaaagtgctgggattacaggcgtgagccatcgtgcctggcctgctaccgcttactctctctgtgaccgtggaaaaatgatctcatctaccttgaagggtttgttatgagtgtcaaagaagataatgtgcaatggatagcatggtttaaacagtgaaggaaaaaagttttgtagttgctatagaatgaatgttttcttgtatgaactgaaaaacttgagtcaagtttcacatgggagctttggtctttccttaatggaatattatcagaaaaatgtgttttatatatctgtctttgaaagttttacttatataccggattctgttacaaataataaaataaagttctgcttattggtagctatttctgtttcaagttaatgcacagagccacaaaatgccatacaaaagaaaggcaacatgatgtcctttggctgaaggcttcatttctattcgttttccatagaaattatgtgtgtctgcttttgaagaagcatactgaaaaaaaaaaaaaactatcctctactaggtgccttatttgtgtaatagaagttctaatccaagtttagtaatacaaagaaagagagttttgcagatggaagactgccagcttgacagcagtcatgcccaggatgctcataaggactgctagaggagggaggtcaccaggagccagcacagggccactgaaaccacgtcagagcagctggagttccacacgttggtgaggggtgaaggagaggggaattaagtgttatccaggtggatgtacctgaggttctgtgatttcataagcattcataacgagtattgacacaatattcatcattagctcattcacatcagaccctatgaagaatttaggaaagctgtgattccaagatcttcgggcttttcttcaaaagaagagagttatgaagccaggctgaaggcactgcagggtggaatttgtgctgcaggggagaggcacccggacacaatgggagccaggcgccttccccacagcttggctttgccacggcagaaatgctgagctgacaggaagctcattttgttcctggaagagggctttattttatttcaaaccctcagctgcctggtgcacatttttgttctggcaataaataactttaagctcatgtttgagttctttcttctttttttttttttaatattccatagaagaaaaataaaagtttttatatgaataatttttaagactcagtaagaagtaaacaaacagctttttaaaagtgggcaaaagatttgaaaagacatgtcactatatcaatgatacacagatggcatatagcatccagtttacaggaagcaaggggaatagagaaatgctttctgtgatacctaccatggggaagcaagcaggcaaacccagaatttgggatacactaaggacagctgatgtggcttcttaaatatatgagtgtgttttttaaaaaaggggagagggccttctcaattatgtaacatttagagtacatgaccaaatacgatgtgaggactaagggatggaaattgactaggggaaaaataactttaaaaaacttttttagggtgacaataatcaggggaacttgaatatggagtgggaattagatggtgctaatgagtaactgttaattttgttggatgagataatggtattgcagttatgtataaaaatagcatttagcaattatgtataaaaatattgagggctgaaatgatgtgagatttgctttaaaatactacaaaataaaggaaaaaggaagaaagaagaaagattgatggcgtacatgtgttgaaatgttagtaattgttgcatctggagagcgggtggataagtggggtttattttactatttttgcttttgtatatgtttgaaaactttcgtcgtaaaaattcttcataaccatctttctagaaattatgcagattgtaaaatataagtaaatagtgacataatttgaggcatggattactatacatcttatatgcaagaaacacctgcccgtaaattcaattaaaaattgttttatctctacaaaaaattccgatttatcagacagtcaatttgcattacaaagggcactgtttcttttataaaatagtttgctgtagaattccattaaatgatttatgtaatttccatgggtagtctttttttttttttttggagatggacttttgctcttgttgcccaggctggagtacagtggcgcgatcttggctcaccgcaacctcggcctcctgggttcaagtgactctcttgcctcagcctctcaagtagctgggattataggcacgtgctaccacgcccagctaattttgtatttttagtaaagacagagttggtcaggctggtctcgaactctcaacctaaggtgacccgcacacctcgacctcccaaagtgctgggattacaggcgtgagccactgtgcccggccaggtactcttttttaaaaatcctccaatttagcccctttctttcttcagtctcttctattctccaaccatggatgctggctcccttcatgcctccaaaactttatgaaagcttatttcctctatctggagttattcccttcactttgttctttgtaaaagcttattatattagtcaatattctccaggaaaacagaagcaataggatgatctattgatgagttgatcgatctagaggttaatgtattataaagaattggctcaggattggctcatatgattatggaggctggtgagttccaagatctaagctggagaacaagagagctgatggcatagttccagtccaaatgccagcagcctttagatccaggaagagctgatgttttagttagagttcaaaggcaggaaaaaaatcagtgtctcagctcaatccttcaagccggaggagtcctttctactcaagtgttttgttctattcaggccttcaacttactgggtgaggaccatccacatcaaggagggctgtccgctttaccgggtctacggattcaaatgctaatgtcatccagaaacaccctcacagggacacccagaataatatttagccaaatgtcttggcacagtcaagttgacacataaaattaaccctcactcttactcgcgctttaagactaccctcaaacgaattctacaggaaagcgtccaaatgtcgatactatgtagatttatgtgtttattttttttattctacgctgtacatttcttgagggagagaaatttttgtcacattcatctttcaatcactagacactagcctaggacctggcataaaacaggtatcaagtaaatatctcttaagtgaatgaatgaatggatgaataacagcatctgtagcaaatttaggagaaactgcacaagttagaaggtatcatgttttaatattctaaatttaaatatgactagtaagagggtgggttttaagactggtataagcaatcatgaagagtgatggtttgtgaaaaagtagaccgtgtaacagcagcaaaataaagttagtaagataattctgaaaacaaaagctattcacatgcatatttgagactacagatatgataaaattagcattcagtaggaactatttgaattttgttttagtctaagttatagtgagttgtttaatctgttagcatttaagtcgattagcatttaaaataaaaatggtattcttccaacttattctaccctaccttaaaacctgctccccagaattccacattattttacctgctccttctagtagcatccatatcttgaaataacacatttatacctctattccttactttattcacttagacattagttacttctaccccctagtagttgtgcaactatggataagttatctgattttgctgtgctgtaatttcatcttttgtaaaatggggaaaatagttttctatcccacaatattcttttaggattaaatgaattactgttcataaagtacttggtatgtaataagagtcatgtaagttttataatcatgagaacagtgataattattaatatcacaattatcagtgatagaaagttagctttcttatgcaacctcccaccatctcacttcttctcattctttctctataattgtatcaaaacttttcagtaaatcaacactgtttaccttatgctatgtttatgttatgttattgtggctctgtgaatgtgttctcaactgaagtcgataaatacactgttagggctacttttcaggcaacacaaactattccaattacttcaagcagaacctgagaaagagaattggaggcttacattatgatcctcgagccaacagtgggatttggcagcttcctatctgcggatgaggcagcagctatcctaagaggtctacctgagcctagagagaggcagctgcgttataggaggtgaggataggagagagttgtaccctgcaggggcctggtgaaggaagcctctgggaaccaggaagggagaagccccttcttcctcatgtgtccctccggcgccctctactgacaggggttagcatcaaggcatctggcaaaggacgcaatttacaaggcccagtgctattatcacagagcagagaaagaagggtaggtttggagcagagttaataactggaactcctgttacattcaaacttctaacatgctagtgtagttaaattccagacagtatgtaaaaggcttgggtatgtatggtgggccaggggagcaggtccattgttttcaaatatttgaaaaacagctgcctgagggagggaagacatcattagtatgtgtttctcagagggaccaagaccagggacagttatgggaaagcagatgttggcatcccatgagggttttggatgcttcactccaaatgtcaccattatcctgacactaagagtgatgaagctgaggctagggtgatcctcagtcattttgcggaagttcagctgggataggaggcagaagtgggtgattcccaaggtccattccaatctggagaagttatggacttttcagacatacctgtgttacctaaagtgagttgtgctgtatatatagaggtcagcctacccatttatttatgtatccatgtgttatccatatgcctgattatccatctctctacccatccatccatgtatctactcatccgcccatttatccatgtatccactcatccatctgtacacccacccactcacccatccaccatcatccattcagccatctgtccatccactcatctaaccattcatccatccatccacccatccacccactcacctgttcaaccaagcaaccatccatctacccacccattcagccaaccaaccgtctatccgtccatccaaccattcgtctatcttcttttgagttgctttaaaactcagtaaagttatttcactcaattaaactaatattatttggaacagtgtttattggttggcttccaaggactatatatgatattaatattggaattaatcaaggacatgacgtgcaaatgcattattttcatcagtttagatatgagaataattcttatttgctgcctttcatattccaggtgtccttttttctgaaaatttctcataatgtgccaaagaagataagagtaatgtgagcaaagttactgaataaaaccacatatgaccaaagcattgaaatgagaaaacagaacatgttttcatccccgtgattgcaagataattccatacgatcaagtttgaagtttcagaaatcttaaggaacagctctctaagcagaagagcttaaatgattatctgggtcttctatgactccccgtgttttatttccttagtccaagccttgtgtaagggttcacagtatgattttactattttgtagatgcatcttcttttctgacacatgggaattttaaagaattggagttgtgaaacagaaatgaaagcacaagaagcatttcctctgtacagcctctttattgttcattggtgaaataagtagcaaagagtccaattctctttctcaggttctgcttgaagtaattggaacagtcatagtaaaaagcaagagatggaactaggattcacacctgagtctgtgcccttcaccactatgcactggcatctcccaatggattaggaaatgtgtaagtacaaggagatgccatgagaaacttgcagtcggtcgactctgtcacttataagctgtgtgacacaaaacaggaaacctcagtacaatccatgaaaaaagcagggcccagagattaacatggattcctcaacatcacacagacaaagagttgcacatctagggttggaaatgacgcctcttgacccacaatctggaactcgtttgtttttaacctacttttttagttttgttccatagaaaatcattaattgctcatgaaaagtgaaatcgcactgctgaaaacctgtcctctggtactgggggtttaagttccttctgttgctccaacactggctggtgtttacacactggtgcctgggcaggcctctcgctccgtgtctgggcttcctggtggtcactgcagcggtcgttactgtgggggaaacaggcgacacatgtagggtgacctccgtggtggtggctactctgtttctttatagacaagttacctttctctaatcagcagtccacagcagtggctccctgactgtgcctcctggagcagctgtttggggctcagtggccgagcacatggtcgcagtaagtgcacgccacccagcgagagttggttaatcatatataatccacccaacagtgggctgccttgtaattgttacagggccctttcagtttcttgcaatttcctttgtctcagcagttttggttgcatcctgaaaactgtcaggctttcttgtttctgtaaggacctgacaattccggcctcacaatgcagcttaaattggaccagctgctgcctcaatggagcagtctgcccatctccaaggcattaagcccaaaattatttcgaaaattgaagcctttgacttgctctggattaatgtgattaagcagggcttgctttaatttgtagccatctcgtcctttattaataacatctcatcatttggagcagcatgcgtgtctgcaagacaacagaaagttaggttgattgcagtttctaagagaagtctttaatgtttcaggagcaactgatatgcagcttcaattgtgggggcagatttagatctgcttgttattcttaattttttatgtaaaactaataagcaaatgaatcctccttccctcctccactttgaccccacctccccgaggtctacatatgatttatcgttccctttaagtaataaagaaaggatctttttttcatctgaattgtgtcagctggtgaaatctggaagaaatatccttcagggttaagaaaggtagaattaaatggatttgattttttttctctgtgtaattgaatgtgtattaccattaagataattataaataatctgttagcttttctaaataagaaagtatatacctcattacttgagacctagattttaataataacagcagtggattatagtggaaggaattaggacgtgttttaaaaatgtccttaataatttttaagctcaatgacattattcttataaaatttatcctggcaaacttaagacagtaataatctaagtctcgtatctttttctccttacaataatttagctaatgaaagtacatgtccaggtatttttctgaggttaaatctgatcttccttctttattatcagagccaaagaacacagctctaggagtcagtaaccctggagctactccactttctctcaccaaagcgctgtgttttcttgggaaggtcactcaccctgtttatgcctctttccatatttctaagattaggaaattgaggaggaaactttctaaaatcccttctagttctattctgtatttccaacttctgatgtttcctacccccatttacaaagtgtgtttcactgggtctggttccaatacagtcgtcttgctttttctctgtatggagtaggtagtataagtggcaaaatgtactgatatttgggtcaaatcagattatttctggaagtcaaagagcctcaaataacccaatgtcattgtatatacttaattgcttatcatctttcttaaaaataaatggctatctaatttacggttctttggctacttattagcttataattttttgtattcagatctctttataataagtatgggaggtaatgcatatgctcattagcttgatttagcccttcaacaatgtatacatatttgaaaagttcatgttgtatatcataaatatatacaatttttatttatcaataaaaacaaattaagaaaaacaactctttacataggcaataaaaatacctatgaaggaattgtaggagtagtacctgttattacagcaggggcaagttgtaaacctctttccattttttcccttcattttgcccaatattttgatatctcctgtaatgtcgatgctcgctgtcttgttaaacactttattatcacttgaggcatttatttatttattctacagatatcattttcagaaatgatttgtggtggttcttctggactgagaagagcctgggtttcacagctgggtacagcaggggtggggttgccacttggtctgagtagaaggaattctggagtaccttcgggtctctgtctgggccatctgctgcataaatccctttacaacacaagaggcagcatacttgctcttgacctggttctgtcactgtggaattggaccacctgccatcacaagtagatccagcaaatgtaccgtggctcgcacatgcacaggttgacttcttgttcatgtaacaaccaaaaacacacttcggtgggtggctttcctcacgtggcaattcagggggccatacagctttccttctgtggctctgctatctcccataaccccattgaaatctacatccagcccatcagatggacggagagcacatggagtgggcacacctatggcctgtaggccttggctcagctatggtgcacctcacgtctgctcacattcttgggagacctcacctgcatggccacactaactgtgagagaacctaggaaatggaatttttagagatgagagatagagctctacctccctgtggtgacatggtaactcctagaagaaagggcagaaatggttagtatttgtgagtacagccctttactgaacttcagaagttttagacagtcttttaaagttgatttcaaaggacctgggcatctctacattcccgtcagactaatttgacttgtggcttggtctttcaaagatttttggagctgtaagtcttactggcaccatgtaggtggtagtcaggacagttctgctagtctcattgagcatgcctagtaactggaatagatttttgccttacagtagaattgaaaaaaaattgccccgtgatggttatttttacaaaggtcatttaggtcattgattatctgggcatcatgcagttgttttcttgttgtttcctaccataatttttaccaggctctgctactaaatggctgcatgatcttgcgtatctgctggagcctctgtctcttcattagtaaaagtagggaatgtaattcttaccttgttgggtggggtgatgattaaagcgtgcattgcgtgtcttccatgtagccactcagcataactttgttaaggaaattaattaatacagagtagctgactctccagacatatgtaatgggtgaaaatagggtggagtttggacattgattttagaaacacattctcagagttttaagaaatcagcaatatcaaagctaattccctttgacaactcaactttgtctaagagataacaactccctttggcatctcatctttggggcagcgttttctgatcctacaagtttgagtttgattgtcatcctcccaccctaccccccacacgccttctctgtatgactggtttacgtctctgactctcccgttatatcaaaaacttttttccccatatgcatccccacccctcgcaaggttgaaatgcacaaaattgccatttaagtagttaaaaaatggttgagtattaacagtttcatttggttgaagctaatacctagaaggcacaagatattttgtgagctattgagcaacgtctgacacctgaatgtagcgtccatgctgctcttcttttgagtcctgtgctatgtttagcatccattatgccatcactgacttcatataggccatgaatatgtatatatgtatgatgtaatcctgagtgtgcttctggagctatttcaaatatctatgactcagtgtgcattaaatgtggcaaatctgtttcttggatattctgttgaatttacctctaaagacaactaggcctgatattttccttttggaaaacatgtttttaacttacaatccattttctaaaatagttattaaagatagtgcagccttgctttttcttctttctgggcgaactttgggaagttatatttttctaagaaatttttgacgtgaagtttttgcagtgtttttcttatctttttaggctttactgaatctgtagttatggcccccttttatttgtgatataatttatttgtgctttctttttttttctgatcaatttttttgccttcgtgaacctttctataaagtgttctatgcttcattaacttttgcccccctcttttagttccatccttcaaataccttcgtatagttgtcattctctttttaacttattttgttgatattttttactttttgctcctttctaataattaattcaattcaagttataaatttctattgctgtatcccaatcgttttgatagtagcagctccattataattcattttaaagattttaacattgtaattgtgatttttcctgtttgagttatttaaagttacctttttgatagtgatgtctaatagtcttaagctagacaacttaaaaaatatttgtaaccctcatacactgctggtatgaagggaaaatcgtgtagtcactttggaaaccagtgtggcagttccttaaaaggttaaacatagggttagtctatgactcagcaattctactcttaggtatatacccaagagtcatgacaacctgtgtccatacaaaagcctgtacacaaatatttatagcagcattatttgactattcataatagccataaagtggaaacaacccaaacgcgcatcagcgtgtgaatgggtaaataaaataaggtatacacgtacaacagcgtgaactactaatgcacacaacaacatggtcgatattgaaaatgtgctacatgaaagaatccactcgcaaaaaaccatagagtgtatgattctatttatttgaaacgtccagaatagggaaagctgtagagacagaaataagacacattagtcattagcttggacgggggagatggtgggtttgggaatgatagctaaagtgtatggagtctctttttggagtgataaaaatgttttaaaattgattgtggtaatgattacccaactgtgaatatactaaaaaccactgagttatatttaaataggtggattgtatagtatgtgaatttcatctcagtaaagctggttgttaccagagaaaaaagcattttctaccaaaatcaccaataaattatgatagctctaaactacttactttaaatttgtttgtgctgattcttactctctctcacctctccctctctgccattctcctggacttctccccatcgttggaaatgtcgaataacaaagtttggattatttatcaaaaaggattgatttaatgaaaatgaatggagaaggctgacatgaacataattttccagttcccaccctcataggtaatcatctataaacccactgggatggcacagccttgacaatgcggcggtgcttactaacaagcacacccgacctagacagtatgattttgcaaaagcagaatcctgaaacaatgcaagtgcagtgaacataggagccagtacaccgcatataacacaacttagaaaaatgctatcgataagaaatggtctttcagagacgatttccggcatgtgctacaggggaaaatggtatcaaatctacacaatgaccgggttctatggagtggctcctctgtggggaattttactttattctctttgccagaaaccttgaccccaccctgtctgtgaagtagcagcctgctttgtaaaggggcgctgatcaagacgaaggctattatcgagctgggatccaaacatctgaagcttatcaccaagcacaatagtgacggcttcttagccacgtttctaattatatttttttccctgctttttagataaagggacaaagaaatacggggcttactttgcaggtttttcaggctgctctgaagtgttctttcgaaggtggagggttatagttttgtgtaatagcagtgctgggaacagggtgggttcttccagactctccccccacgtacaatagtgtgtggatggcagagatgcattgggagctgaaataattcatttgtcctttctaatgaatagtaataatttataatttgtactaatcaaaaacctttcatccacaaaagccaacaagttttataaacattctcctctcaccagcctctacagtaagtgcctgacaaaggtaggatcgtccataatttgcagaagggccaagatagagaacacagtgcagaaatcattactaatttatctgcagcttggaatttatatttggaaagtcactttgaacttattttcatcaagctgttttgattgcccagaaatataatttatactgacctccataatggatatctgccaagatgaaagctacaaaagtcattgatccagatgttttctgttatctgcaaacctagcaaagccatatttgccagcatagtcgacattgtggggacaggtgtccattctgtgtccccttggtgtccagccctattatctctgtagcctccggtgacagagcagccatagtggcactgtgcttgatgcaaagataccattaccttctcgtctgttctctgatcagtgagtggtggcgatatgagctgagcataaagcaggaagagtggggatgcccttgtattcagtatacctccagaccttatcactaccaagtgtccaacacagggctgctaagtaatcttgaaaatataccttccactcttatcagtgcaccttcttgacaccaaatctgtattcttgatcctggaattcagaattctccatcaaaaacattgaaaagcaggttacttcatcagctctcctctatatactgtgttgaggaaaagatttgcatgtaattagcctccttccacctccctccagaaaaaccccccaaatttagagaccagtcctaacccttagaaaatgcatagtgttgcagactgcttttgaagattaaagagatgaaaattccattcttaacttcaagagcttccttaaacctggtccaaaagactttcctaaaagcccagccagttcagatgataggtgcagacacatcatattgcatatattcacattacacacacacacacacacacacacacacacacactctcacccttctctttgctggggaaaggtttgttgcagaagttaccattccaatacaccatgcaagatgcattcagacgttctcttagatttcagtatcacacggtggatcctgcattttgtcatataaaaattgcacatcatttttagctgccttcagaaccctcttcatatttattaggagtattgtgctcctatccagcagctaaagctgcttcgtgttgtccagttagggtgaactatagaagaaatgtcctatctactgcttttcttttttaaaaaaatttttatttccttaagttttgggggaacaggtggtatttggttacatgagtgcattctttagtggtgatttgtgagattttgttgcacccatcacccaagcactatacactgaaccgaatttgtagtattttatctctcacccccttcctcctctttccccctgagtccccaaaagtccattttgtcattcttatgcctttgcatcctcatagcttagctcccacttatgagtgagaacatacaatgtttttttttccattcctgagttactccacttagaataagtctccagtctcatccaggttgctgtgaatgccattaattgattccttttttggttgagtagtattctatctcatatatatatatatatatatatatatatatatatacacatatacacacacacacacacacacacacatatatattacagtttctttatctactcattgattgatgggcatttggattggttctgcattttacaattgtgaattgtgctgctataaacatgcatgtgcaagtatcttttttgtattatgacttcttttcctcttggtagatagccagtagtgggattgctggatcaaatggtagttctacttttagtttgttaaggaatctccacactgttttccatagtggttgtactagtttacattcctgccactgcttttctgcttttcttgagggataattggttaattaggaaaactgactgaagagagaatgaatcattattattattacttttttttgagacagagttttactcttgttcccgggatggagtgcaatggcacaatctcggctcactgcaacctccacctcccaggttcaagcaattctcctgcctcagcctcccgaatagctgggactataggcgcccgccaccacacccggctaatttttttttggatttttactagatactggggtttcaccatgttagccaggctggactcaaactcctcacctcaagtgaaccacttgccttggcctcccaaagtgctgggattacaggcatgagccaacatgcccggcacggaatgaatcattttttgaaaaggtttacagaaacctttaaaaaagaaaacttaaataaatgtacgttattgtgccaaacattggattcatgtccattatctctcctttgacctagagtcccctccctacttggagtggctcctcatcttccttctttagcacagtgtggaggtaggagtgaagattctggagctacattatggaggtctgggttctgactccgcccctcagtggtggtgtgatggtggctgtgccatgtaacctctctgtgcctaactgtcctcatctgtaaaatggatataatgaaaatagctcttattggcttgatgggagaattagttgagttagtatatgtaaaccacttatagttgtgcctcatccagaacaagcactgtttgccactattattatcaaatgatctctagttttgcatcttcaaaatctagtgagaatttaaagacattcgtgtagcaacttgaacaaagaatttatctagattttcatgacttcctccccaatctttttttctttaaaaaaaaaaaaaagctggaaaaatacacataacataaaaattactaacagccatttttaagtgtattgttcagcagtatggagcccattcccttcgtcgtgcagtcatcaccaccatccactcctcgagctctcttcatcttgtaaaaccaaaactctgtgaccattcaccaccaattctgcatccgccttctccgagcccttgacagccacccttcccaatcttacggagtagtcttgcctgcatttaatttgacagtatttttaacaactttcttttattaagctttctaaagcatttcccttattttttattttttggttttgttattttcatttgacacctaaaaatggtacctatttatggagtacagggtgatgtttccatacatgtatacaatgtgtaatgatcaaatcagagtaattagcatatccatcacctcagacgtttatcatttctttgtgttgggaaccttcaaaagctgctcttctagctgtctgaaaatatacaataaatgattgttaattatagtcagtctgtagggttctggaatactggaacttattccccccatctcaatgtattttgtacctgttaaccagtctctccctatatccccttccccccgctccttccccgcctctggtaaccactctactctctacttctataagatcaactttttcagcttccacgtatgagagagaacatgcggtatttatcttcctatgcctggattgtttcagttcataaaatgtcatctaagcttatctatgttatcttaaatgacagttttgttctttttttaaaacaaaattaaatattaattttaatagaaacaaagctgtatttcttcttctgcttttatttctgtatgtgtgacatttaattaaaatttctaattagaagataaagtgcaattggcctaaaccagtttgggaacagtcacaactaattgggtaagggtacccctcagctggagggagcttcttggtgcaggcatgtcagagggagctatggggttctgatactgtgggcactgggcaccgtgtctgccagcaggaatggtgtggcttatttaatctaagccatcctgtccattctaggatcttcttcctgtgttacggtgctcgtcattttcaacatctgaagcactcttacctctacctgtgtgtgtctaagtagttcccgtttttcaacattgatatggtttgactgtatccccacccagatctcatcttgaattcccatgtgttgtgggagggacctggtgggaggtaattgaatcatgggggcaggtctttctggtgctgttctcatgatagtgaataagtctcacgagatctcatggttataaaaaggggagtttccctgcacaagcactcctctctttgcctgctgccgccgccatccatgtaagatgtgacttgctcctccttgcctcccactgtgattttgaggcttccccagccatgtggaactgtaagtaggataaacctctttattttgtaagttgcccagtcttgggtatgtctttaccagcagcatgaaaacagactaatacaaacatccagttagatatactgtctccattaaaccaaagcacttgtctgtgcccctcccatggcacctaacactttctatcctgtgttttcagtgtttgggtgagttctccaagagcaggctcagtgtatcacatgtctttggatgtctcctatcattggcttcaagccaagattgaaggctcacatgtattgaattcctggcctgtccggctgggacagagagaatgagtagagaaactaagtatcagcacactttatagttaaagcctgtgtgtacgcacatgtgtgtgcacacacgtgtataatgtaatctttatagcgtacctttttggcgtttttattataactgctgtgctgacaaggaagtcgagactcagagaggttaagcgattcgtccaaatcaaatattctagctacagtgccaatgcccttggcacagtttcccagcacttcattgttgaaacgtttggtgtgttcctgagggcatgtcttggggctcctacattaattactgaccatcatcagagatctactagtcaaggctaaaagattcccaatatcaatcaaattacagccgagtctgcatctatacgaagtcattggtagcaataatttagtagttaccattagctccaatgtttatggggagaaagcatgaaattatggaatcaaacctactgggccctgaatgacctgaattaagcaaataatttggcctcattgaggcttagttttctcatctttgaaatgtaaaacagacatcataatacatggagttcccatgaagatttaatacgcaattaatgcatatgaaagcatttcatgagctacaaaagtgttacaccaatctaaggtatcatcatcatcccacgcttacagagtaaccaggaatctcaagtcaggaaaagtccagtgcagagttcggaataacacagaacaagctacctaagtccagaagtggggcctctggtgtttgttactgagagaacccctttgagacacacaccgttctcatgcgttggacttactattagtgtcttggtctggtgaatttttgctcagggctttgtttccctcataagttaaaataacgacaggcaaaggcacgtagtctagctgaatgctctccatttttgtttcagacctggatatcctacaggtgtgaagttgccaagaataagggagacccaggggtcaaggggaccatggtagagcattagagtcaccctttcctctgtaaagttgtccctgcgttctcaagctgtgtcactgaactttgagaatacccttctccagcagtaattggttcatcctggagttgccatttggttgtttttttgccctcctagactgtgagctctttgaggtcgggacctgtcttaatcctgttttggctgcatcccagagagtgctcagagctcatgctagggtttagtaaataattagtgaatgaatccctcctgtggttgtgatgttggattacgagccccatacaaaagtgaaaatgaggctggaattatagttggtttggtcaccattttgattgtactgatatttgattgaatcagactactgtttttcaggctttaaaaaaattatagtcgccctaagcggcctttttagacatttctctcttgtctcccccagtccccttccattaaatttaataccacagatatactatataccactagttactgtggccctttagaagccgtagccattttcatatgtaagatatttttgtcccccaagaactgatttttgcccccttgaagtgacaccacccttattgagaaatcataatttatagaatcaggtggtttggtgctgtgcagatattctaaagagttcctatttgatatgtacatagtcgattataaagttcttaagcctcagttgcttgttgtgttggcatgcttttaagataaagctgttggactgattttttttggggggctgtggtgtaaaataactgatgcttttggcactgtctaggaggcaaggccaagactttcctcagaccagcaacagtgtttcagtgtgggtctgagttataaacaaatctgaagttcttagttccattttttaaaaaaaatttagactaaaaatgtacttacatttattattaatagtttagttagagccatgcttcctgagcaatcctgccacatccttcctatgtgagctatttgtaaataatgtactatccaagttgggagaatatgttaccaccatatacacttaaaaagcaactataatgtggctaatgtgcagaatgaataggcaattttcattgtctttggatgacgtgaagtagctctctggcaaaaatggtgcaagcagccacggtgtttgaagtggtgagcttcaataggagtgccatttctttttttttttccttttttctttttgaattattttactttatcttatttttttgaaatggagtctcgctctgtcgccaggctggagtgcagtggcatgatctcggctcactgcaacctctgcctcccaggttcaagccattctcctgcctcagtctctggagtagctgggtttacaggtgcccgccaccatgcctggctaatttttgtatttttagtagagacggatttcaccatgttggccaggatggtcttgatatcttgacctcataatctgtccacctcggtctcccagagtgctgggattacaggcatgagccactgcacccagccttctttttaatttttgtgtgtacatagtaggtacatttatggggtatacgagatgataggcatattatcttgtgtatcaagatagtgggtatatatatttatggggtacatgagctgttttgatacaggatgcagtgtgtaggaatcacatcatggagaatggggtctgcatcccctcgagcatttatcctttgtgttacagacaatccatttattttcttttagttattttgaaatgtacagttaaattattgactatagtcaccctgttgtgctatcaaatggtatggagtgccttttctcatccatcgcatggagagtttagaacagtttttgaagaatatgaaaacatattggacttgatttcaaagaccccttctattatcatgctcgtagggcctctctagttgtcttttaactctgaggtggaacacagacacttttaggaaaacgtacgcttgacaacttacccagagaaacctgtctttgcttggagagccgtccatgttgttctgtttgtactaacatagatcctaaacatttgaagtcttctggcatctcattgtgaagttctgcgatgccatggttgatcattattagtatatggagttataagatttgattaccactggtaagttcccaaagtgctttgtgctttcccctttatgtctgttattgctcttaaccatcttctaagattgataggacagatattagtatgcccattttatagatgagcagcctgtggctaagagaagttaagtggcctctctagcagattatgccctcaaatgtagaaaaactcaatgtggttcttcagactccaaagtcagtgccatttacttgcccgtagtaaatgccttcagccttcttaaaagccatcgtggaggagtgagcaggtcccaagaagcactgcctggactgtgagtaggaggaggcagaagttgacttaataaaggcatggatttctagcaattaggacatcccaatagtggcatgaactactttgagaattagagagtgccctgtcttgaaatggtcatctggaggttggagtgggctaaactatatagtatgccatttggctagatgacctttcaggtcccttacaattctgagactttgttgaaaaaaaaaaatgttctgtccatttcctcctttgtggtttagccacatacatcagatgcccaagttcgtggttcctttcccagctttgcatcagaagcacccatggggctttgtgagaatgcatatgccaggcctgcccccagctctcctgtatcggaattccattggtggggtggagggggaggcgtgagagtatgtttcagagttccacaaggatttctaagttgttaaattgtgaaccactcttcttgtgtagcccactgacaacaaggcacacacagacctctttttaaacttggtggtataattcagtagcatcaaggaatcatagtttctcagtgtgcaatacccttgttaatattaaaaggccatttaataaactgcattggttctcttggctgcagggataccatggtccctgcttgacagattggttttgcccatatcttatcatccctgcctgtttcgcagcagagtgggagtttggtgccagtctagaaaatgggcacaggtccttttgtacccttcttattctggaaaatccagctcaaagggttagcattgggtgcgaaggccagcctctgaaatcagcaggttggatacagaaactagggagtggctcactgctatcctagttacctacttctacgtactggttttctttgtaccagttagaaacctccagtgcacaaagaattaacggttgccattgactgctttcttgaagacttttcttgatccagtactgagctgtgtttatggcactcctctgagagcataatctctgaaggatatgtctgtataaaatatacagcagaggatcataaattctccatcgtgtctccccatggcgggccaacaacaacaaaaaattcacaattgctccaccagtattttttttctacttttcaatcaataggatgctttttaaagcttatgtttctcgtcggacactttaagtgacgaatgagacaaaagaaaaaaaaaagccaagataaaatgacagtatagacactcctcaaatcctataatgaactccacagggcatccaattttgatgtattaggattttttttttataatgagtacattgttggaaatcacattttctatccgcaggagctggagatgaaaccgagctgacatcttacctctttgtagttaattagcaagagaaaagtagtgttttgaatctcgtgtgggaaaaggggaggtattattcacccaccctcgcccctttctcccttcaaacacctggatcattctgtgtgctctttgatttggtttaacggtttggataagtctggctggcagggaaaggatgagggaggttgaagaatggttattatttaatgaaaaaaaattactgtgtctccctctcccctccatcttgcttataggataaataaactaagtcaagtctttttattttaaagatcagtttcttacctggactcggactctaggcagttcccgtggcacaagggttgtttgttgtcaccatcgttacattagtcaccgtggaatcctcagtgctcagcaccgtgcatggagcttagcaggcatttgatcagtatttattaatgaataaataaaatggtgctggcccatacagtaaagtattctagtcgcattagctgtgtctaatacctttctctgcatagtagccacatccactttaggatttgtagtgaggtttccgtagaattcagtggttagggacagagggttggagtccagtgtgcatgtgggattccatctagggactggtcattggcaggtgaatggagctggggtccatacagatgccccgtccggatgaaggataagtgagtggtgggcagatgcagcacgagggctcctccggcccgtacgtctttattaacatcacatcacatgcccagtcctggggcctacagaggagagccactgtcactaagcacatacttgtaagcactgagcactcacaggttgcaccgcatgggactgatcccaagtagaataagatggggcggcagggccgggtgtggaaggaaacaccactttttgcatctcctctccctgcccttgctgaactctgcctgctccctccaccgtcggtcctcttcacagccacccgctgggggaccccaggggaggtgactcagtggaggagccctgctctgacaaagtcagtcccacagaatcgcagtggccgggctctctccctgcacagcgcctcttcctggggtccccagctcagagaagcctcctggaggaagcaagactcgaggggaccctgaaagcaggcagggcttggactgtgggtagcctgggacactgtggactggggacagcaggacctggggtgaccctgagggcagagagggcttggtgggcgagccctacaggctggggacagcaggagccggtggtgggtgtgaggggttagcctggcctggggagggtgggggaaaccaggttgctgtcataccagtgatggagggccctagtggccagccaagggctcctgtaggccccagggaaggggacagagatgacaggtgtggagaagcagcaaggaggagggcttgttggcctctggctaggcttggggttgtctccgtccctcgtgagctctgagccttggctttcctctcagtaaaatggacataggagcatttaccccaatggccaagggtggctgcaatgctgacatgagtctatggatctagaggctttgcagggcacaggacactgtctgaaggcagagtctgaggttcctgtccctataggattgcatcaggggtgcgccatccctatgatgggccagctaagcagctcccatggtggccaggtgcgtgggtaagctcatgagccactttgtggctttgcaacaacaaagatgagctactgcttccatttggattcctgctcttgctttggatgccctccccgccccacaagtcatctgccgtgaccgcttcctccgtgtgcgtctgacgtcccggtatgcgtgtgactgctcaggcgtgactgcttagcgcccaccaatgctctcctccagacatctgcatctctgagcatcttagcctgggcctcagtccagcctcccccacttgatatttgaatgattttggacgagcactgtgttttggatagcactgtggtgactgttactagggaatcatctggacagcgaagaaaggtccgacgtgtctctggttccccaacctcttcctcagctgtactgcaggtctccgtaaagggttcctttcctgtttccttcctcccctcctgcttcctccccttccctctcctccctccctttccttccccttctcttcctccttgccctctggggctcctgtgagtctcctgatgactggggcagcaggtgctgggacacaggagagcacaggctgagagctggctactcagggatctgtggcgctctagaccagtggttcacaacctttccttaacactaagaatcatcttgggccaggcatggtggctcatgcctgtaatctcaacacttcgaaaggccgaggtgggaggatcacctgaggttaggagtttgagaccagcctggccaacatggcgaaaccccatctctactaaaaatacaaaaaccacccaggcatggtggcatgcacctataatctcagctacttaggaggctgaggcagaattgcttgaacctgggaggtggaggttccagtgaaccgagattgcaccactgcactccagcctgggcaagagagtgagactcctctatctctaaataaataaataaataatttttaaaaagaatcattttgggaaacttttagacatagattccctgaccaaggacattgggaaccaagtcacagtagcagtcaaatgatactagcaacgctgccatgaagaaaggtgataccggctgagttattctgcctgtgctgggccagactgctcaaatgcctcccgtggagttttgagctaatcatcaggacagtcccctgaggtgggtgctatcagtgtccccattttgcagttaaggaagttaaagcccatagaggaagaagctttgccaaagtcacacagctgctaagtgaccagggtggcaactcgggcactctggctcccaaaccgagttcttgagctctcctctccatgctcctttggtctgggtggtgcccagccatctgtctagataggtatcctgctgactgcaatgtggcagtctatggctggtagggacgtgggggaacagtgtgaccgacctccttgcacagggctgtcattgcactgcgggctacagcagagcccagttcacactggagggccacccactcagctgggctgttttctgaggaaccagttgtttgtcctcccctaaccttctccacagcagcacagagtccaggaaccctgagcaccgggaccagggccggcttgggaggggtgggggcgggggctttgtgcacaggtcttgcctgtgggcctcatttctgtgtctctggtatgagaaaaacctggattgaatagaaagaccttccctgaaactgggaggttgctgagagaccaaagaatgacttggacaagtccagcttggcgatagatgagtttattaggacttacatagcaggcactcctgggcggcaggacagatctagagatccctgctgctcccgtctctaaactgcctttaagctaatttcctggctctttgcctactgtgtttgggcaatgagactgcttgtcttgctacgttctcagataagttccggggcattgggttctcagggacgcctgctcctcagctgggcaccatggcctcagctccacctgacttcaaggctcaagcagtggacacacacctttaaggaacctgctgggggaccgtcgcactgcgctgcctctctcatttcccatttcttgtccccacgaagcctctccggaaggcacaggctctgctctcgttcttactccttccttctcacacagggacctggggatctacacagaccacgtgggcctagactgctggcccagtgacccttggaggcccccttggtccttctagatgagccccacctgggaccccacgcaggccgagctgctcttggttctgacggctctgctcggcctccctcccaaatctcgtctacataagacctgcttccctgctggcgaagcaccaccatttctatggagaacttggggtgtcattctcaactccagtctgagttgccatcatgttccatgatgctggcagcgtgtcccagcctgtggtcacttggcaccccctggagaggtggacttgtactctggatctgcagcccaggcagcagtgggagcctctcctccagctcagccccggtgcctctgccctctcccaggtctcatggactctggtggacaaaggttcttgtcagaggaagtcgttgacagggtgccatgggaaacggcctctccagggaggcaagattccagcctcagctcttgctcctgtagcccctctttcggaggtgtctttctgcctggattaaacacttgctcattaaacctggcttaataagaaactagaaaagaaaaagaattagaaaaattctgattctagactgggtaatcgctttgagaaatgcgatttttcccttttgccacttcatcaaaagagtgagaatctgggcctttctagggtgtggatgaaggctgagctgcagtctccagcagaggaagctcagtgcccagaccagtagtacacacaactgagacttctagaatgaatgaagaatgaatgaatggataaattggagtgaggcacttacagagataaaattcagtttgataagaaggaggcgtccttaaatcttgtgttttctcctagagttgagtcctaatgggggcggcatccttgtacggaaacacgaaaggttaatagcaataacaatagaaacctcgtgtttgtgtatggagagccttacgcttcccaaatactttcccacagatgacctcatttaatctttgttttgtcacagagatattttattcccatctaaaaaagtaggacacccgggatcacagtcaaaaaggtattaaactctgtgttggaatgatggtttaagctacttcttgtgacttctattccaattttccccatgtcatcacggctgattagagaataattatgataatacaactgagaataatataagatgtagagacttaagtcccatgtgccaggcactaatcacccagtttgcaggtgaagaaactgtgcatagagtggttgggtagataaaggcccccccagcatgggtgtgggtcccgaggaaaggcatggctcatttgccagggagctgtggtgtggacctgctttgcctcctctcccagaccccgccaaggtcatgcacctgcccagcagcagagccaggaggccaaccctgacaatctgactcctcaccactacctgctggcatctcaccacagctcaccggctctctcttctgttcttatgtactgcgtgggccagttccctgctctcttgttcttgtcccagcagcccaacagtagcaaaatctaattatcctaacctggaagaatcaaaggtgacattttctccacggataggaagctgtgctggaggactgtaaacattggttgacttatctcggggttctctttaaaggcacctagttccatggatgacttagcttccatgtagctagatgaccccagaatgcctgattttcctggccccaggtcatgcttgtatgtctcttcttggattggatgcttcgtctaatccaaggaatggctgcctttaatcaacccctctccatttgttcatcttcctctggggctgtggggtaaggcagtggagggagatgcttagagaggacatcatccttttcattttttctttcaagatatttttgaacagcaacgttaaagcccccgtaatgctgctgtgaattgttaacaagcatgtttgcacgtcacatctatcatgctatgtgcgcgatgttatgtgaagacacggcttgaagtatttttaagatctggcctttcatctctggaagcacaagaaagtatttgcagattggtctctggaatgaaattagcctagcacgttggctggttcctgtaaagtgtgggcatttctgtaagtggttctgagtcccttaatccttttgatcatttgcactgtgtatttttacacaggttcttttactttggagaaataaagtaaagaaacttaaaggtgagtttggcaagggcatcactgtgctgtttgtcaaggcaaatgaatcttgaatttgaatggtagtagtttcttttaaacaaccaagcttctttaaacctctccacaaataacgtcagtggcagattatgtctgaaagtgtttgctggcgagtggaaatctttcctgaccccatattgctgtcatgaaagaagagcctaatcccataaaatattcttgacagcctcgtgtcagttaccacacagctgtgatttcttatctgggctacagcctgtgtgacatttgttgtcacttcatggcttcaggtttctccattcagaagctcaggtcatagtaggaggttgagcttcatccccggttgaaacctggttcgcgtatgactgaatcctcttacgtcctcactgttgtgtgaaaaaactcatagggagaccttgatttcctcatctgtttaatggggaccatatgtctctggcaaaatcgttgtgagcaatgtttgtatgtctgtgttcacagtagcattgtttgcagtggtaaaaaggtagaggcaacccacatgttcgttgatggatgaatggataaacaaacaaaatacacccaatggaatattattcagccctaaaaaggaagaaaattcagacacatgcaacaacatgggtgaaccttgaggacattacgccgagttaagtaagacagtcacaaaaagacaaatagtggattccacttataggaagtccctagagaagtaaaatccacagagacaagaaagtggaaagggggttgccagggcccagtgggagcgggcaaggggagttgatatttaatgggtacggaatatcagttttgcgagatgaaaagagttctggagccggatgattagtgatgattgcaaaacattgtgaatgtacttaatctgatggtaaattttatgttatgttcattttatcaaaataggaaaaaaatccatgagcattaaatggcatcaagtagataagtggctaccatatcattgttgttcactaaatcataaagtaacagctttgaccatgtgtgggatagtaaaatatgtggtattttaatggttctatgaaacttcatcttatgagtataccatgtttgtttccctttgtttggcttgtgtatttcttataagtattctaccattgtaataatgacagagtgaattttttgtgcatgtatatatcttttctattagttgaagttatacctttgagatggatttcctggatcacttaatcaaggtaaatgagcgtctttgtggctcttgctacatacacccgtggggtttcagaaaagatttagtgattttaccctgtcactagccaagtaagggcaccatttcattgtatcctcaacagcactaagatgcttctaagcaattttattaaatgtgataagagataatatgttagtgtttgaatatgcatttatttgctttcattttgatcactaaaaatgttggcattttgcatgtctcaatttacatgtatttcttcacataggaagaaatacatgtaaattgagaagaaatagcctgtttacgtcttttgcttatattttagtgtggtttcaatgtttttcatgccaaatatgtctgtcatgttgataacatattaccatttttaatattcagagatttttaatgcttatgtagttgaatcacttatttaaacatttcaaattacaaaataatatgttctactagagcaaaagtggttttacaatcacattattatacctactgtatctttttcccaaactctccactgtcattcttttcatatcttttagcataaaatctgtttagatgctaacttgaatgactatagtatttgaattaaaattatatggactagccaattaataataaaatattaatataataataacccagtataaaaggacatgccaattagagcaaagaagaaattaaaattgctaataaccatgaaatttgtgttttacttcactaataatataaattcatcctaaataaaacaatagaatcctatcttccagctatgaattgctaaggattaaaaatgttgtaatggtgactgagactggccctcaaaaacgctgccaatggaaagagaaaactgggtcaactttactgaaaagcagtttggagctaggcatcaagaaatttaaaaatgtttagaaacattgatttagaaattccatttatataactaaggcttgaggcagcttcagaagcatggaaaaatatttacatttatggataaaaatatatttcagtctaattgcccaatgacaaggaatgattgaataagtagttggacaaccatctgatggggagttatgtattcattataaatggtgttttctaaaagttttagtgacatggggaagtattcccaatatagtggtaagagagaaaagcatgctgtaatgaatgcagtggaagaaatttgtgtgtgtgtgtgtgtgtgtgtgtgtgtgcacgcgtgcatgcacacatctggtaggcacccaggaagagattgataaaatttattgatagtgcttatgtggcagtagtataggtgatttgtattttcttttttctttcttttttttttctttgagatggagtctcaccctgttgccaaggctggagtgcagtggtgcgatctcggcttactgcaacctccacctctcaggttcaagtgattctcctgcctcagcgtcccgagtagctgggattacagacacccaccaccacgcctggctaatttttgtctttttagtggagacggggttacaccatgttggccaggctggtcttgaactcctgacctcaagtgatccgcctgccttggcctcccaaagtgctgggattacaggcatccaccaccacacccagctaatttttttgttcagtagagatggggtttcaccagattggccaggctactcgaactcctgacctcaggtgatgcaccctcctcggcctctcaaagttctaggattacagtgaactgccgtgcccagcttgccaaattctttactacacataaggtgactgaaaacagatagataaaaaatttatatagcctagtgatcttagtatggagggatctcttatttgccatgctctaagactataaaagaaagaaggacatgaatttcacaggtacaagcagtactgcaaatacccacccctgatccaccaaacctccaggaccaccactgagaacaggcctacttacagaggatcctgcaagtagacatatgtcaccatcattgtttaccacagagaagaattaggctgggaaaacacttaccaccctgctgggtatttaaatctgacccttgtcccagtgttaacagcacagcacgtatgtccctccttaactcactgatctcatgtgaacgagtgatcagcctgttttttacaggtttctctccctggcaccatctcactgtggtgcagctgagctcactacatatagcatggagtgatgataaaaataaattggctctttccctttgcagagtttcagttcttgagcgctatgtcagggtggatccataaggtttcctgagtgagcttagaaacctgaaaacccacgtttgttttttcatgaacttaaaacaatttattagagcacaatgtagaagtcatcgcagcaagctccctggaagagaactgtatgcttttatggaaaaagaaccagtaacagagccttgagagagactcttagctaaagtctaatcctccttccattcttccttcacagggtagagtttcagcttttgtctgttgttttttttgtgaacaaaaaacttgcaataaatggatgttgtcagtaaatttcggttgtacgttttgttttttccaagaaaaaactggccatgcagaagtcgtccgagtggtgtaccagccagaacacatgagttttgaggaactgctcaaggtcttctgggagaatcacgacccgacccaaggtagagtgatgagtgagccagtatttaattatcttactaattacagctgggataattagtgtttgagctgcatggaagagatgaaccttgaaatcacacaggagctcaagaatatgattgcagacatttattgacggaggagaggaggggctggggagaaaaagggtgagagaataaaggcacagccacattcggcgcccctgccccccttacagctgtcaggggtgggaaaattcccacagaggaagacgccagacaatagcgatccgttcacctttgattattgcattattcctccttaatgcagtcttttgtctacaaaattaaagtgtctttccagcagctccaaagattcctgatttatggtttctttatttctctgagtttagcctttctcgtcttttgacgttatcaggttggatttttttaaaaaaatgtatgtggtgataaagaagaacataaaggtaaaatgcagtattcactaggtccacaaagcttgctcatttaaatatttcatttgttctctttggaatttgttatgtggagatattaatatatttgggctataaacaatggtggttggaaattttatttgaatgcatacacaagtgaaatattccatgttggcaaatatcattgtaatattcaataatgaagcaatttcaagattgcatcccagcagccttgcaggccctgctttgccagtgtgatgatctgatattatgcagcttatgaactgaaaagtcctatgcaatagatgtggtttttcacaaaccctcttcatttggcagtcagtctatttcaccaaagtattttctctttggtgtcagatttttgtgtagtggatatgcagtgttatttcttgatgagtgaagtttttctccaaatgtaaattgtgcttcatggtggaatcttcatatgcctgtagcagcacaggttggtgggtcctgagtgctggttctaagaaccatcccattctagggctttttgccagagggcaaaggtcagagatgaggcaagagcagcaaagtgacaaactcgagcagggtgaggcaggttcaggatccacgcagatctatcagggcagatgggggcctagaggtctgggcctaggaaggaggccgggggcacgatttccatgaccacaaagtctggtttgacatgggggaatgggtacctggtggaagagggatgaggtatggggcagggtagggaaagaaccggtaggacaagaacactctaatcagaaggttcacgtgtcaccctagcttgggatatgggacatcacttcatgtgggaaggcaggtctgtgggcctagattgctttggttctgcaggaagctctgcagtgaggatcataaatcagggtggtgacagccagtcgctccttctggtaagtcatcaatccagatggagcagacgttcagccatttgactgtcaaagtcaagggtcagaggaagatgataagagctccaaaattatcagtgaagacatgtatcagaggcccaggcaaggcctgaaggcatgtaggtgacaggtcgggtctgtgtcctttaatgtggccaactgcaatgccacgtcctgatagaatctccttaggcttaggcctggcagaattgtaaagaaggccaagtctgtcgtcaacttctctctccataccgctcttaaatgctttcatttgatcacatcttcattgattaattgggttgctaataccggcccctgaacctcggggggaatactactatgatgagggtttgggctgggagaactcacctctctgttcatcatttggccttctatgggctctgtgtttgtaatggtggcgtctctggggttaaaaaagattttccagatcttcacatcataggtggtaatatggagaccaaaacaaggcaagggcatggctaaggttgtagcgtgatccagtctccccagctgaattcagagaaccactcatcaacaccagggcaaccctgactgccccaggacccctccaatctgtggtccccacccttctgcctctcttatggaccatctctttccataggtcagtggcctccccacaggtgaggaagaggtaaggaagggcaggggatgatggttagttaagggtagggcgagagatcctccgtcaggaacctctactcagctggctttgtttttcttaagctagttttttagtttctattacatgtaacagtaacaaaaatccttactaatccacccattcaatccaaacaatcttatgcccattatatttgccaggtgcccttttattttttgtttttgttttttattttattatttttttgagactgagtcttaatcctttgctcaagctggagtgcagtggcgtgatcgcgtctcactgaaccctccacctcccaggtgcaagcagttcccctgcctcagcctcctgagtagctgggattacaggtgcatgccaccatacctggctaatttttcatgtttataatagagttggggtttcaccatgttggccaggctggtcttgaacttatgacctcaagtgatccaccctccttggcctcccaaagtgctgggattgcaggcgtgagccactgcgcctagccaccaggtgtactaaatcactaaggcatctgggatacgcacgagtatccggcctcttggttaatgcacatggaaaatatattcctacaggaagaaaataattaattccaatatgctgagatcaagtgagcatacagataaatgcgcataagaccacaggctaaatgttaacatgaaatcattaaaacaagtatgtgttagcacttgaacattaaaggcaaaaaacaaacaataaccaacccttaagttcagaataactctggtatcaatggagttgatattcctggggaaccctgaaggtccaaaaacagtgacacatgtcaagtgtcatttttccaaggtcagaatttgaagcctgctcctcgaaggatggaccagaggcaggggagagccaggctacaaatgaacttggctatcactcactcaccacatctgaccacagctgcctaaatctctacttgaggtcacatggcaacctgtcacgtttcacagtaaaagttggtcttgaaaagaaagccgccactagagaagatgagggtggtgaagatatgtaagactgactgttcttactcagaaaatggacattttgaaagagagcagcaggttggatttggtggtgattctgatctgtgaggccgtagtccactccaggttcttttcagaaacaaaagtgattactaaaactactcgagcaatgctcttgcctgtgccagaattgcttatcaacaaaaagacaaaacttgtgtagaagttgaaaagtcattgacatttgatgtgaagatgcgcccaggaaacatgatttccacagaaatgtgactcaagagaaatgtattttaattagcatgttgaaagattttagtacctttttgtaaagtcattaaggacttgaaggggccttaaatttttttggttataattcactgcattttataggagaagcagtatctacagtgatatttgcaaatgtggagattcttgctgatgtcaatggtcttactgtagtagaaacagcaagaatgtaagcttagagtcccctttcagttaaatcagatcttcatggcataggctaaacagagaacattcagcatgttctttcctgcttcaaggtgctgaagcagctctcatagtatctgccctaatggacatctagatgaagtccccatgtgttttcttcctttttttttttttttttttttccggatggagtcttgctctgttgcctaggctggagtaccgtggtgcgatcttggctcactgcatcctctgcttcacaggttcaagtgattctcctgcctcagcctcctgagtagcttggattacaggcatccgccaccacacccagctaatttttgtatttttcatagagatggggtttcaccatgttggtcagcctggtctcaaactcctgacctcatgattcgcccacctcggcctccccaagtgctgggattacaggccacaaggcatgaaccactgtgcctagccttctgccattttggagggagcaaagctggtaagtgagagattggaaggtgtaggctttttaaggtataggtgaggcccgagacctgttattccacagccactagacagtgagtctgaagaggatgccactccacggattagcctaaggaggaatgacagacatgctagcatcattactcatgtggtcagtaagtggaatagtcttttcttttaatttaccaattaccacagaacctctacttttgctgaaacatttgaatcccactgtttaagccaataggttctattctggccttctttcttactcatgggatgaagatagttcctttaggcttctgaggatagactggcaggtgtacattcctggccatggggtacccagactcccactgtctccaggcaacgtggtgggtgcctgagatttaggagttttgagttctggtccctggttggccccttcccaaccacatgattttggccaggacacttacccaacctgaacctccatttttctcatctacagaaaaagggataataatgtctatactgccgacttaatggtctgatgtaggaattaaataaaatagtgtgaaaataacatgaaaatggtataggtgccatgccagtgccaggtattgttgttacgtctttttcaacacaacaatacaattccatcagattttaattttacatttattcttacatctgtgttgcccttgattctttgtctgggtaagtatttaccctccatctactaaagtgtgggttttctacccaccgagattcttgtgtctcttgcattggttggaaagagttcagcattgtttatgttgtcttctgggaccttgctggtgctgacagtggtgatgaggctggtggatccttgctcaaaagcctccttaaggcttcttctcacagagtaatctaaagaactggatcaggttcccagcatttcatggctggtctgtatcctcctaactagaatgacctgtgcatgaataacacaattcagacctcctagtcctgcgtaggactcggggcacagactgagtgcctcgagccaagccacaggtacaccaggcagagggtcttcagttttgtgtgacttcacccactaaatctgatttctcagttgcaacccatcttgctgtcctcagtcctggagcaagggagagcaatatttactaagcacctcttaggggccagtcttagcgatagatgtttcataatcctaattgcatttaaatctgaccataaccctgtgaagtaaggatcattgtctttgcttagcagaagaggagcaatgaggttccaaaagactcataatcttgcttaatgttagtggcggtatttggatgcagctctgtctaaagctcaggtctattttcttttccatacactagaggaatccaagcttcctgactaggaagacctcttctaaggatgcacattttttttttttttttgagacatggtcttgctctgtcacctaggctggagtgcagtggcacaattggcttactgcaacttctgcctcccaagctcaagacatcctcccacctcagcctcctgagtagctaggatgacaggtgcacgccaccatgcccaacttattttttgtatttttggtagagatggatttcgccatgttgctcaggctggtctggaactcctgggctcaagcaatccacctgcctcagccttccaaagttctgggatgacagaggtggccactgcgcccagctggggtgcacatttttatggatcctccagtgataacaattgggcttttagtacatttaaaaaagcaaatatattaaaatgctaccatggatttaattatactttaaattgcatgcctatcatattcaccacttccacatcatgtacttctggaaaagggaactattgtacacataatgcattctccaggctctagatcttgcctgctgcacagttggatgcgtggagcttttgtggcaactccaagccttcccagaggactgtggtctggaaactgctccggtatactccttggggagcagtggcctttgcagaggcctctggctgagagtgctggttgaccccaatattagggttcccccacctgtgtagtttaagaattttagctggtgtgcagccacccataaagacaaaatccctgagacaccttagagctaagtatggccacatgtctaaattctgactatgggggccttagtagaagtgacagcgtgcagcttctgggtttgtggccttagaggaaggggcattctcttccacttcctcccttcccacaagttagtgtggggctgaagtggtggaccatcacgaagcccagggatggagcctgacccttgtgctgctagagctgtgagactaaggagccagagtcaccatcccaggctggatctttaggcaagaactcttgtttaaagtactgctattgtggttcattgaagccttcttattctcattttctacagcagctgaacctatgtcttgactaacacagccttcaactataagctggtgatgaactcccagttacccttctgaaagccttaattgcagtgttcccttaattaaaacgtctttaatcaaacctgttgttaagagtgtggaccctggggtcagagatgtcatggctgtgaaccagatcggcccggcactcgctgtgcggacaggcctcatttctctctatccacttgaccacgtaggtcctccagtagtctactaactggcctgtctcaccctttctcattccctgctccataatgccctgttaaaaacacaaaaccagctgtggccccctctggcttaaagcactttgccggttgcccgatttctttgggatgagatccggactctttacagtggccagtgtggcctgggattacctgattggcacttgcctttccaactttggctcataccacagttctccccagactatgccccatccatgctcactgtgcttcagttactgtcgccttcatctgttccattcctggaagacttgagctctttcttgcctcgcacactgttcctactgcttagcctgtccatagctcttggtctgccaccaacatcaggcaagactgcaagtctttggaacctcattgcttctcttctgctaagcaaagtcagtgatgcctacttcatagggttatagtcaggattaaatggaattaggattataaaacatctgccactaagactggcccctaaggggtgcttagtaaatgttgctcttccttgctccaggatcgaggagagcaagaactatgtgactggctccttctcctttaagtctcagctgaagatatcgtcctcagaaaggtcttccctgcccaccctaattaaagtagcagtcccagccctcacccccatgaacttctgtactatcattctctccttgcttcctaactcatcatgaggtaaaatcacatgtttaattgtttattgcttattctctgactcctctagaaggtgggctttgtattaaatgttttctcattgaactagtgagtgaacctctgtttctgcatctgtaatagtttgtgccttctcagtgtcggggcgcacacgggcgcggagcctgccgtgcagagcgtggcgcctggtgcggaataagcgctggctctaatagctgtcgtgctcatgccgcctgtggaagggccgtttccatcaccagctgctgtttgtttgtcttgttctttcgtgaatcccagtatttgtctgcttgttctctatcatttttcctcagctcatgttctgattacccctgatggcttcctattcttggttcacaccctttatcctcaatcagctcctcttcacccctttccacctgcagcacagctcccagttgtcctcagaaggcttggtctggtttgccccccgtgggctgcaccgtctatgctgttgggtttcctggggccccagggccacacatcctggccttaccgtgagctggggattctgtggggctcctcagcctgtgcttggaactagagagcctgcaaggactcttctctacttggtgtccttgggctgcatgggcttccctgccagacgtgtgcagtcaccacaaagccctgctccaggcgagttttttccaggtggtcccagggaatcgggtgggataggtccactccgtgttcaggaggttggctcccgagcctctttccaggtgcactgtggagaagcaggtcccctgtgctgtctactgggaaacattcattgaagggagacaaatcctattttccttctgttccccatcaacttggcaataaaatactgtcgttcgtatatttgaacttgccagattaatatctgaacttccttgtgctgaccccttgaagttagttttttaaaataagtcaccagttttgaaggactatccttttttagaccatatacaaggaatctatcatctgcaaataattagacagtgggaatgatattgtattgctaatgagcagatgtgcagactcggattggaagaacagctgcacacatataaaatgcaaaagctacccaaacccagcattatgaattctgaaagggatttcattcttttaagaatttcagaaacagagaaaaatgaaacaaaagaatttaactgatatttttattaattgttctttcagtcacactttcccttctatcacattatcatacgtgttcatagtatctttgctgtttgcaaaagtgttatttgcacttttaaatccttctgtcatataatactataaagcttctatttaacatttttcctttgcctttctagtgttacaagggtttggtgtctgcactctgagtgacagactcttactgaaggtctttcctgagctgtgcacaatgctaagtgctcatgtgtacgtgatcccatttgctccttaaagcaacctatgaaccttagacccattttgtagaggaacagaaaggcccagtgaggtgaagtgatttggcacaagccacttactacattgcttgacggaggtggaattcggacttcagggctaaaatcgaagcctgatgttctttctgttgggtagcacatggccccacagtgctacacaattctatcagaaagcagaaaacatgacccactggaaacagcagcacattatccgatgattttaaactctttgtgatgtccattacaattttataatcctattaaggatttgcaagatgaagaagtccaaataatcaggcttttgaaaacttttagccaggaagagtttcacatatcttagatagtaatggttaggtcatttagaatttgaataaattgctgaaatggtatgaaatcactaaaaagaaatgaagtcagaagaattactagacttcacataaaagagtactgaattaggtcacagaaaaatcagagctggtaacactggcaggaactaggatttctaggttccaggaatggcaggctgagttattcagaccaaattgcccactgaaagcagctccaaatgttgaataaaatacaactatatatataaagcatcacatcaaagggctgacagaactatgaggaattaaccaggttaaaatggaaggcaacacaggaacccagacaggtaagcagaggattagatatatctttattctgagcaaacttgttaatcccagaaaatgcgagctttgagagccttattaaggacgtagagggagtgaccaacacaattccagcacttgacccagtggacataagatgctgtaccccacacctgggggggcgccttcttctcaatcacacaaggaacatattccaggccataaaaggctcagtatgtttcaaagggattaaaatcatgtagctttttttttctcttaccataatgcaagtattcagaaaatcgtcttatgttagaaaatttaaaaatttctggccaggcattatggctcacgtctgtaataccagcgttttgggaggccaaggagggaggatcacttgaatccaggagttcaggaccagtctgggtgacatagtgaggtctccatctctacaagaaatttcaaaaaaactagctgggcatggtggcacatccctgtagtcccagctactcaggagtttgaggtgggaggggtgcttgtgcccaggaggttgaggctgcagtgagccatgattgtgccactgcacaccagcctgggcaacagagcaagagcttgcctgaaaaaaacaaatctgaatatcctagttatcaaagataaatcatgatggaaattgtaaaatactttgaatcaaatgataattaaaatactgtatgttaaaatcgatagggcataggtaaagcagttctcagagggacatatagagccttaaattcatatattagaagagaaaagaagctgagctaagcgtccatctcaagaacttagaaaatcagcaacaaattcaacccaaacagtataaaataaataatgaagggcagaaagaaatgaaatgggaagcaaacaaacagaagatcaaaaaagccaagagtcgatatttcacaatggctacaaaattgataaagctctgggaagttgttcaaggaaaaagtgagaagacacaaatatacaacattaggaataaaaagtgggatatcactacagatgtgggagattttacagaaaccaggaagatatgataagcaactttgtgtcaataaatttgaaaagttagatacattctttaaaaatatagtttaataaaactgaataaagacaccactggcttcatcagtgagttctcccaacatttaaggaagaaataattgcagtttttcataatgttttcaagagattagagagagatgcagtccatcttatgatccttgcatagtcttgataccaaaacttaactatgtaagaaaagaaaattgtaggacaatcttacttatgactatatttgcagaaatcctacgcaaactattagcaaactgaatttaatagtatataagaaaataatacatcatgaccaattttagtttcctccaacgaacacaagcttagtttagcactttagtattagcccatgtaattaaccaccttagcaggtattttaaaaacatgtatgattattgaaatagatgcttaaaaagtattgaatacaattcagtattcataaatgatttaaaaacacatataaaagatgactttcttattctgataaggagtacatgcaaaagcctatagcaagcattgtatttaataatgatgcattgagaaactacagagaatgccattgcaatttctaatcagcattggagtgggggtcctagctcatgcagtaagtcaaggaaagaatacgtgtatgctgattgaaaaatccactagatacctatttatctttccccagccggacaccattcctcttctcccttgaagtggtcatgtgactgagttctggccagtggaatgaggaagaagtgacatatgctgcttccagacctggctcagaaaaacctgctgcatgatctgtgaacttctctctctgtattcagtctgcctgctgaatgctaatgccgagggaaacctttgaagcaacatattgaaggtggtgaagcttctgtcagcctaggcccctgaagagttcatgaagtagaactgttaccatctcctttttattaactgctttgcatgattatgaaagaaacttctattatgtccacccactggaatttcagggtttacttatttaccaggaactggtaccttgaagtggagtgctaccaaaaaatctaaaaaaaaaaaaacaaaaaacaaacaaacaaaaaaaaacatggcattggcttagtagttaggcagctggaagatctaatattgggtcttgtttatggttggtaaacacaccaattctctccaaattgttttatgaattcagtgcaaatccaaatgagatcccaacagttttgttgttgttgtcgtcagtgttgttgtttttgtggatcttaaaagctaatctcgacatttatagggaaatgcaaaagtccaagaaaagcaaagatacttgcataagaacaagaggatgagaggacttattcttccagatatcgagtcattataaagctacagctgttaagacatggtgtatctgatgtagggacaaatgaatagagagttcagaaacagacccactcatgtcaaagtatgacaaatgacacagttggcatttcatagtactggggaaataatggcttcttaatcaatagtgataagataattttcttataggaagaaagttaattggatttctgcctcacaccatacacaaaaatcaattccaagtagattgaatacataaatgtcaaaggcaaacgtacgaaatttcaagtagataattttcatgaccttgggtttcggaagcatttcctaaacaagacacaaaagcactaaccgtaaaggaaaaatatttgacaaatttaactatatcaaaatctgacaactttggttcatcaaaaagcatcataaagaaaatgccaagaacagaaaaaaagaaaaataaaaaataacaaattgccaagaacagagagattatatttgataaaggattagtattcagaatatataaaaaatagacttaaatgtatgtgcagtatttttttttagaaaagacagactgctgagagaaaaaatgggcaaaggacttgaattgtggcaaagaaacataaaatgataattaacgttattaatcaggaaaatgcaaattaagatcaagtgagattccattacacaccaagcagactgacaaaaagtgaaaatctgacattagcagactttaatgaattggcaagcatttagagctccaggaattcttgtgcagtcatgtggttttgtaaattggtacgactactctggaaaaatagttcagcatgtagttaagttgaagacatgcaaacactctacagcaacaattctatttctaggtatgtactcaagagaaactcatgcatatgtataagagaatacatgtcaagaatgttctttacagccccaggctggtaatgttcattaagggtagaatgtataaatccattgtggtgcattcatacaatgggatattatgaagccatgaaaatgaagaaaatggaaggacctcatgatcataattgtaagtgaaagattcaaactgtagtataattgcatttatattaattttaaaaataggctgtattagtctattcccatgctgctaataaagacataccggagactgggtaatatataaagaaaaagaggtgtaatggaccccaagttccacatggctggggagccttcacaattatgaccaaaggcgaaggaggagcaaaggcacatcttattacatggcagcaggcaagagagtgtgtgtaggggaactgacctttataaaaccatcagatctcatgagacttattcactgtcatgagaacagcatgggaaagacctgccccccgtgattcagttacctcccaccaggtttttcccatgacacgtggggattattggagctacagctcaagatgagatttgggaggggacacagtcaaaccatatcacaggccaaactaaactaggtttattctgaatgtgtccgtgtgctaaagaaattattgcaaaaaccaggtgtggtacaaccagagagagggaaggcattgtcatcaatagagacacatggaagactctcaagggtacttggctgtactctctttcttgacattagtggtggtgatgtgagtattcactttataatcactaattataaatagagtaatagtagacacttaactgtgcgtatctattttatgtacctttgtacatttatgtcttatgtacttttctgtaattaaatctggaaactacaaaggtataatatgtcgattgctacttctgctaatatgaacactatccatgatggactagctttgtaaatgtgtgtgcacatgtgtgcttggtactgatttcaatgtaagcatgttgtaaatctcatatagtggggcactttggctgtaaaactttaagatttggacttgcaatgatgacctaaaaattttactattttgaacgttttctaatattttcattatttggccaaacttgggattttagaacataaacagacatggagtcccaaaagacattctaggacgcataataagtaaaaagattttctttggccaccataaatagaatttcccttttacacaaacaaaattcacactatgataacttttgacctttcatgaagaaatcaccacatcttgtcaaaataatttatgactatagaagtaatgtgtactccttactgaaaatcaggatctttcatttttctttttgcttttagatatggaataaatatgtggcacctctgttaaaaagcaacactatttcatctcccttgagatgcactgcgtgaaaaaatgcaaagaacattgtgcaggtgatagatagtgaccgtattgtgtggctgtcttccttttagaagagagccacataatatctttcatacatccctatattccaccttttttttttttacttaaattatatatatttacaaatcggaataatagtggttaagatcatggactttggagttagatggttccagatgcagcactggccttcaacaggcaaccagcctctctctgagtgtcagtttccctttgagggaatgtcagtttcaccgtggcactgggagagggcatggatatgggtttactaatatcctccaagtatttgcagaattgggtgaataacgtagtaaagcacagtgcctggacatagtgagaactataggattgttagctactttgatgatccctctctctctctctctctctctctctctctctctctctctctccttcctcctcctcttctccccctccctctctcccttcctccctttagatgaaaggagggctgtccattcatttattcagtgttttaaattaaaaatgagctgtcagttaaaatggacaggattaagttctcagataaagtgagatggttatattcatagggcttgtctcaaacacctaaggtaaaggcaaggtgcaccaggaggtgtcacctggataataagaagtgccatctttcactgtgaaggatagaggctcatccacctaggggaggacttcgggacaccatggcatgttttttcacagagaccctactttccagcagaaggtaggaggccaccccgaagcagcacctgggtgagctctcccagcaatgccagcatccctggtggtcttcctgtgccactgcagcatgcaggtagcctttggtgcagcagactgtaaggcaggatccgttttctcttagcagcagtctatagaagagaagaatgtggaggtcatgctagtaggagtcactctgttttcaaccaacatggacagtcctgctaatgagattgctcccgcaaagctccctaagatagagatagcgatttcagaccctgaggcgttgttcctgacttgtcctgatgttcactgtcagccggtaactcctgggacctcgtaaagtgatcacctagcaacaactcttagcataaacttccctttaaagttctcatgttcagacacatttatcacgtctgcaatcaggatggataaaacagagttggtacccaaagatgagctgaggcttaggaggccctctgagcagaggagaagtcatcatcttatgcttcattatagatgaagcgtttctgttttcctctgcttcctctggctctgccgagagggagagaaacctcagagcagtcttagggttgtttgtccctttaaaatcttctttggagaaagtggatggagaaatctcaagcagttggtagatgtcaggaggtcagttctcatcaagaatgccccaaagcccagtcctcattaatcagtttatagagtactatggaagcattttaagcacaaggtgttgtttctgagccagtaattctctttccactcaacactgaaagtccactgcttgctttcctggtacatcaagacagccaaatagtgtcaataatttttcctcatagtttttcaaaagccaagtggagggcacagtgaactttgcaacacttgttgcatctgtgggaaagggggctctgggtcattgcttggtgattatgctcactcagggttccagaaaatactgtagctcatgggagtctgatctttccacgcatctctggtccccaccgtgacttgtcaagatacctatgtggttacacgcccaacccaccagcttcaggacccaccaggccccttgtcagaccttgtcctgcctcttcacagtcctcagaacgttccaagcttgttcttatttctgggccttgggctgggatgccccctccccagcaggtaccctacatccagaagcactttgttccattgtcctcgattattttgctgtaacttctcatgcatccattttggaaggagaaagggctttggtgtcggggccatcaaagtttaaatcgcaggatggccatttacctgctatgtgacctcaggtgggtcactgaatgtctctgatccataatttcctttttgtcaaagagggttaagaatatcttctccacagggctcatgtgaggatgaaacaagaaatgatggcaaagacctcgcacagggaagtacagtgtcaggctcgtgactactcttacccctccctccctcgtcctggttattccttgagacaagggattatgacctaattcttctgtagcctctagagtgtggaggctacagttgacacacacgaattctttctgctggagagaacatatttatttgcagaaagaggaaagacatataggagttattctatcatcaataacatttttctgtcctatctcaaaatataattttggttaattttgccctctggagaacagcattataaagcctgtttagatcaatttatgacagtcaaatatttcgtttgttttgtgattcaatgggtagacaagcagggccacttcttgtattcccagccgctcctggatgttggttctttcttctaggttttcagtctgttgagtttccagtcatctttcccagtgaagcatctttctcatctgggcttcacgcttgagggtaccatgctcatcctcttgagaagcgggcatcagggctttgacacagatgcttcctgggttacagctgcttttgcaagcagtagcagttccttccaagtccctgaaggcaccgcactgctccgcagtcctcacctttgttctaccttcacccttggcgcccacctgctgccaagacaagtcacttccttgatccagcctttgagacataggccccttccccactgatcacgtgaacttacccactccctttctgaaaccttgcattttttttaacctgcacagattttcccttaacacctctaattcttgcttatgcctgctggtctctgtttcccctgattatattaggaatgtgactagctgaaacatgctactgggtccaattcctgaatcccagtgcctggttcattttcaccacaacatggtggcctacaggggatctgtggcaaccctgcggctgtttcactctggggcactgtcacactcagatagaaactgactatcatccacccttcagctgctgagactggcagaaaatgctctttgctgactttaagttgcaggctagatgggtaggtgactttagtcataggtgcaggactcctgctatgtgccaagcaccgtgccaggaatttacacagacattgtctcatttcctcatccaccaagggagggatgatgaaaccttccatacaggtatctccttaggacccaaggaaataatatgtatcatagtgcattacatgtgacaattggagtagatcgttgtttaagtatttcatgtaaaagtatgtattcatagaacatctagtatgatccaagacctgtgataaatctacctgagttcaaagatacttgttgtaattaaaacaggcaaatcaaaacagatacatttcatgcttgtttaaagaaaatgctgtaaacagaaaattaaaacaagcacttagcaacacatcaggcacagggaccatatgaaaagtgtcaaaatgtctcagcattgtgcccagtttgagactggcactgtcgcctagtgaccgggtaaccctccctgttttctgctttcctaggtatgcgccaggggaacgaccatggcactcagtaccgctcggccatctacccgacctctgccaagcaaatggaggcagccctgagctccaaagagaactaccaaaaggtagggattgctgggctcctagcccctggcttaggccaccatgactagggccaggttctgattttagagggcagtctgctgcttttcaactggaattgtgttttatttgcacatctcttagaaatttctgtcagcctctaggagtggagccattgtgtctaatacgtgtgctaaatgaggttttaagagtaggcctgggccagggccagtggctcatgcctgtaatcccagtactttggggggccgaagcagaaggatacttgaggccaggagttcgagaccagcctgggcaacatgaagaaaccccatctctacaaaaaatacaaaaataagccaggcatggtggcctgcacctacagtcccagctacctgggagggtgaggtgggagtatcgtttgaacctgggaggtcaaggctgcagtgacctgtgattgcaccactgcacttcagcctgggtgacagagcaagaccctgtctcaatgtaaaaaaataaagagtaggcccttatgtgtttgcctttgaatcactcatctagatgaagacacagcctgttaaaataagtctttttccttctctctttatttctgtctctgtctgaaactctctctttttttcttccctctgtattagttttacagggctattgtaacaaacagtcacagcctggttagtttaaacagcagatatttattttctcacaattctggaggctggaagtccaagatcaaggtgtcggcagggctggttccttctgagtgctgtgagggaagggaaggatctgttccaggcctctctccttggcttctagatggctgtcttctccatgtttatattcacatcagcctagttttatgtgcgtgtgtttctttgtccaagcttcttgtttttaaacagtctctagtcatattggcttagtgctaaccctcatgacctcgtttaacttaattacctctgtaaagacccgttctccaaggaaggtcacattccgaggttttaggactccaacatatcatttggagggagacacgattcaacccgtaacactttctcataacagtaaattgaattatgataaaagtagttctcggaaatatatacatgatatcacaaaataattattttcagagttgtgtacccttttttaaaatcctccaatagagatttagttgttttaaaaacaagttgacttgctttagtttttagaactttgtgatagtacttgtattttatttatcattatattttctgatgtggatttgcatttgacagtagagctagaagctactataaagctaatctatgttagaattatgtaaaaagtcaggtatgcaacagcccccaggaatgagtgcagagacgaggaggctgtaactagagtgtccactggtgagcaagtagaaggacgggtgactcaaggtcagttcgactatgatgagcggagaggcctgagggaggcgctgacagagcccattccttccttggcccctcccacctccctcccagggtgatgtctgcttggctggtcatggtaggcagcctgtgggatggcccccagtgctctctgcccatatgtaattcatctccttgaatatgggctgcatttagcaactcacttctaatgaatgacagcagtgatgggagcactctgagactaggtcattaaaagattgtggctcgtattgtgaaaactctctgttaccgcgtgagagatggtaggggaagccagttgccacgtcatgaagcagccctgtgcagaggcttacatgacaaggacaaaagcctgccaagaactatgtgagtgagcttcgaatcccctcaaccccagtcaagccttcagatgagactgcagccctgcctgacagtttgattacagcgtcatgaaggacttcaagccagaggcacacagccaagctgtgccacagaagctgtgagataataaatgtatatactttgaagctgctaagttttagagtaatttaagtatacttgtatttccattctaaaaaccttttacctatatattctttctcttatccctttttcgtaatggcttttgtaacagtggtgggctaacctgggcatttatggtggtggttacacatgcagtctctagcatgaaattttctcaattcacatgtcatctgtgcagtttattatcaagtacctgccacttagaaagccataagttctatttgactcaagcagacctatgaggatgagggagaccccattatccccattttccagatgctcaaagacagagagcaatgaccttagaataaatgaaattaaagagaagtaagactggatgcagggagatgagttgggcagctattataggattccgggccagaagtaatggaagctttgtctaggatggtggaagtatgggtgggagggagggatatttaggaagtacaaagaccagaacttggaacttcactggaagtggagagtcaataagagggacaggtccaggtccaggtcatggctggtgattttttgtacaagtgtacagagaagcagaggcagatttgtggggaaggtaagttaagttgtgaaagtgcagagtctaaggtgcccatgacatgggcatccaaggggctgtttggaggagccatgggctgtttctgccttgcagggaggattgttaggactgctaactgggctaatgcttgtgaaacacagggcctagcacatggtaaatacctcataaacaggaacccttattattattgggagttgtcaacttatatttgctaaatgaaaccccagttgctgataagattacttgggaaaagtaatgagataaaagcagaagaggcagggcacagtgactcacgcctctaatcccagcactttgggaggctgaagtgggcggatcatgaggtcaggagttcgagaccagcctgactaacatggtgaaactcggtctctactaaaaatacaaaaattagccaggcgtggttacacgcacctgtaatccgagctactgaggaggctgaggcaggagaaatgcttgaacccaggaagcaaaggttgcactgagctgagattgcattactaaactccagcctgggcaacagagtgagactccatctcaaaaaaaaaaaaaaaaaaaaatgcagaagagagggcttagtacccgaggaactgattcctccacttgagcggtgggaggggaactgtccaaccaggcaggacactacactgggcaccacaggaaccaaccccaaccaagaacttaaaaagtggttcaattgtttcatcccactgtatttaattataaaggcagtatttataactactactaaaagtcacatatgataatgccatctataaactcccttatgtaatgattcgtagttctctagggtaccaagagtaataccaagcgactctggaagcatattaactgccctccagaatactgaaatatgatgatatcctggtgtttgcaatgaagattttcagttcaaggccagtgccttccgtgtgatggtgaagaggcttatcaccgaattttccagtttctatgccattgtagtttctaccctcagttttgaggggaacccacgttgattttagataaatgatatccataggaggtaaaatttaggtattatataattaattaatgagctgctataattatcctttcattatttttgtagtttttgtagaggttaatcttgtaggcagttgtgctgaccagatgttttctgggtgttctgaacccaagcacatgggaattaaatacgtgtgtgtgtgtgtgtgtgtgtgtgtgtgtgtgtgtgtgtgtctgtgtctgtctgtctgcatgtctgcatgtctatgtgtctgtttggcttttaaaagtagggtctattttttaaataaagattgggactcctgtgcctttagtatcccgatagccattgctgctcacattactgcatataaactgcttaatcaccaactcaggggacaaatgctgtcatatctcttttatggttttgcataaataaaactgaccctagattccactgggagatgagttgaaagttcagtgttttcgtaccagctaattgactgaaacccagagtttcagactagaccagtgcttcctttcagcaccactcgcctttccgccatgatgctgtggtctcttttgcactgtccagtggagggcctctggccacatgtggctgttgagcacttgaaatagtggctcactggctcagttcctcagtggctagtgtgactgaggaactgaatcttttaattaatttacatttatatttaagtggccacatgtggctggtggctaccatttagagagcatagcagttcattaaggggtgagcttgtgcgtgtgtttgcatgcccatgtgcattgtagaggggtggagcatgtcagtctggatccctggccctctgctctcactatggcttatcccaagagcgggacggccatggaacatgggacggccatggaacgtgggttcctgcccatcagagtgctgcaccgggagctgctctcaccttttcctgcctggagaccacagcatgagggtcaagttttttccttttcaggaaccaaagtgtctctttgtgtaccccatcctggtgagcaatagagctaagtggacatccatgcctaggtgaccactgtgatttttatcttagcttagcttagcctgggtcccacagaaagcagagcccaagccagaggcttgtgtgtgaggattcactgagatgtgtggttccagggagcaggaataaggggcagagagactggggaggaaaagaaggaagaccccatacaagttagcccctgccactggtaactggttgtttgagatttatgaaatgactaggcattcgggagaagatgaggaagcatgtttccattgaatgccatcagtcataggttgattctgcacttctgagctgcacgtgtgtgagctcagggtactgtgtgccagggcaggaggcaagagacaagaggcacatggcgttgagtgtaagattgggcaatgcaggtgcataaaagctgcacaaagtgaatgggggcccttgcagaactgggtactgtggctggcctagcaagaggcagatggggccacagggatctaaagtgatgcattagtgtcctctgggtccactgtctccaaagggtccttctcactccgatccagggaaggcagctgactgcaatggctcaggaatgatttgccacgatggagtgactttctggcacctctgatagaggtgagaaagaaaaacacagttcaattttagcagagtgcatcctgctgcagtcatatggtgatataatatgtacttttatataggttatataccataattatgtataatacgtatatctatataatatatagctatataataataatagtaatactgttagaacagcaacaacagtaccaacagagtacttactaaatgctaatcaagcagttttaagtcatgtatagatcttaggtgtttatctgtatacatatatttgtttagctgtagatgtgtatctctctatgtctttatataaagttaaatgcattcatgtatttatgaggcccttttaagttttgaaacttgaatgaatttctgactgtttattcagttgatataactgataatacaaacattgcaaaatcagcaatttgcaatgcctgtgagaggtgatgttatcagctttgataccgtaaagaggttgatcagtgctttagcctttaccttaaaaagttatgtggtttctaatacattcacaaaatggggaaaattgccgatctaaccaactgctttattcactgagggaaggagagcagggagctgaagaggtgacccccggactgggctttcctgtgttttatatctagggtaagcttgaacaagctcctgaaaccacagaggtgtttaaggtagggagggtcatttcttaacactcctcgattatggtctagaactctgtactgtagtcagaaacatttagtttgatttctaaaagtggggaaattctgcccatgactcattctgttcattttacatacactgctttcctcttcagaaggcttggtgtttctggccccatcactacattcgggacatttgtcttctttgagcgctgctgggacccctatacactaactgtaatgttgacttaggttactaatttaatagtcttcttcactagcctgctcccagtgaccccctagtacccagcttcttcagcagcttctttatatgtgaagtttggagtgacagtattgcttaccacagagcagccatttgaacataaaattagctgattttatcacagggaccaattgttgagctaattagatgtgcagtactgctgaggagccagaaaccaaaagtgattttccattgaaactgtggttttctgcaaagttggctgggttgtggataccagcctcaccagcgactgtcagagttttggctgaagaagtttgctcatttctaatcagattaaaagaggcaggaaagacttaaggaggaggatggagtcttaaggagtgaaacttgaacttcacgctgggtttgctgaccttgaacatgctggattctgcttacagaatttgacagctgcttcatatctttggtgagcaaccctaaccctaatacaactttgcataaaatggaggggggtgtttttgccttcaaggagaagacttgataatcttttcttagcctcattaaaaaaaaaattttcctcaaatctttggtggaattatttgcttatagcactaattgcaagacatcatctaatgtattattgtttttggattgtcaaatatggacaatttatctcccaagtgagcccatcatgagaaacatttcccagtatcctaaactgaatgtggcctccggtagagtgagggtggttcacgtgtaattcttccatcctgagaatgtgactccagctcatttaggaattaaatcttttcccactgagaaattatgtttcttgaaatgtgaaagacagcaaatctaaagagcattctcctggccatatgacctggctccttctgccagctcttcaagtcttcaagaaagcacaatgctttctctgggtatttctctcgcgaaaaagagagaagaaaagcagcgttttcctttgtatatattttacaatatattaagttctaataaggataaaatgtttctggagtcattgttaaattacccactgtgtttcaaatataaaacagtgttttaaaggctgtatctatccgtctctcagtgtttgtccacccttccatccatccacccacctgtccctatcatcagtatatagctacaatctttaaatatttgccataattttatcttaaacttcaactatctagcaatttattatctctcatctctgcgtttgtttataattaatacagggtcattttaaagaaaagttcccaaagtgaaaggtaaaaaaacagtatgcatgtacaaatgggttccagctagcattttcaaaaataaaggttcagttttgattatttaattttcttcctgcttagattgcagccagatatttagtgactccctaagctcttcagttaagccctgacaaattgtggtttgactggtgtgtgtgttttgttgcggggaggcggggaggaagaagacagtgtcactaccaaataacctacttggctgggcacggtggctcacgcctgtaatcccagcactttgggaagccaaggcaggtggatcataaggtcaggacatcgagactatcctggctaacaaggtgaaaccccgtctctactaaaaatacaaaaagttagtcaggcgtggtggtgggcgcctgtagtcccagctactcatgaggctgaggcaggagaatggcgtgaacctgggaggcggagcttgcagtgagctgagattgcgccactgcactccagcctgggctccgtctcaacaactagaacaacaacaacaacaacaaaaaaacctactcacctgcgctaccaatgcagtcattgctgcttttctttagcatagtttgaataccatctctatggtaattttttttttttttttttttttttttagtatcagtgacactctgagtgtaaatgacactcaaatttagggtctagaactaccctctggactccagatccccataacaaactgtctacttgttatcgccacttgtgtgtcaacgtaatgctttctaaaatgaaagtttgattattgccaccccctgtaaacaagtcccatggcttcctcctccctcctccctcccccctccccactcattgacacccttccccatcgggtcatcatttaacttgcctaactaagcaagatcctcagaagtcatccctgcctcatgcctttccctcgccttttccctccaatgaatcagattaacagattctacctccaaaagacatccccactgtgctcgcttctttcattttctctcacgttcactctcatgatttaagccaccattatctgttcctggacaactgaacttcttacctctccatgattatgaccacccgcacaggcagcagagtgatattcctcagtgtacctcgggtcatttcccttccctgtgtcagcatcttccacggcatctctactgtatgtggaatgaaatctgaactcctttgcatggtctaccaggtccttcaaagtcatgtcaccatcttcccatgagacatctgtaacttctaatcagagagcctaattatcacagtatatctaagatgtagcctataattcttaaagttcagaacctttgaataaggctcaagaactttccagagaactggggactcactatgagaaccacagggactcaggaaatcttactgttgtgcagtgaacctcataaaggatggttttatacttctttgtatttcaaagttgatcccttcatggactcactgttgccacagagagaccaaattcagaggctgtggacatgctgcctggttgaggctatgctgtatattaaaaggaaggattaaccatcttgttcttgaccctaaaccctatcctgcaaactctcttgacaccgaagttgctattatgatcgtacaacattatttggtaggattaagtcagtgggtgatagatgaaactgccttcctctcactactttgccaaatctctgacttttttgtccctgtgttaatatcctatagctactataacaaattaccacaaactggatggcttaaaagcaacagggatttattctctcatggttccagagggcagaagcccaaagtcaatttccctggacccaaatcagggtactagctgggctctgctcccccaggggctccagggaagaatccctccccggatcttccagcgtctggtgggtgccaccatgcatggcctgtggctgcatcactcaagtctctgcctctgtggccacctgcctcatcctcttctgggcatctgatctcgtcctgcatctctctaataaggacactgacagttgcatttagggcccacccaaacaatcaagaatactcccgcatctcaaccccccttatttagttacatctgtgaaatctgtgccatataaaataacattcacaggttttaggggattggaacatggacattttggggagaccatttttcagatgaccacaggccccataatctggtctccaacctgccagtgtcatgtgtccaccccaaaatgggagactgaaactgggggctcttcctcgggctgcttaggagaggtgggcgttgttcactaggtgggagcgcatctggcttgccctgaaccccagaacacactcaggtttcccagcgagatgggatttgatttcctctctcgggggtctttatctagttttgaagagaggtgaaaatttgcaaaagtttatcccctttcatacatctctaccttcaaaacagacccaattttactgctatactacttctgaaataaagtggcataccaaaaataacagtagaaaaaaataaatcctaagagctagaaggatatttgggagagaaaaaaatgtgtgtgtgtgtgtgtgtgtgtgtgtgtgtgtgatcaaaaagcatttggatgtttggcaagagtggtctagcactctcttagtcacttactctctttgagccctgacttaatttgctctgataccaatttttaaatgatctaagtgtggataacaaaatttcccaataggttcattataagaattaaatgtgatacacacacacacacacacacacacacacaagctggcatgcagtagtgacccaatatacattattgaagctgagccccttcagttttatgatccagaaaatagttttaattataccaacccaaatgagagaaattaaatatactcaatgaatatttagccatgctataaccatgataatataactgaaccagataattccccagcaagaggtatatacagatcctttgtgttttcttttcaacatctataggctgaaaatggctttttctccttattctcccgtcccatgttcctcagtaaattaattaccttatcaaatattaattatgtacagattcattgccagacttgcattacagttgctttaaacaaagctatctgaggcaaagtcttgtgaagtttgtggtaataaactgtcccacatacagtcacagaagctcacatgtgacaaatgctcttttctgcagagaatctcctaggaactcgtctcccattttctacattaagtaagcttataggaggcttccattcacctgtgtgtccccagtgcctggtgctgtgcttggtacctagtgattgtcaacaaatatctgttgacctgaactgaagtgatacagcatataaagaagcccgttttgttgccccttgttatggaccgaatatctgtgtccccccaaattcatatgttgaagcctctacccccagtgtgatggtgtttggacatggggcctttgggaggtgatcagggttagatgaggtcctgagctggagctcccgtgatgggactgctgtccttatacgaagagacaccagggagcaggctcttgagcactctattgctgtgtttcttgctgcacacagaagtcatgtgaacacaaatagaactgcctgcaagccctgagaagaggacttggaataaacctaccttgccagaaccttgatcttggacttctcagcccccagaactgtaagaaatagaagcctgttattgaagccacgtagtctgttactttgttatggcagcccgagctgacaagagagccctgttttgtgtgctgcactccatggagcgggggcagagcactggcttggaggagaacaactggctggagccctggctctgcctgtagtgaccgtgaccttggagaggtctctatggcccattcttcttttgtaaaatggggaaattaagaacagtggaatgttgtacggcttttcggtgctttctcctgtattttgctgggtaaacttcacagtcacacacaggctagggcaggatctgttctctgacttgcctatgaggaaactgaagctcagaagtgttcattcacattcccaacatgacccccatagtaaatgtagagagctagagtcatttgacactgaattccataagcttttcacccatgctgtgtggcgatacatgctaatctgtcaggcattttacgaatacagtcatccttcggtatccaatggggattgcttccaggaccctctgaagataccaaaatctgatgatgcttaatcccttatataaaatgacatttacatataacctatgcacatcctcttgtgtactttaaataatctctagattacttatacctaatacaatgcacatactattaatatattaaaatagttatgctgtattcttaaaatttgtattgttgtattgtttttattcatttatttataataattttgatctgtggttggatgaatccaagcacgcagaatgcaaggatacggagggccgactgtatcagggtttaatgggtgactgcagaggtaaggctgtctacagtgacttcatcctgcctttctagagatcctcaaatttccaaccatagttacaatataggatcagcatatcttcctttctgtcatgaattgagaaaatgtcatggttatctgtttctttgttcccagggaaatgggtaagttgcatgctagaagcatcccttctcggtctgttgtattctctatgctgcaatgtttaaaacccatctgagtaccgaaagactgttgttttcaccaacactgaaacatcatttatttgcattggaaaaccctaaatagacatgggtaaatgtcagttgatatgttatggtttggggattacatagctcttcgtctttaaaaaattttttttatctgtgcttttgtttaaagcatgaagttatgatttaaaatgcccatggaaaaaccctgaataattcattgacttaccttagtcaaaaagaaaaatcccccctccccaccgtatgcctagcaatagggataaaattcttcttagtccctttctgtagctttgaggttaaaattatgggtgttattatgaactctaaataagaacctgtgaaataaatattttaaaagtgcccatttctgggaggcaggcacccatatttctgtgtatgcagccacgtagacagctagatcttaggcataatggtttagttgcatgtgggtgattattttcatttccacttattactgtgtgctagactccctgtgtatgagtacagattgccctttcttgcactgtatttagaaatctctgtattacccttgggcatttgttcattaatagggggtggggaaaggaaaagcttgtaataatgggctttacatattaaactgtgtgcatccgcatttgggccaaatggaaaatctggtttgtatgactgccctctgctggctgtaggcctttgctgcagtggcaggatatgagtccctgggtggagcccctgtgcagatgccggtatcagtcttttattcacttgcactgagttccatccaagtacatcagaaacagcctaagattctacctactgcccaggttgatggtggaagacagcattcttgtgaggatcaaggagacattttgattttagtagaagtacagtagaagtatagacacaaaataatcctggccaacatagggtgatgtttgaatgaatgaattcacatttctccacgggccacactcctactcatctttcagtggcaacaggggaatgtttagtggctcccatatgtgatgtccagaccccttgtggaatgcaagatgattttacggtgtatccagatgaatcttttaaatctcagttatgtgtttataatatatattaagaaaactgcagtgaatgtttgaagcccacaatttcctgaaggtgatggctgaggtgaagagcaggaaatggaacctacacacacagctgcattccttgcagagatgcctcttccgcaagtctttgggcggagaaaaaccacagggaggtccccgatgacttgggcagcagtggctctgtacttgctttgtgtatgaccttgggttgttgacctgtctaagcctaggttttcttatttgctaaacaggataatagtggctacttcttaggcagttataaggatgatatggtgtatatgtaaagtgtctgtcacagaacaggggcctgggcaatgccagatgcttctttttcagctccccatcccccaggacgcttctcagagccggcccccctccatgttcgcatcacgcttggcttgcatctcgtttcctctgacccttatgagagttgccacgtttcttctccaccccaccccccccacgctgagtgggaccttcccttgctttgcatctgtggcaacattccatgagcacttcacacaaggcaggcactctgtgaatgtcaggtgaattaaacccaagtgcaaaatacttgtaagcagcattttcccattctccaacacattcagagaatttcacctatcagattaggacagggcctatacgtttttctccccctacccgccattcgtgtggtctgataacagcagcagcattaagttcccgtccattggctgcaagcagggaggaaaaaaggccccagcgcctactgcctgctttcctgcctgcgttaatatcatctcttatcttaccaactaacatataggggtgtgtgtgtgtgtgtgtatttatgtgtgtgtgtgtgtgtgtgtgtgtctgggtatatatacacacacatttatattcgttaatttccgtggaaaagaaagggatggcagcagaaacattttaaacacagcatttcagctagggtagggtctactttaaagacaacaaaagggcctttgttgttctggcaggtagatggataagcctggccctggttcagcctctataaagtggctccggagtgataggatcagagaaactaccgggggcgggggggaggtgcagggacgcttttatttctgtggcgccaagagtgaagcagggtttgccgtttcctacaggggcagtgcgtttgcgtttcaaattcccgttgattgtgtcgcagcccgcgtggtcccgagctccccggcctgcgcctgcacggccgcgggacgcccgcttgcatttccgccaccgaggcaatgttcatttaacgcttccagagatcagagctttcatgtttgccacgaaagccagagagccgggagcacctcaggagcggagatgaaaggccatttgtgtttgtgcatgtgtatttagcgcttaaagggcaggaaaaagaaagaaaatagatggtcccgctttgcacttacttcaaaatgtgccttactccctctggtgggaccatttaactccagcgcgccacccctcccccgctctcgccgctcccgtctgccccgctgcctcggcccacgtgatggctgttcgggccccgccgagccatcttcccgttgctatggcagccggcgcggcgagcccgcccattggctgcaagcgaggaggaataaaaggctctcgtgtcctaggtctagtgccctgcgccatggccccgtgcaggtagaggcctgggcatggtgcgttgcaggacgggccgggcgcagggaccgccccccgcaccgtgcgccccacccagctgtccagaaacggtcagggtcaatgtcatcagcttctccatggaatgggaagcaggtgaaggacaaaagcaaggctcataagggaaagtgagccaccttttccttcacccttaacacctcccagctctgttttttttttttttttttttttttgtagtgtttgaatttgaaatccggccctgtgaccctttctactcacagacactgcacgtgaggcctgagcctaagtttagctgtcagattccatttaccttggccatgccccgtggctccaaagccgcgaggacagcactccattgcgacgtctactcccgagcctgaatgtttcgaaaattatcttcgtcttgctgggttcgctgctgaactggggaggcgattggaattaccatctggcctcagagctgcgggtgactcttgtcctgaccccgtggcctagtgaacagatgaccccggcgcctgatcttgtacctggtcaaacaggtgtggagaagtcttggaggggaactgcagctacctgcctcgggctctcttcggctggcgacttgggttccctgctgagtgagaaagagagccagccacacccagagccttcaatccccagagggagggcacccactgcgatttggctgtggttggtcacctgccttccccaacataggaccagtcagcagatttgggagtgcagaaagcactttcacaaacattctctcctctgcttctcataaggagcctgggaggctgtcactctaatcgctgccctccaggagaagcagctggtaacttgagaccacatgatacgtacatgggggagcccaggatgcacactcccgctccctgattccaagctctgtgcatgctctttccattctgtcactgggccaggtagattccctctggacatgtcacaccctcacagatttataaatagggaatgggctctaggaggaagatcgctcctccctttcttctcattccgtatcttgccaatatcacattaaaagaatatgtcactagtgtttaatttgtcaagatcaggggctaatggttgaggattttttgtggttccttctgctggcagaaacacatttgcaaacacaaaatcttttaataaaatagcaagatttagtaagaaagaaaaatactgtgagaaaaaaataggacctgattggaggaacattattatgccagagacacttggttgacttaaacactaatatattatttttatacatattcacacaaagggtgctgtgtggtttcaggaatccacagagcctaacacccaagcacatgtgatagaaaaaaaaaattttaatccttttttttttttcattttcatttctgtttggcttctttacaaagtcgtcattgaaaattgctgtatggttatttttccctcttgtgttacagaccaaactcagtgtctgatgtacagtggaataagtgaggaaagagacaatattgggcaaaccagtgaaattaggctcttgtttacatgagtagcccttactgagattcagctttttgttgctctgtgtagccttttgatgtagattccagagttgtaacttacatgataaattacaagtctgtatttattcatacattagagataggttatttttacctttgtgtgtgtgtatacacatttgcttggaatcggtgaatttctaggccacattgaggcaattgaacgctctttataagcagttaattgtctagacccaacgtttgctgcaaacacagtctggggcaaaatgggaattaacatttttacaaagacaggcatagaaattctaatccagcgaattgtttcctttctctggtagcagggctgagtcctacctggccacaaggctgccattcacctgtgtagcccagaaaacaatggtaaagaccaccagagataagaccagctaatccatgccttgtaatagtcaggtttcgcaattcacatcacctgtctgcaaaggtaaactcacaaacccctcctgagatatgtgtacagtcaaatgggatcactgctgtcgctaggccagcagctctagaagcctatgttacttttttttttttttctgagacggagtctcactctgtcacccaggctggagtgcagtggtgcgatctcggctcactgcaagctccacctcgtgggttcacgccattctcctgcctcagcctcccgagtagctgggactacaggcgcccgccaccacgcctggctaattttttttatttttagtagagacggcatttcactgtgttagccaggatgatctggatctcctgacctcgtgatccaccagcctcggcctcccaaagtgctgggattacaggcgtgagccaccacgcccggccaagcctatgtcgcttttaagatgaatccaaaaagactgtgtgctactaggctacagaaagcagcattaagtctgatatacatcaatccatgttcaagcagattcctctctgtctctggaagttggttaatttttctggtcctgatattggatattgtcacattttccttgatagtgtcatccggtgaatgatttttcatcttgaaccttatactcctcctctctcggcagctggtgcttccctgttcttcctcagccatgctggggctcactgcagcctcctctgctcaactcgcctgggtgcagccatcttcaagaaaacattattaaagcaatattattagtatgcagcaaggtgccttctttctgctaaatcagtttgtaaagtggtcctcacaaatgcacacattctttgttatgacagcagggcttcgtgtttctgatgcaagactaataagacttggaagtagggaggtaaactgggtggcccaggaaagcaggggttaggggagttgatagaagatatgagaaatgaacctaaggggtgatcaaagagcagccaaagaaaaaaatatccttaagtgggagaaaaaggcaaataggacgtgtgaggaattaggcaggagtaggaaagaaaactgtgaaccactgtatgcacacttgtgtgaaagaggaacctaggaaagtgagccccgagaaagcaatactagcagaaagcaaaaggtgctcaagaatcattgtgttgtttatgttgagtgaaataaggcaggcacagaaagaaaaataccgcatgatctcacttatatgtggaatctgaagaagttgaaatcctaaagcagggaatagaaaggccagaggccagggtggagtggggaagggaggaggagttgttggtcaaagggtgcagagtttcagatccacaggaggaatagggtttgagatctgttgcacagcagggtgactgtagtcaataatgtagtgtatatttcagaataactaagagcacatttaacacgtctcaccataaaaaaacaataggtaagtgaagggttggctttgctaactggcttcatttgattattctacattgtatgcatatattaaaacatcatgcactccataaagatatacagttaggatttgtcaatcaaaaataataataaaaaatttaaagaagaattgtatagaaagaaaaacctttcaggattgagaaaactctgtgaagaagtcacatagaaattctccaagaagtgccacctgtgtactgaaagcccctttaatggacttttgtggtgctttggtgattcatacaacttcagacaaataatttcctaacctgcaaaactgagctagcaacccttgccctgatcactctctttgggggtgtttttgaggctctagggagctgatgtgcgggcaaaggttataatccagaaaatgctctacaaatttaagtaaggttttggcagaattgggttgtggggagcaagtgccaggcaagtttccagtccttgccaaactgcattttctaagtgatgaaagatctggcattttattcttttccattttttaattcactgggtttgttcccttgttcttatgaaccttgactgcagagataagttgacagtggctgacagatgaaaattttcattgatctcctctctggtccctgcctttcctagccccttggctttggaatgaaaactgtaagtcagggacacccacgaagcgatgatgttggagttgcagtttgtaaaactcttacgttaccatctctttatctgagcatggagacaggccctttctgtaacttttctggctaaataacttttcttcagaaggcaactcatgtttgaaattagacttgaccttgtttcatgagtttccaaaacttatgattcaggtccacattggctgcttttgaattggatctatttagatgtcaacatgtacagcacaagtacaatgaattcagtgtctgtcctgttcttcgtggtcaggatttttgtgtttgttttattccctgttaagcaaggggttttctttctttctttttttttttttttttttttattcctctgagacggaatctcgttctgtcgcccaggctggagtgcagtgatgcgatcttggctcactgcaagctccgcctcccaggttcacgccattctcctgcctcagcctcccgactaggtggggctacaggtgcctgccaccacgcccggctaattttttgtatttttagtagagatggggtttcaccgtgttagccaggctggtctcaatctcctgacctcgtgatccccccgcctcggcctcccaaaatgctgggattacaggcgtgagccaccacgcccggcagcaaggggttttcaatacaggctgtctgatgactaacgagagggaacataaggaccctatggtctgcccttctaggctgttctcaggccctaccccacccaggcctctgctctccctcttcttaaaatcttcatggatccccaaggcagctgccctagctgccttgtgtgtgtctacaatgatagagctatcagcactgccatttcctggcccgtgtggtatgagaatatgagtagccaataatgctgtcacagcctgggaaagagacggcaaaggggaagaggcagccgcttgagaccacggagccacagccgcccattcccagcagagctcggagaccacagtgacacacctgcccattcccagcagagcttggtgccattctcaggtctcccaagctgaccccaggtgtccgtgcttttatgggttaataccaccagggtattgaagtagattttgacaatcaaaaaaaaaatgtatatccgaattccacgtatggtggcaagtctatgggccatcaaattaggagttattatctatctatctatctgagacaaagttttcctctgtcacccaggctggagtgcagtggcgtgatcttggctcactgcaaccttcgcctcccgggttcaagtgattctcgtccttcagcctccagaatagctgggattataggcatgtgccaccacgcccagctagtttttgtatttttggtagagacagggcctcgccatgttggccaggcttgttttgagttcctggcctcaagtgatccgcctgcctcagcctcccaaagtgctgggattccaggcatgagccactgtgtcccgccagattggaagttattatacccactttataaagtggcgaggatggcatgttttgattcaattcaaaaggtatttaccaagtacctccgtattcaagggaggggatgtggaagcaacctatatacaaacttaaaacctgcaaaggcatcagcaaagagcatctcacatcagcttctctgttcacttggtccctacttgtcttcacagaaagaacagttcttgtgtggtaatcaaaatggtatttctttgagaaaaaagatgcccctgataagaaagacaacaaatactttgatgtggaaacagcctccaacatgaagtaagatttccaactgatcagatccttaatttagatgtcaagtgagaggttgactatttgtagggctctgtggattccagactcccactcagacctactgaattagggtccttaggggtggggccaggaaatatgaaatgtttaaaactcctgtattaggcagttctcgcgttgccataaatacctgagactgagtaatttataaagaaaagagatttaattggctcatgattctgcaggctttacaggaagcctgctggcatctgctcggctcctagggaggcctcaggaagtttctgatcatggaggaaggtgaagggggaacaggcacatcacatggtgaaagcaggagcaagggagagagagttggggggaggtgccacacgttttgaaagaccagatctcctgtgcacttagagtgaaagccgacttatcaccaaagaatggtccaagccattcatgaagcatctgccttcatgatccaaacaccttccactaggccccacctccaggactggagatgacatttcaacatgagatttgggcagggacatatatttaaaccatatcaactctctaagtgattttcatacagcgctgggcttggacatctcaaggtagtggattagtacttagtcttgggcatcagacaaacttaggtacctgtttgagcctggataggtaacttaacctctcagcctgtttcctaatctataaaatgtagctaatcatatgaacctcggaggttgatggtgtgacgtaagtgagatgacatgtgccaagctcccgactcgcaatgttctgtctgcagctgtatccgcaatgggcatgaatgggcagatgatttgcccaaggcgtgtgaacattaaacagtcagctgttgatgaggaaggcatggctcgggacagtgccagctaagatacatctagaaccccattttccatcagtgcatttcctcctgtgacataagctgtgcctcttgtgtgctaggctcccagcccaaggttaggggctttggggaagcttaactgtgaggtcctcatctaggagcgtctttccactgccgtctaagctgtgtgtgtcagctgggttcaaagagttaaaaatatctggttagtaatcagctgtgcaaaagcaacacttttcattcttaagttctgttcttcagtgtgttgagatttttccgctcatttgtttccatgggtctcacaagcatggccttgagcagcagttctcagactttttgacctcgggacctctttgcacccaaaaattattgaggaccccaatgagcttttgtttgatatttaccagattaaaaattaaaactgagaaattaaaaaaacccgaacacacattcattccatcagccatcgagtgttgatgtcatcacactccgtgtagcttccagaaaacttcacctgcacccatgagagaataagagtgaacagggaaatatatcttagcatgatgataagaataattttgaccttgtggatcctggaaaagattctggagttccccgggggcctctgagccgcacggaactgctgatcttgattgcacaggttacccaaccctgttcgtctgcctcacagagaagcacagaagtcaaatctgaggccgttgtatcactgagcagcacagctggggcagggtcttagggaaggcctccgagtccagcgcagttccctggccttacagacgaggaacctgagccccaaagaggtaaagcaatgctcccaagctcacacagcgtgggtgccaagctcagttaataacccagagcttctgcccagtgggcttgcccctgcatcccagttgagtgacttagggaccaggctccggtgaaagacagcttggttccaatcccagctctgccactgtgtgacttcgggcaagtgtcttaacttctctggcctgagcgttctcatacataaaatgtgaataataaaaaatagctgcttcataggcttgctgggaaaattaaatgagataacgtgtggaaaggaactggcatcttgcataagcattacacacacacacacacacacacacacacacacacattttagcttcccagctaattcttagagggatacatttgtaatattttagcagtcactacttctagaaatcatgaccagcttttctccatctcttggtctcaattgttccttttcccagcaaccttcaggcttgctcagcagcatcgcaggggaaagggattccagaatccatggtgagaacaccgtctctatctgccttcacaacagactgaaggcagagctaagatcggatgtaattagtttacatgtcagacccaacaatccatgctgtacgtcatgcaggagtgatcagtgttttcagggtggaatgcaatctcataatgaagcggtgaatagtattattgcagttgaataacctgcagcatgatgtatggtgattagaatttgtttctggcatatggttttctttttcttgtttttcccccaaagtggaatgtctgcttctgtagcaccgtccatttgcaaactgcgttccccaaccactctttaattgtctcctacatcagttcatgggagagcttagtgagggtaggtaacccagtgctccttattcaacaaatgtaaatgtagcgctttacatttgtaaagggtgctggggggtccctggtgacctgcacacacaagtcaatagatttctgctgaaaaaattttaatattaaaacatcatacataaatttgaagacttcatatgcaaacagcaacaaaaccaaaaaataacaaaggacagagattttaaaataatctcttataaataactagttttatctacccaaccaaataaaataatcagcactccgtatgctacctcagatcctgttcagacatatgtgggtatcaataatgaatgaatcaattgattcatcctcagtcttgctgagtgtctttctgggagataccacttgtggctcttgtttacccaaagatcactttgaagatagaacattctatagtcccagatagcatcttcttgcctggaactgacataagatccatatctctaagccacaggactggagcttctccctcttgctaaggaagttgcatgtatcacccaaaagatactggctttgaggtgagaagacctggattctcatatcgtcctttgtactaacagcagtgtgatcgaggcaagtgccttgactctctggtcttccttcaccccatctgtacggtgatctctcagcagctgttcacctctaatggtggactatagagtggtggctgaatccctccaccatcaggcaatcaaagccagccatttccaccgaggcaggtggatcacaaggtcaggagttgaagaccagcctggccaagatggtgaaaccccgtctctactaaaaatacaaaaattagacaggcgtggtggtgggctcctgaagtcccagctactggggaggctgaggcaggagaatcgcttgaacctgggaggcggagattgcatcaatccgagattgcgccactgacactccagcctgggtgacagagggagactccgtctcaaaaaaaaaaaaaaaaaaaaaaaaaaagccagccatttccaatggccttgacataaggattatgttgcattaagtaaggatcattaaggatctgaatgagctaactaccatgagtttgaatgaatctagagcttgatctcaggtttgcatgtcagggatagcttcgttcaccaacacattctccattactgtgtgaggtggtgtacaagacctcaggttcactcttgggcctgggaatgactacagtggacatatttattcttccttagtgtgtcaggtgtctatcacagcataacaaactaccccaatcatggtggtttaagacaaaaataattgttcttgtgattctgtgggttggctgcattgttctgtcgattttgcctggactcattcatgggacagcattcggtttggcgggtcacctggaggcagggctcagttgggaagatggggctgtctggatctctctctctttccatggtctttccccctcaaggttagcctggcctgggttggctctagagatggtgacgccatgctgaaccccaattccaagagcttatcaagcctctgcttcctatgctgatgttccttggctaaaacaagtcatatgttcaagcccaaagttaatgtgaggatggggactgcccctcttagtgtagataccaggaggtgtgatttgtcgaggctgttagtgtaatggtcttcccaccttagcctcagtttccatgtcggttagatgggaataggttactaagcatgtaaggagggccagcctgagtttgaggtattttccatgtcacatccatttctaactgagtgtgtgatcataggattcacattcctcatgaatgaagaagtcttgtaccaagcgatccaagggtccaccattatcaccacctgacttcagcacacacatacacagacacacacttctgtttcatcttccacacaatgtaaaaatcaaatatgattggaagaatcttcaaagtggtagaggactataccaatgggatatattattacaaataataattatgaagaattctaatgtattttccaaaaacttatgagatgctaaacatctctgttacatattgcacatttaaaaataattacattatgagaagtgcgttattcgggtttctgtttcttttctggtgttttaagctcactctaaaaaggcctggcaaatcaagatgtgtttgcatgaaactaaaggcactaggaggagactaaaaggtcaaatctaccttttaggagcagcctgcattccaaatggaggcatttcagcttactcaagtctttatttagtctaaccacttggcaacctactttatttagtttaatctcctggcaacctactctaaccacttggaaacctacagcctacctacagaatcatagttcagccatccattcctaccttcctagtgtttttgtttatttgcttggctcattgtattgtgtttatgtgtacatgtttgtgagggcagctcaactgtgacctcttgtgcagtgttccaaatttacaaagttccctaaggataccaggccatccctggccctcttttctcttatatatgggcaaaggctgagtgacttggggtcctgacctcagtaaatgcagtcttatcctcacccattgctttgcttattcactgaacctagtcctgaaaatatgggagtatagattcagaatcagctctcacctctgtgtggatgactttgcgctcagcatgcatttcatagccctgctcatggcttataaggtcctctctaacatggctgctggttccccactctcctaagtgtaaacaccctcccccactctagggactgtgcatcccatcctgcatccactgcaccctagccttcataactcacatgctgatatggaaataaacgaagaccaccaaatggaaacaagcaaagcctcttgaatcagagcttgctacatccagagggccagccactagcccttgcgttcggcagagactgaaaggcaagcggaagagagaaagctccagagtggaaaagagggaaagcttcaagtatgtcctgattggaggctgttggcctggggaagttgcagacaggctaacaagatgcggggaatcttgtgtaatagattaggggtacctatttagctttcttgggttagtcctagaatttcaagccaggacaaaagttagggaaactgtcagggaaattaatcaagtccttgccatttggggctgattgctaaaggggttgttgtttggcttcctgaactggtgactctaaacagtaggttggctccctgggctggttgctgcaggttgtgggtgaaggttctgtttttatatagtcagactagtgtccatttgtatcttcagcctctcaccattcccccaactgaaggtgctgctgttacttgttccctgtcctcacagaccctctttccacaccccatcattctggctgaagccccctccaatgtgttttcacagcacctgcactttgatcacaacacatgtcccctttattttagtcattactggttcgttttcccttttggtccaaacactccttgagggcaggggttctgtcttgttcatcactgtatcttccctagtcccttgcaccgtgtctggctccagtcagcttatagtaaataccgattaaacaaatgattgatgaataccaaatacagcctgataaatctccctctttccactccctggtctgcatttctccctgccttacggatatctgcaactggatattccacttgcatctcaaaattatcatgtctaaaaccaaacatttgatctttctcccaagccattccttcttgtgatgtcctgatttgtaaagtcccaccatgctcacaaacactctgccttgccccctgcagctatcagtgggtccccatcatcttcatctcttgcatttctgtcccatttctttttattcccacctcagcctttgttctggtttggactctgacctcagcctgccgcctggtcactgggttccagtctcagtcaccctctcgaatccatcctccacgccatcccaaagttccactttgcttatgcttctgtcttatgggaaacccttctgtggcctcgcatgtctcagcctagccttcagagctctcaaccgtatgaaataatcccgtccatagtgttcattactccttgccacacacttgacttttcaatcccgttaccctagttgtttctaggacatggcagttcctcccctcctttctgctgcctttaccacctccgcagcttaaacaatgactgaacattcccttgtctccagtggcagttatagatactacgctgtgctgtagtgatcgatgcagatgtcttctttcccttactgaactaagctcattgaaacatccaccctagctggtctttgccatttatagagtaggcacatggtaaatatctgttgagtaaatgaatgatgcagctggtcattgcatctagaataaccctcacgttaaggtgggttcatccttagatggatttgggattgatgaattcaaacgtgcagttaagagtttgcttgtaaatcctgagaccatatagacagagtagcagcataattgtgtgtctgaaccatcagtgtttactcagcccttccttttgtagttctagtaaattgctttgtatttgaatccgtgctagggccttctccgcggagatttttttttcttgaggcctacaccggcagcatggccaaatgcctatttcccaacttatatccagaaattattgcctttttttttttttttttttttttttggacagagtcttgctcttgctctgtcgcccaggctggagagtgcagtggcgtgatctcggctcactgcaacctctgcctcctgtgttcaagcagttctcctgcctcagccttccaagtagccgggactacaagcgtgcgccaccgtgcccggctaatttttgtatttttagtagagacggggtttcaccgtgttggccaggatggtcttgatctcttgacctcgtgatccgcctgcctcggcctcccaaagtgctgggattacaggtgtgagccaccatgcctggccctggcttttctttagtagaagttcagttcatactaccaaggcatctaaaatatttatctccttactcattaaaactcggcagttacccgtcttactggaaagagggatacgtttgcctaattggggatccaatttttttgggtgagcagcagatctctggggcaggaaggcgggtaggcatgtgtaagttgtgatggagcccccagccccctaggcctcatccacctcagttcggtctccagctccagcgactcataggaacaccacagatgcacgaaaagcagccgggtcactccttatggaaggcgtgccagccgggcacagcaggtcccatccgtccttctagggcggccagtaaagagcctttctggtaataaatgtaatgaacatgtgatcattctgctgactgcagcctgctaacaagcttacgattaggatcaccgagattctccaagtgcccgagtgtctcagcctattacatggaggtgacacgctgtcataccaccctgggaaatgcaggatggctcctggcagcacagnnnnnnnnnnnnnnnnnnnntaaaacattcagagcatgccagccccgtgtagaacaccagcctaagagactggaataaaaagaatgccgacaaaatttgaataatcatatgcgatacatctattcattctaaaacatgattagataatgcaaattatacatgataatcataaattaaaacaattacaaataagacagaatacatttattgtttaaattgttgaagtttatatttagaaattgctctgggtagcatcaacattgactctgctggaggattcacctttgctgtcatagatgcaaaccaaccatttcaaacagttttaatggcaatctgtgcttccaatgcagtgaactgggtttctgctccgccgtgctcttccccattctctgtggttttatcatcctcggcctgcacacgtaccgttgcctttgcctagaatatcttttccttttttgtttattcttcagggtttaatgaaaaccctgactcttctgtgaggccaccccacttccctttggtattgcttttctcctctgcttccgcatggcatcttgcacatttgctaacgtgcactcatgaccttgaacatcccttgagcacaggtctctgttcccctctgggagcctcccctggctcatgcctcaatgatgaggaagaccctgtctgagttgcttttgtggccttcgtcccctctgtgcctagtacggggcctggcgctcctcgattggaaagcaagaaatatttatttaatgaaatgtcactaacacaagctgaggctcttttaggtctaagaaaacggccatctccccgttgctgttttggcccctctagtcctgtgtccttgatgtctgtgaacggccactcctgagttctgtctgtgaggctcactgctgctagcatgttggagcccaagggcattgaggggccttcccctgtcacccccttttgttacagacacacattccagagaggtgaaccctcgctaaaggttacagtttgccttccagctaccgctgaagcttgtggcttggttaaacaggcctccctgagtagaaatgatggactcttctgagttgagagacctcggattgtacttgaaactttccattctccagctgggccatttggggcacttcctgttcttgtgtgaaatcattagccacaatctggagacctacgagtggaatttggtctgcagtcttcgtttctttctttaaagtttgaattctgatgcttctcacaaagacacctgctttgcagatagctctggtccccaccgtccatccccgcagttactgcatctttgagaaactttctgttttatactcacagcgcttcacagcttgcactagccatgttccaagtcttcggccgctgcatgcagccagcagttagagtgcgggactggacagcgccggccggatgcttctgccttcgctcattgacggttcttgctggcttccgaaggcatttagatctgacactgtggatgaaaaggccctataaagcccttcctactctgacatccagtgaatctactattaagatggattttagagttaagtgagtccaggacgaccatcgatgtctcaccgaattggaactcactggtcagcagccgtaatgtttgaattggaaccagaaaatagctctcaaatttgcagagtcagctttgccgggcttcaggctgagtgggctcatagctggttggccctgtatctctggcctgggcaccgtggctccttgccaaggccggcaacccttgatggtggcagcacggagcagaccgagcccccagccgacttacccccgaggcctcgcgcctcccccttcacagcattgcgccttccctcttccagttcccagggtcgcttcaggctgtcccagccctctgcctagtcagctgtcagggaggggaagtggcaagtccaaggccgccagagggcttcctactgcctgccctgcctgtggcatttcttaaggtgacaaagagtgtgtttttaaaccaccctccagaactcttactccccatgaattctctgcagctgctcccccagaattgactggaaagagaacctcgtttaagctgcctatgcagcagaatgctgtgagtcagacgacgtcctgccaagtgcaacctgagatgcttcagtggaagcttgttcctcggtggtgacaccttgtctccacgctcatccattcgagtgaaaattcatctctttccctcccaaaaacatcatgtaatgaatgatggttgtttttgctctgaaggagacttttttttttttttttttttttttttttagacggagtctcgctctgttgccgggctggaatgcagtggcgtgatcttggctcactgcaacctctgcctcttgggttcaagcgattctcctgctccagcctcccaggcatctgggaccacaggcatgcgccaccacgcctagctaatttttgtatttttggtagagatggggtttcaccatgttgaccaggatggtctcggtctcttgacctcatgatccacccgcttcagcctcccaaagtgctgggattataggcgtgagccactgtgcccggccgaaagtgacttatatttgcatagattatctctgtaaaaagtgaaaggtttctgtgaacgtctggtacttataaaatatctttgtagggcaggatgggagatgattaaactacttcctcatttagacagtgccacctgtaagaagacttgtggtgtggattcaaagatggttatccacagtgagatgaatagaaggcagtacttctcaaactttcatgttcaccgaagtcacctggggatcttggtaaaatgcagattcggatacagcaggtctggatgaacccagactgcttttcctaataaactcccagaagaggcgcaggttttaaggctatgaggtgcttctctggaccctggctgtccgacggccacatttaatgagaagagaacccagctgtgtggttgttgactgcgatgaggatcgcactgacttagaaagttatgactttaatgttccttagtcgaatcactaagatttctatataaaacagcagaaaatatgggagtttggagaagagagaaatgagctggatgaaatagcttcctagctcctgattgatcattgggcatcagctattttgtgtgctggtgccgatgagcaggggaacacgtcgtgaacagagttgtgtcatagctggacgagaaggagatgttgtagggttcagttcgtgtagtgaatttttcctgaatccttaaattctcatatataaaaacatatagatatgaagacattacaataatatagaaaagactgtgtatgtatgtgtgtatgtgtaccctatgagaaatgtttttgctggtatgcgaaggggaaaatctagtgtttggaaagagttctccactgtgctttgggactacaagttcagcttggggcagggcagcagagttgaagaggaggcagggagggcagaatgaagccatcgtccctgtgcagcatatcgggtgttacttttatgttggtgaaagaatgatccgaggagccagcttatcagtgtggagaagattgcagctgcaatttgctggttagtctctgttcttttaacgctttcctgaagtgccattttgtctcggtaaaatgctccctgaaaatactcaaatatttttagttgtagagtacaaatcagattgagctgcacatttccctggtgagcaaaagtgatgagtttgtgttcattaactcgaggccatctggtgcagacacgctgccgtctgtgaatcaaacgtgcatcaaactccagggatcagaacgcgtgccagagccagtgttttggagagtcaacaacaaccgggggagaaagaggccctggctatatttttcttttaaaaaatcggctctgtcttgcaacatatcagagcatcccgtgctgcccagctgatgagcccacttgcaatctctccattgcccatctgaactgtctttgcggtgtgctctgaactgtttttgaggtgtgtctctgtggttgaagtcatcttgcctgataccatcttcgtttgggtagggggagaggtggagagagcattccagtccctttctctgcatttttctgtaaccacaggcctgagccacagacaggcgtgtgcacacacacacattctcactgtgagacaaagaattgtgaggcaaagcaatgctcaaggtagttgacatgttgcagaacattcttgggagaactgccttctgcaaataaccaatttcttgaggagacagtgcttcttgcagtcttgccaataaaaagccactcagcagcagctagctttctgtttcgcgcactcaccaaaatatatatacatgaaagaaattgctacgctgatctggtactgaagaccaccagggccgtccgtggcgtgtacggaggagggacctgggagggtctgggagtctccttggaggttcctcccacttcggcatccgtgagtcctgtatttggtaccggaggcccggaggcccgtgtatctgtgttagcagttggtcccctgcagagcacgacacctgacgtttctgtaacgagatgcaattttctgggtagcctctgtaccgtctttctagctatgccttttcctttaggtacccaagcatgttcactggaagaagagaacacagactgggctgcagacggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgtaggaaactttacatttcagaaaatatgaagacaaaaagatgaaggaaagggctttaaggatacaaaggaccttattatggaaggaaagcagtgttgtcaagagagctaaaatgaacttttctttttccagtgggttaacttttaaaagtgcatgttatttagtgccctgcattgcagtgtatcttattataaccttaccagccccagctccttcactgttttcagtgtttgctaatatggtaatcatgaaatagcactttatttttgaatctttggttagcattagagtttaagtttatcatttgctttttgtttgtaagccctgaatgaaggtttacttgcacttaggaaagcccactgtccagtatgtagacaagttagctcactgaaggtcttactaagccattagttgaattacaatgcatttgctacagcctggatctctaaattgatggaatccacattgttggcaagattcaagggtagcacacaccctgaacacacaaatgcgaggacacaacagcaagaatgagtaagcgagagaatcaggtgagtttctaaggagctttctggaggaacagaactttgttttactttttgattatgcaatttatgtttatagtggaaaacaggtaagacaataatagtacctttgctaatcatattttaaaacattttggtatgtatgcttctattcctttctctatgggaataaataccttaaacaatagaatcagtatattcgtgaaatatcggtcagtaaaatcagattagaatgattacaaatgcatcggtgaaggtattatcagtgaaaatatttgtaacctgcattttcgctgcatattcatttcatgaatatcttttcataccagttatgtaatatgtgtgtgtgtgtgtgtgtatatatatatatatatatatatatataccagttatataataaaatgttattttattgttatcactatgtagtctcattgaatggatataccatagcttatttaacggctttagtgttgtttgacatttgggttgcttccaacatttcctgctcataaatgctgccgtgatgagcatacttacagctgaatcttttcttgcatccatggttagttccctagaataagttcccagaagaggaatggctacatatatgcatgtgcaaactttatggcttttgatttgtgtcagtagcataatgtattttcttcactggcatttagcatacttttaacctgtggtagcccataactctttactgtgtcagggccgggttccgtgcacctcctttatcagcctacaacactacgatgcccccagcctttccagtgccgcctcttcctgcccagcccagttcctggcccagaggccatggcagtttgcatggaagtgctgagtattgtttcatgtttgcaaagagaggacagctgtggatgaatggagaggaaataggagaaagtcattgtcagagactcgggatttttgatggaagctttatcgccgatagatatgacatttgccgagtaggccatcacttctttgattgtcactttccaaaccaaagcaaatgaagtcatcaaaaagaacgatgtgtcggagggcatttcaaaattctggagatttctgagacacgtgtaaggaacagaaaacctggcttgggtggcatgctgtgtcaaaggaaaagaactgcagtgaggttggaggagtgggctcacctgatggatgcatttcttcagtacatacatggcaggggaaggcctgtccctctgtggggtcaggcagtcagggtggctcttttaaagtggtagcttctgaatgtcctggctgctgggatcctagtagctttcctgggtgcccttggaaagcagaggattggtggtggtcctgggtgagggtctgcagatgcaggtggtggccaggggtctagccaggaagatatgccatatcagggaggcccagccctcaggggactgaggtttagagtggagacttggagattccttggaggtctagagataaggagtgactttgttccataggcaccgggctcctggagtctgagccataggaaactggtattcagtactagagctaggattgaagaaggggtctgttcacaaggaattcagtagcagcccaggtcctacgtggtaccacagtcagagtggaaccagcagcccagactgctg

SEQ ID NO: 17551 - DNA, 10234 bp, Human
  misc_feature (1)...(10234): n = A,T,C or G
tccactacatgaaaggtaaaatgaattaccgacgttaagccgtcaataaagtcatttctgtaaatggtgtctccaaagggccgccgtattattcagctggctttatcagctggctggaaattacgtggaggagccgggccgcgcggcgcgcggggccgctcactttgattaagcgtcttgccagcgcgatgtgacagagcttttgaccagggttttattcacaggcctgtgatgaacgccaagctgatcaggcggaatgaagagtaattaaaacctataaattatcttccgcagcccttctcgaggcgtctcctgcaggcgagataaggcgtcgagaccctatttaccgcgctgaaagggaccgcggcgcacaaaagctacgcagctaaataggatattgatagtgtcctaattagaatttaattaagtacccacgcttgcttgcgggataaagatttcaattttgcgaacttaaatataaataaaatcccacccccatttcggggagaaggggtgggggcgcctggagatttcggggagcccttgggtgtgctactgaagaggactcgggagactccaaggtggggttggaggcggcttgggaaggtagagaagactgcagcgcagcgttagggagagaggttttctcccctaggctgcagcgcaagtctagccgggaactcagccccggaaatcgggggaccctcgcctgctcccaagatgcggtgagcaatataaattcctgctctccaccagcccttttgagaaacttcagctactgtggtggtggttcggcttgttgtgggtttagttgcatgttcctcctagcctaaccctctgtgacttttctggaaaactggaggtagggggattctttcgcatgtcacaaatagacaatatttccaaagggatcctttctctactgtcccagttgcggagggcgttcagggcgaggaggtccgctggagctctaagatgacacccccgaaggcctcgtttgctgacgcctttctcggccaccgcaggcttcagcatagtcggatactggtcctccaaaacgaatccggagacaagtcccgcaggtgcctagagcttcagtccacacgccacccccgtccctcacattcccggttatgagaaaattttgggggtgcctcgaccaggaaatagcgaaaaagagatcggcagacgggagaatgatagcagctggaggaacggcatttccctcaaactagggaagaacgcacagagctggagccggaggcacccagggagttgggagcaatcccaggaaattcagtcacccggcaattgagggaaactccctgttcacaacttcagctagccagggcaaatacttggggtgcagcgctttcatttatttgattttactttgcagggaaatctaacacagaggttaccctgaactctaaaagctagggcctagcgcgcatccgcgttctgactcgccggccccggggccctcctgagattaatctgcgttgcccggactcccactgccagggaaggtccaggcaactggctctggggctattcctagccctctgggcttggctctatggcgccagggcagctccagggtgttgtcgaaagtctggaccgggaagggcatgggtgcggattccccacaaagggaaagcaatgcagcgggccggcaggagacgtacaaacgtaaacgtgcgacgctagctaggcgcagcgggcctttcagattttgctatttgtgaaaaacaaattgcgcctctgaaagtaaccaactctaggtctatttcacatcaccgacctccctgtctcactccccctccctccactacacacacccaaacccacacccacccacaaacacacaaaccggcagtgacaacaaccacccatccttcaataacagcaaccagagacagaggagaaaataaaaagctgagtttcttaggcgtgggggtgcaaaacagccaggctcctgcctactgcccctgctcccggagctcacagacccataatcctgcatttctctaacaagttgtttatggagttgcttctccatttgcctacatcccaaaattcacccctcccgggtttcttctgccccctcctgagtcccggcctgaaggagggggagggacgcgggtgcgggcgcgggtgggggagggcggacccgacgcacagggccagcgccgaggcgccccctctccgccagcggttgacgcccccggattatttatccgcaaagtcccgcgcgcgcccattgggccgaggcccgagtgtcagcgcgagtcccggctcgccattggctccgcacacgtgcggccctgactcacgtgcttccggtttgaaggcaaaaagtgtgcctgggtgattttttttttaagcgagagagtttgtgcaaagatccgagctgtcagagatttgaaaaaaaaaaaaaaaaaaaaaaaaaaaaaaacagcccggcgctggcggagacgcgctctccctgcaaaaaaagcaaaggcgattaaaggcgctgccagcctcacgctctgggcacagctgagcgtgacactcggggaagtcaaacccctcactactgcctaggaagatggctagactttaaatactatttttttccctttaagaaaaaaattattggagctttttttcttgctttctttttccttttctttttctttttttccttcatttttttggccgtggcttactccccatttaaatcaaatcattgaatctggttgcagaaagaaaaaagaaatagccaagtgtctccatatctggatgtctacaaattagagagggagagacagcgagatctatctgctagataagaacgagcgatccaggccagacgcctgagcttttttcctgcacccgccccgtgccttcgctgaggcttcgctgcctccttcctccgcgcacccccacgtgccgctggcaaagtggggtggggagcgaggcgctgggggcgggggcggcgcgcgcggaggcggcggggcggcgagcatggaagaacagcagccggaacctaaaagtcagcgcgactcggccctcgcgcggcggccggcgactccgggcggcctcagcctgagcctcagtccgggcgccaggcagcagcggcagtcaacaagtggagacagcgtgccggtgtcccgcagcctgattgctctcgccaggcgcggctttgcctgccgcccctgcccagcacccgcacccccaccacagtatcgattccgcacctcacatctcatgaccctgctcacaagcgcagcagcgccagctgcactgagcacaactttttatcgagaaatctgaggcggattcgcttgaaaaggaagagcgcaccgagttttggtgttgcgtgatcagagaatcgagatgaggaagcgtgtcagcgttaagagatcaaattgnnnnnnnnnnnnnnnnnnnnccccttgcctgccgcccctggcccaccacccgcacctccccccacgccccccgcccccgccgcctcagcatctcgcggcgcctgctcaccagccgcagccagcggcccagctgcaccgcaccaccaactttttcatcgacaacatcctgaggccggacttcggctgcaaaaaggagcagccgccaccgcagcttctggtggctgcggcggccagaggaggcgcaggaggaggaggccgggtcgagcgtgacagaggccagactgccgcaggtagagaccctgtccacccgttgggcacccgggcgcctaggcgtgcctcgctcctgtgcgccccggacgcgaactgtggcccacccgacggctcccagccagccgccgccgggcgggcgcgtctaaagctgggaacccggctgcggcgcggcggcgccgcggcggcagtggcggacgcggcggcggcagcagcagccaagccctcggacaccggtggcggcggcagatggcaggcggcgcggggagccccggagcgcagggcaccaaatacccggagcacggcaacccggctatcctacttatgggctcagccaacggcgggcccgtggtcaaaactgactcgcagcagcctctcgtatggcccgcctgggtgtactgcacacgttattcggatcgtccatcctccggtgagtacccaactccgggctgcgccatgccttctggccccgcggaccgccccagaacgccaagctgcggcgctagggagagcaaacccggcctcgggtactccagtctctcacgcctgcttcctcaccccagttccagtcacaaccgaatgttcatccagctatgcgatcctggcctctgcggccaccacccgagaagctacagctcgtggcacaggaggctcgggtctcgattctttgattttgaactctgaatccctggggccttctttgtctcttatctttattattcttaggaaaagtacatagtcagtgattttctttccagggtgtttagataaggcaggaaggtgggcctagtgatgtgtgtctgaaatcccaccagcctgatcgtccgaaggccagatttgaccagagaaggccttgttcagaaaaattatattcactgtgtgtccttacagacacaaacaccatctcgatattttctgcggagagaccgtttacattgataaacatgggaaacacaggaagacagggaggaaagcgtctgaaagccgtccctctcccccggctgggtagcgaaaagagtctgacccgggtgggtagaaaccagggaaaggcagttgccaaaaaggtgggtgctggcagcccctggttttctggagctgaaaaacagtgggagaggagagaaaacaggtcaggctcaggccaggaagcgtgtccaagggcatgagagccagtttcctccgtagcttctccgcggaacggttcccgcatcctccccgcgcggcgctttccttttttcacccgcacatccagcagacttctggcatccgtaggcctgtttttctcggctttccttccaccacttttccgtgtgcccctcgcgcttggcgaacccgaggaggagacctgagctgggctccgggagagaaggccaaggcctgcctgacgccccggcccgcagtgtctgggagagcggcagaagctttggcccaagatcagcactccaggcacccggtccggcagggggccgggaacaacgtagccacgcgccgctttcctctggctggtctctcgccgccccacagctgccggccgggcgcggatcgatgcgcactatcagctcccgccatctcgagccccgttattgacacgtcgggctccctgaacctccgaaaagctgctttgattgactcgcctgatggatagagtgattgagctgtcaggctgcacggctcgggctggccgggagactaggaacgattttattacaagagtccgtgcctctgcacacacatacaacaacacttcaacatgtcccggatgcagaacgggcagtggggcctttttggggctgtgtgcatttcttgggctatttctccccgctcagctaattacgaatcaaaaccccagttctgctctggagagggccttggctttgttcttggccactttccttcttatgggcctgggtaggtaggggaccagctccttctcctgcttgggcagttgggggaggaggggatgagcctcgacccagatctgagtcgctgcagtatgctaggcctggactcgttgtcataggacagctggttaccccagcctcctgcctgccccaggagtaggctgcccagccttcctctctgtagctaggtttggagatgccggcaaagatccttctttccagacagttttagagatgaacaggcctgacagggacttaacttggttcagcaagctaccatatccaaggcaggacccagcaagtaaatgccagaagacttgggtgtggaagcaggtgggcagaggtgcaggcttttgaggcacacaccaacagttcaatcctctcctggttttcccgctttccctccctcctttctcagtgggccctcctcccagactagtatttgaggggaacttcaccttcctaaggaggtttcctgtggccccttcccattcctatctggtggtcaaagcacatttttttttttctggattgtccctgcttccctccctctcctttttgctcataggtgggggaaggggctgcagtctccttgcaaatgtcatcagtaggcagagaaagccaatccggcttgtttttgttattcaggagtttttaatcctgaaattgcatcagttgaaaggggagataaggaagacccagataagagagaccctgccccacgcagccggttagaggaatgtggaaggccctccctttcttattggcaccatccaaggggcaaggctgaaaacccagagccagggtcatgaggatggatcagggccttttctccttcagagaaggggtggtccctgcatccctgagaccctagaaaaggcttcctttaggccaaagagaaagaaggcgaggaggtgtgtgtgggagggaggggtgcggggaggggggcagacaccaaatactttggagctaagcagccctctcccagccggctcactatcccgttgttttctgaggtcaatagctacaagcagatggggtcttattgtagtttctcctgtaggtatgattcttgaggaggagaggaagatttgtttgcaggctggcgactcccccagggcctgccctcactgccccagtcctatctattccggggcggtgaggacagcaggcccctgacccccaactctgggctgggccatatgagctccaaatatctcctcatcttggattcctgccttcttggcttggaaatgttgtgatttcggtctgtccctgactgtcctgtgagaattggggtgtggggtgcacctacaacctcaaccagctttccttcactgctcctttgccctcccaaagggaacccggggaccccagtggtctggtgaggggcacttcgatccagggattggctggcgggagggagccaggggttcagcagggcctccgagatcgccccggaagcgcggggctcgcggcccagctcggcaatgctattctcacggcttcctttgccctctcccccctcccttctgccctcggtccccacccccaccccaccccggccctctccgccgctgcaggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacaggcatcaagaacggcctggcgctgcacctcatggcccagggactgtacaaccactccaccaccacggtccaggacaaagacgagagcgagtagccgccacaggccggggccgcgcccgcgccccctcccggcaccgccgccgtcgtctcccggcccctcgctgggggagaaagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccagcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaagtgtacactgtgctcacgagcgctggcggccctcctgtttgcgggctcgggaaggacgtgggtccgggcacacagcgccccagcgcccctgcgcacgccgggcggggagccggccgggccttgcgatcaccgcacaacgaatgcagggcgaaggggaagcgcgacccagatttgggtttagcctgggtctgaagggtctggcgggacacgcctggtctccgattgcgttcaagggaactcaaaggccgacaaccacagtcctggcttcggaaacgctgcctgggctgcggggcagctccccgcaccggtccaggcccagcccagtggcggcctcctcctgtacaaactgcttttcactccaacctgcacttttctttttctttctttcttttatttcccctggtgcaggttttgctgcagattttttttatccagagatagaagggggcctgccttcctccctccccgacagcccgcttgggcgaggggcactttggcctggcctcttggccgcctggactcactgcacttcgtttgcgggagggcttctgttggcgaagcagcaggtccgggggcggcctgcggagcctcgcggggctcggatctcctgggcccgcaatgccggaggagaggaggcccaaatgctgggaaagctgttcggagtggctgcttgggccttgaacccgaggtgggcgcacgtctgccgtatctgggccctaaaccaaagagggttcccttaggcatcccaacaaagcctaactttcttcctcaccaaggggggcgcacatagaagcccccagggccctcaggacaccctgggttcccagaaggaaatgtctggcctcttgctgctaacactggggcccatccttccagagcaggagctgctctcagatcttaagaggttaaggggaggaagggaagtttccttctcaggaggtattatctttgtccaggatttttttaaattgtaaattccactcccacattttttctctcttcggcaatatgtatgtatatacccacacgtgtgcagctagacgggcaggtgcccacacatacttgtgtgcatatacaataatgtgcagatattggtgcacctaagttcctaccagttttttgtgtattcctgtacccgtgagtattgtgcaactgattttcttctctaattagatacacaattggacgtttgtgagttcactgtgtgtacatgcatgaatttgtgtttgcacactggaatgtctgcaggtgtgtttgctgggtttgttcatgtgtgagatccctgttctctgtgctcttcccttgagtttctcaactgtttttgtaggattgattttgtgcaaaatgataatggctagttattccaccttttttattgaaaaattttccctgatttggcccaatgtactgtttgctcctggccggggaactaacagggctagatctcaatcccaggaagcctaggtcccctccaaatccctacataagggtttggcggctagagtggaattggagggtgcatttgacactgctgtgggttcccaactttatcgcaattaatttccttccttccatctgcccattgttttctggaggagtaactcttgcatataataggtgctcaaccaatctttgtgggcagagttagaagcagtgagatgggcccttccctggggttggtctaggggagttgttttctggtagtcaaaagcctgtgctttgcttgccttggggagtgggcttggactcttcaagccttccaggctttcctgttaaacagtctgaggcctgtgtcttggagcacccttctcctaatacctctcagaatttcaggaagagtcccattccatttcaccctcccagcacatcagatgtgatgttaaggatgctcaactctatatattggagaaccttactattttgaatgtctaggaattggctacactcccttctcccctccctattgtggcctcttaggatattcaagtcccccaagactac

SEQ ID NO: 17552 - DNA, 13102 bp, Human
agggatttggggagtagggtaaacaaaacctacttggaaaagaattggggaagaaaaccaaaaattgccttctgcagggctggggacagggaaggaggcagggccagggaaaggcacatttcatatcactaatctaacttgggaggctgtgggggaccgtcttcaactggccttacgaggaaagccacatggccgattggagaatccacaggagggagagaaggaaagggaatgtagctggtaggatgcaatagccccttcctttctgggcacaggagggcagccagggcaccaggtccaggcagtaacctcacaagaacagcagtttttgcagcttagagatcacccacctggcccacccagctactcattctgctcagcgtgggctggtgtagggccactctccgccccgagggagtggacagctctgtagcttggggccctgcctcttcttctgaggcagtactgcctctgcgcccttggcctggggctcctggctctcaggggtggcaacagccttcccttcctgggcagcgcccttgtcgctgcaggcattgatcttcccccactcctgttcttcctccataggtgaggaggcagaagagtcaccccaccctccttcccatttctcttgaaggacaagctgctcttagaaacccttcttgaaagataattatttatttatttatttatttatttatttatttatttatttatttattttagacagggtatcactctgttacccaagctagagtgcagtggcgcaatctcggctcactgcagcttcgacctccccaggctcaagccgatcctcccacctcagcctcccgagtagctgagatcacaaccccagcacactcagcttttttttttttttttttttttttggaaggcagctatgctctccactctactatcaacgctattttattgtatttttgtagagacgggttttcgccatgttgcccagtctggtctcgaactcctgggctcaagcgatcacccctgtcttggcctcccaaaatgaagggattacaggcgtgagccaccgtgcctggccttgaaaggcaatttcgtcttcttggaagtctccttgcgagggagggagcctcccctttggcctcagcaccctggctagggggtgctggctccatggcattgccaatggtcccggctgcctcttctgttcacaggggcctactccccttcacccttgggggatgtcaccattgcttttcacgtggccaccctcctgtccgttggctttcgcgtggggagtgcctgctgcctctgcggcggtcacgtcgccccggagagcctcggagctctggctgcccacgatgggagtcctctggggggcgccggagccgtgccgggtccccgccgcaggggacagtaacgcggagtcggcctggccggcggaaagggggtgctggggaacagagccgcaccccactcggctcgggaaagccctggtaaccaaaattcttgaaaagcactagtgtctggcctcggcactaactctccccgagtctcgttaagcctgcggggatgactcagagggtctggggtcctgtcggggaaaagttcagaaaccagaacagttccagattctctccatgtgtctgtggtcccaccacctcctccgcaagggaccctgaaagctgtctgggacctaggacaacttcttgggatgagtacggccattcgccctggctgagccccaggagtgcgggcaggggccgcgggggtcgggtcgccagccgccacctcctgcctttctctgcctgcggtgcgctgggacaccctcgaggcggctcagcgcccgcggttcccagcgcgggcggggccgcggcagaggttcccaaaccggttgcacagaaacagcgccaccccctactgcccgcggggccacctgtgtgtgcctttccttcaaaaacaaaggcggggcgggggcggaagtgcctcaaaagaaggcgggccgaagcgaggtgcggctccctgtcgccgcggaggggcgggggcaggacgcgcaactccggccggagctgtccggggtcgtgagccggccccgccttggtggcggcgccccctcgcggtccagaggcagacgcatcgggtgggctcgggtctccagcccggccgggaggagggaccgggtctgcggagcggggactcggggcctcggcggggcgcgcacacgcaggcggggcggcccggggtgcggggcctctgcgcggctgaccaggctcccagagcgtcagcgccgcccatggccgagccgctccagccagaccccggggcggccgaggacgcggcggcccaagctgtggagacgccgggctggaaggccccggaggacgccggcccccaggtaggcgccgactcgggagcggaggggctgggcccgccttccggctgatttgcagtgaggccagcgggtcccatagagttaagtaaaaagtacagttttttaaatggtcccagtccctacccactatgctacgcaaacgagaaaccccggtcatttagctctaccctccccgctacccccagtgcaggtcccatctcaatttcttgtctttgcggggtggtggggcggggaggaactggttacgtcccagaacgcgcggtggaaccctccgaaccgagggggtgtaatagatgcttgtctgaaagtgtgaatcgagtccccagcgtgtggggttggggccgctgcggtccctaatcgcaaggaggggaacctcgtggaggggaacctcccagacctaaggagcggggacctcaggccggaccccggggcggtgcagcccctagacaggacggctccaggtcgacccgagatcatggcaccggtatttttgcatctcactcctaccctcttagaattgcttctcgaagttttctctgttccactttagcccggaagttatgagatccgacactatggaccagccaagtgggtcagcacgtccgtggagtctatggactgggattcagccatccagacgggctttacgaaactgaacagctacattcaaggcaaaaacgagaaaggtaaaagcagttttccttgtaattatgcatattgtgaaagagtccccgggcttattattgagttttagcttattaaagaaatatcctttataatggaaaaataagcaagtcatcaaagacttgtcttgttttcagacaagactcctcaggaccagggttacactgggtattacttttcaacctctgttctctgattttgctggatgaactggggtttggtgtaactcgtgataagtccttttctatggctaacacctcaagataatttggtgactggtaggatcagagacgtcaggaggcaagaaggtaccaagattagaagcatcaagtcatagcttttggtctggctttgctgctatttatattttagcaggtctcttagcctgtgggacctcattttctgaatggtaagaaaaaataatttactgaccatgtaatctctaatttccccttttatctctaaaaattaagaatttattaacccagaatatcagtattacagaaagtggtttaatgtgggcagtgagcaattgagtaattttggccttactgttttaagatgaaaattatcttaaaggtaaatatgtcaacaatgtgaagtaaatcaaggaacccagatcaaaaaagaataggttaaatgtttaaagctgtcaaaaatacactaaatttgctttcatttttatgtcacagagatgaaaataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtaagtggtagataatttatagccttgctgactgctagttttacttgcgtgcactcacagtttagctccaatgcaatttcaaaaggctttttcacccttccataaaatcaggtctaatgcattttgtgatgttttcctactggctttgttgtatatgttactgaggtctgtcacaagataataatcacttcatttaatgagtctattgcatgcccttcatataagacacggtgcaaattatatgctcccaaaacaaaagactgcaatatagttagacctgaacaaaaataccttaaaacagaagtcttagtttgttcaggctgttgtaacaaaataccgtaggctgggtagtttatgaaaaacagaaatttctctctcacatttctggagacaaggaagttcaagtttaaggtgctggcagtttcagtgactggtgagggcccgtttcctggttcatagatggaaccttctcagaaatgccctcatgtggtggaagaggcaaggcagctttattggacatgttttacaaggctctaccctcatgacctaatcactttccaaaggcctcatctcctaatactatcacattagtgattaggttttcaaaatatgaattttgaggcccagcactttgggaggctgaggcaggtggatcacttgagcctgggagttagagaccagcctgggcaacatggcaaggccccatctctaccaaatgtatatatatatattagccaggcctggtggcacatgcctgtggtcccagctacttgggaggctgaggtaggaggatcacttgggcccaggaggtcgaggctgcagtgagccgtaattgcaccaatgcactccagcctgggtgactgagaccctgtctcaacaaaaagaaaaatgtatatatgaattttggggagacacaaacatagagttcatagcattctgccctgatcctgtaaaattcatatcatctcacatgcagaatacattcattctatcccaatagcctcaaaagtcttaattcattccagcaaaagcctaaattcatctaaagatcatcaaaatcaaatctgaggctcaaggtacagttcatcctgcggccgattcccctccatctatgaacctgtgaaatcaaacatattatatgcttccaaaatacaatggtgggacagacataggataaatactgcattccaaaggaagaaatgggaaaaaagaaatgggtaacaggttccaagtaagttctaaatcttcagattaattttctttgactcaaagctcttccctctgggcccactgggatgaaggtcccacttgtgaagctctgctgaacagaggttgggcccccaaggcttcaagtggccctggccatggctttggatggcccaaccccactgcagctctcacagttggagggaccccaccctgcagctctaccaggctcgaattgcacaccggtggccctcccagtctggtgtgcccggctcccatggctctgttagccatttccctattggggactcactgcagtagcttggtctcactgtggccctctgcttgggtcacatacccaaggccctgggcagctccatccttcaaggtggaggtagccacacccccacagctcatgtactgacagaggtcggcaccacatggatgctgctgaggttaactgcctgtgccttccggagggacagacatcacagcccaggccacacctcagcccactggagctgaacctggggcatccaaggagggctgcactggaatgcaggaaacagattggtgaggcagtgctaggcagtgagttccaaggccccccaggtgcccaaagaccctcctttgaaattgttctgccctccccaggcactgaaacttggcatgtgatgggagaggcagctcataatttctaaaatgcctttggcatcgttcttccattatgctggagaataggtcctggtttctgtttagatggcagttccacattcatctccttatcaaagggttgcttggccttacccttgttctctcttgaacaagctttctcatttcttttaatgtagataggctaagaattttccagatgtttaagttctgcttcccttttgattaaaaatttactctttaaattctctcttcttgtattttactatcaagagaagcgaagccacatcttccattcacattttgcttagaaaatgttcagccaaatatcctatttcataactcacaagttgtactgtccacattacactgggacacaaacacagtttctttgccatgtcatgacaagggtcacctttcctccaagttccaacaaatgttcctcatttccatccgagaccttatgagaatggcctttaccgcaaatcaccatgatctggtatgactcccactctctccttagactgccgttgccatcctcagcagtgcctctgtatctgccacgtggttactgtcctctcccacatgacccttacagcagtcatgtgtggacgaatctgttcccttaatacttgcttatcctttaactttcagagtgtcactctcttgtcatttctcctgtcccatttctttacctccgttggctcctcagctccctaccctaggatcactgtcgatgcctgttttagaccctcatttcatagccgacttgttctgggcaatccattcatattgcttcaactccctcagtcgaatgattctcccatctattaagtgtctccagatctgatttccctacttgttggacatctctctttggggttgggggaatcaaactcaacaaccctaaaaatgagcctttgcccaattcccacatctctgatcttatagtgcctgtctcagttgagggcctcatcagccagataggctcctctttttttttttctttttttctgagacagggtctcgctctgttgtccaggctggagtacagtggcatgatcatagctcactgcagcctggaacatctgggctcaagggatcctcccacttcagcctcctgagtagcatgtgccaccaccatgcccagctaatttattattttttgtagggacaggatctcactatgttgcccaggctcgtcttgaactcctgggctcaagcagtctacttatctcagcctcccaaagcattgggtttacaagcatgagccaccatgcacagtcaagacagcttcctgagcaaggaatttacagtcaccatcagcacaatgttcctgacaattgattgtcaaatctggcccattcacctcaaaaatgattcagggttttgttccctcctctctatcaccattgtgacttactcgggtcttcctcttctagggaccgcactaagtcatctttgtgtaccccagttcttggcacaagcctgacattcccaatagatactgggatgttgattgatcttaactgaattatttcttgactatttcacttcagtagcctgcaagccgtcttccctgccaccagtcttttcctttcctcttccacactggaactgtcatctttcttaccacaatgacaaaagcccaaaatctccgttggattcctcttgcctccccagggaagctcagattgttcacacggtgcacagtgccacatatgacctggcccagccctgtctcagcagctccccttcccaccacttgggcttctcacccttcatgtaacatgccatgttcttccacatcttgttacctttgacctcaggcacgttagtccacttttccttgctaaaatttccctgttttaaaatgcgtgtgatcataatacttactatctcatagggttgccatgaagatcggatgagttaatttatgtaaaacacttggaacatgagcatcaagcattcctagctctagtactctctttttcctcttcctggagagcccattgccaccctacaggacaaatgacaccttttctgtgatgccttcttcaatttctccacctagctaggtactctgtcctggggcccttctattcttcttcttctaagtaatagtggcttatttatagacggaaatttcttcaagaatatgacagcatgttactatgtccatatattccagcccctggcaaggcaggcacgtgggggtgagggaggcaagcaccatatatgttgtctgtgttctgaataaaacagtgaatagatcattgtgaaacaacacacagtcagagaacaaaagcttatttctaattagagggttcagtatttgattttaagggaaaatgaatttgaaaacaaattccttttaggcagaacatgctaagcattggttattcatcaaggaaataaataatacatttaagagccaaaatgtttctttctttttttttttttttttctgagatggagtttcactcttgttgcgcaagctggaatacaatggcgcaatctcagctcactgcaatgtccgcctcccaggttcaaagtgattcatctgcctcaacctcccgagtagctgggattacagtcacccctcctcactatgcctggctaatttttatatttttagtagagacggggtttcaccatcttggccaggctggtctggaactcctgacctcaggtgatccacccgccttggcttctcaaagtgttgagactacaggcgtgagccaccatgcctggcccaaaatgtttcttaacccatggttcagaattatattcaatcgacatgaaaatgatagaatggaagagttatatcaactcacctgcagtgttttattttgcatacatgtgcatgcagagattcctacacttgacaggattaaaagggaactgcatgccaggaatggttctgggtgctgggtagacattgttatataaagcagacatggtttgtacccttaaaagagatgacacctcagctgaagcgtggtaggattgattttttgcactggcacattgataacagaacttataccaaagaaggcatattaggaaaagttttgtttctcagtgtttcttattcttaaccctcaaaatcaaattcatcatgcttgcatgtcagcagctcagctaggtcagtgctgtcatgatttaatctcaggatgtttttgtttatatactgtagaatgtatacttaaacttttattctcttttcccactttttgttttaatcttttgactgtcttttcttccacttccccacagcagcctcctgactggatccttcctcaccagtctattatatgtctgcctatattctaatccagatcttatcaagttgcacatttcagctcaacatccttggaaataacctcaaaaggccttaggctaatgcacagggttcttccttctagttctgactcaccttcctgacctcattttatgcctcactatgaaaacacttggtatttttagatttatggtctctttcctatcactcccctttctttgttcagcaaaaccatcctccattcaggcccaactcagatgattctccttaccccagatttaatcaggtcctcaacgctcccacaacactttgatcctgtccctgtttaaaacccttctcagaggccgggcgtggtggcttatgcctataatcccattgctttgggaggccaaggcaggtggatcactcgagctcaggagtttgagaccagcctaggtaacacagtaagaccctgtctctacaggttttttaaaaaattagtccgatgtgcacctgtggttccagcaacttgggaggctgaggtgggaggactgcttgagcccaggaggtcaaggatgctctgccaccatattccagcctgggcaacagacagagtgagactctgtctcaaaaaaacaaacaaacaaaaaaacctcaggatgtatagagagagctgccagaacgttgatctcttccattggatcataaattcagagaggtgaaaactgtatcatattcatctgtaatccagtgtttattcttttccttaggagagggaaaaaggggcaatgtgcaagtgaaaatcgagtctggaaaaggggcttctacaggggtgttggtgtagttctctgatcagcagcaccggcatggatgtgggagctcggaggaaatacactctcaggccccaccccagacctgaatctgcatcgtagcaaaatccccaggtgacctgtatgcacgttaaaggtttgagaagcacagggtagagcacttgagattgtgtaggttccaaatccacctgtcaacagatggaaggaggggatgcatcctcctgggtttcctcagtgcttctgaggtcacatggagactgggaatcacaggcaggagtggtcagttcatctgctgagagggagtagctttttttatttttattttttgagaaagagtcttgcactctgtcgcccaggctggagtgcagtggcgtgatcttggctcactgcaacctccacctcccaggttcaagcgattctcctgcttcagcctcccaagtaactgggactacaggcatccgccaccacatctggctaagttttgtatttttattagagatggggttttaccatgttggccaggctggtcttgaactcctgacctcaagtgatccgcccaccttggcctcccaaagtcctgggattacaggtgtgagccacctcgcctggccgagagggagtaactttggagctgcacttcactcagcattcacggtactagcgcccgctttttgcttcagactgacattcacatcagtattaaaatcattcacggttatttcctttctcctttgtaggtctttcgatggattttctagtgcccaaaagaatcaagaacaacttttgacattagcaagcattttaagggaagatggaaaagttttcgatgagaaggtttactacactgcaggctacaacagtcctgtcaaattgcttaatagaaataatgaagtgtggttgattcaaaaaaatgaacccaccaaagaaaacgaatgagaaaaatgaaaggaagttctgctgtcagaggcaaaacatctgtttatcatagacatcaacatgacctataagtaaagtgcgtgtctagtgtcttctattgagagtactactattaattaagcttatttccaatgtgcctttttaatgcttgaagttttatctacatacacaggtaacagaggacagtagtctgtaaacatataaatcggtcataactatcgtggtctttatttctgtgaggatctagggaaatttcatgtcacttccctccttcactgcatcacaatcatattcccttttttttttcttggatttgtgtcagttggatgatatcccctccagatagtatcaataaaatgttaaaattatttatcttgtgtggaacccctaggctgtcaggcccggagaggtgaaattcagctggacacaaaaatcaaattgtcttttgtggctgccaccattacattctctgttgtatgtattactttccctcctgcatcctcccactgccccactgcacaagaatactccatgtaactccatttaaatgtaatgaattcattcctttctttctggtctccacttaaccccctaaaaatcttgctttttcccctaaacatttccctgaactgtcacgtattttcattcattctttaactcattgtagggagtccctgctatgttccaagcactctgctaaggactgggaggtggtggtaagaaaacctgtgtcccaagcccctcatcactgacttcctcttcactaactccaacaacatctttccacctccttaactatttcattcaccctcccactgtgaacaccacagacaaggcccctggcctcatggagtttacattctagagggtgagggagttcaacacaaataagatgcttgaaattggcaagtgtgatgaagaacagaatagggcagtggggtagagtgtggttaggtagggtgtggtggacatcacataaggtggtcagcaaaggcctctcaagagacagttgagacttgaatgacgaggatgagtcagatgaaagccaggggcagaggtgaggggagcatcttgggcagaggtgacagtgttaaagggagaggccacgttcagtacccagaacaaaaagctgcacacactgcttgctgagcaagagagcactgctcttgtagggcacggtctctcggataaagaaaactgcggaccttatgcagggttttaggaaggattaacagactttcaaaagcatttaggagtcgagggagctttagttgtggggatgcagttaccagagtgaggccgctgctgattagcatgatttagaagcctagtttggaggtgaggttactgatgggaaattgtcattgattgtttctggtacttaattgctactgtggccaaaggatggtcagttttattcaggatttgaagtggtggcagacaacgtgaggtgtgccactcaaattcaccttcaagaaagtaccagccgcccagctgtgaggggtgtggttcgccgacagtctccccgttaccgtcttcagggtccacgccagatttcaagataaggacacactattctgtgggagagagggacctagtctacaactgagcaaggcagtggtagctgacagcatgcttttttctggcaattcccagccaataactgagcaaggtggtggtataagacctagccatttaggccaggtgcagtggctcacagctgtaattccagcactttgggaggctaaggtgggaggattgcttgagcccagaagttcaagacgagtcatggcaacctagtgagactgtctgtccaaaaaataaaaaattagccaagcgtggtggcacacgcctgtattcctagctcctgaggtgaaaggattgcttgagctcgggaggcggaggttgcagtgagtcctgatcatgccactgcactccagcctgggtgacagagcaagatcctgtctcagaaagaaaaaaaaaagtcctagtcatttctaccaactcgaaagccctctaataagcagtctctgctctggagctttttggtgggctgctagagactttgttagatcctaccgttcctctgctcaatcctgcttttcccttttcctttcagagatgtcacttcaccagttttgtactcctaactccatctcagcctaaaattggcacaattggtaccagtggcccacgaacgtaggtggtaagacagcatttgcaggctgagtgactcactgtctg

SEQ ID NO: 17553 - DNA, 106380 bp, Human
ctgtttgtactctcagtgaaattggtgaatgaataatacaaacctggaaacctggcctacctggcctcctgcagtcttcactgtgttgattcaagtctattatgacctgttcttgttgtctttcatgagtcagagcagaggccttatcccttcccctccctgtcataaatgccttagagcttggacttggatctcagcttaatcagttttgtctccacttcccctttcttgcttcaaggttcacatgtgtgcgaggcagataattctaggggctgccatggcttggctaagcttcccttgaccactgagcatttctaagggagttgaggctggtggctcctccttccttcctactggtgcttccacctgccttggtctgagttgcagtccatggggcagcgcctaagtgtctgagcacacttaagaatctctagtggtttatgacccagactttgccctaccacctcagtcttctgaatgttctcttccctggaccctgctccagacactttaaattcagaagaggaaaatgtgcccagcctgcctggagaaaagtgtctgctcctagccaagatctcctcatcacaaagtaagaatatcaggtggtggaacccccatcatacctgtccccttcctatacctgggtctgttgggtagatgcagtcctttttagagaggcatagtattctcagacctgtcgccacaaattgctccccactcattctttccctatactttgtgtctttgaaacctctttatcttctatgtttaatatctagactatactttcttcatggaattctagatgtgtaaatttacagggctgggagggtccatatctagtttaagaccctcattgtagaaatagaaagaggcccagagaagagaagggagtgggccaaatccacaaaatccacatagctgattactcctagagcaagtggggcgagaaccttggtcacttgactcaggacagtgacttttcactcttctctctttccaccaggaatgggaatgacctttgactttaaacaaatccagactccagttttaccctgaattgttgggggaacattttgttttttttttctttttagtattttcaattcttccatgtcttagtttttagggtgttgacctgtgttaatccaggctatcttctagctatatctggtttcctcaggtggaaaatgttaaatatagttaatataaaatttcactctagaatctgctagaaatgacggaggcaaagttaatgtatatataaaaaaatccaccagtgactggtggccagtaggctttcaataattgtgaagtcccttctacccccttgaaagtactgtgtttctcccctaagcagcacattgtgtgtggtggtttcatggttaaaagtttagacagacccagcaaatctctcttctcttttacttcctaagtgtgtgaccttggacaagttaccttccctctcagagctgaattttcctcagttgtaaaatagagagaattagagtattcatctcacaggataattgtgagacttaaataagagaatgcatgtaaaatggttaacatagggcttagaatgtagaaaaaaagtcctttgttttattgccaattttatttttacttatgactaagcagccatgacctcagaataatagtcagggctgacaattgtgcttcagagcaagaaggggaagaggtggtgagatggaggctctttcaatttctacctcatttcttaaatggagctgttgaaatctacccatgagctttggctggccacactgacagtgttctcctctcagcaaagaccaattagcaagtcctgataacagaagtacaacccacccccttgtaattcctcctgagatcctaaccaggatttgtaaaacacccggatatgggtaaagaaccatcccgggttttgtatcaaaccaggccccagaggaacaggacattccagtagttttgtttctggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaaggtaagctttcttttctctcttttcaaactctacctcacctgccttcctgtgcaaaaacgtttatttagctgggtttaagggagtcctggccactaggagaaaaagtcagtggccaaaaagttggaggaggtttggctgatgtgcaggaaagttaaaggagacaataggctccttttgttcctctcgccaaaatagccaggactacactggcttgtctgtttcagggccaatcctggagccatacagaatagttcattttcctgtcgaaatagcttgctcatcttctgtttcacaggttgaggaatttattgaggtgatggatctgaggattatgtaagtgggaactcagttacttaaaaataaccatgtttggtttcatattttgagaccagattggcacagagtaagccaataaatgatagcttaactaagctaaacatctgaatttgagtagtcttagtttctacatagcaaaaatcttttagaaatcattggttcaaattctggctatttttaacaactggctgcgtgactttgagcaaatccttgcacctctctggtatcagttttttatacatcaaatgagggtgattgaaaaagatggtttctaaaggtttcatgcatgtgtgaatctataacacgttcagtttttcattactcagcatctattatatgacaagcaatccttttgctagggactcaaatatccatggttttatttgggcctcaagacaatcctgtgaaaaaaatatcatcccattttttggatgagatgactaaggctaaaataatttattgaaaggtcacatagctatcacagacaagagataggatttgaatcaaggtctttaacttcaaatcggtatgttttctatcacagagttaagaaagcagaggaccaaaaggtgaattttgatggagggtttattaggaaggctgctgagagattgaagacagggccccaaagatggctcagcattcctttattcagttgagtaatcctttgtttaggatgagcctgtctagcccaaagtagtataactgagaaagggagatggagggagagaaaagagcattgtcgcaataaaggaacagtttgcaaattctagggaacacagcaatgcaaattgttatgaataatagggaccagacccaggtgacactgggatggcaggaaggtaaggtaaaggtaagggaggcttaactttatattggctgatcttctctccaggttggcacaaggtttcagtatatcttaactaaactatccaaatagcctagaatttttctttcttttttccttcctttgagtgcctattccttctgccttcctttttattttgtattttttacttttttccaggattctttctcaacttacttatttcatttctccttttatttcttcctgttctttttcctcatcagtctggttcttctctatgggcttagctgagaaaaaaaatatccttgcccaagtgaaaagcttacacagggctttcacatctttcatattatttgacctttattacaaactaatgaggggcccaaagtagagacaatcctcatttaagacatgaggaaactgaggctcaggaagttagggacttgttcaaggttatataaccaataaatgatgaatccagagctagaacttactattttctggtgcctgaacgctttccactgtaccatgaaatatctaagtggttatattttattttatttatttattttttgagacccgtgtttcactcttgttgcccaggctggagtgcaatggtgcgatttcggctcaccacaacctccgcctcccaggttcaagcgattctcctgcctcagcctcccgagtagctgggattacaggcatgcaccaccatgcccagctaattttttgtatttttaatagagatagggtttctccatattggtcaggctggtcttgaactcccgatctcaggtgatccacccacctcggcctcccaaagtgctggcattacaggcgtgagccactgtgcctggcctaacatctaagtggttataaaggattttatgggtttttcattttttctgctcttttagtatatgataaaaccaaattaaacagcagcaataacaatgacaaattcaaatttgaggaggatagaaaggatgtcaataattagaaggaagaaaaatacttatcaggtgcctactaagtcccagctgctgcaaaaatttatcttatttagatatagagtaaaacagtacttaaacctaagtttgtctgactcaaaagttctagttctttacattataccatgttgtttccaagaagagagttcagcttgggctgtgtgcattttcatacctatgtttatattcctgtatgcttagaatgtgttaccatatatgggaatttatgagtgtgcacatatttattgctattcataaaatggaaaatctttatggccctggcaagtttcatttccaaactatttccttacttgcaatagtaatagccactaataccttttgatcacttacatgtgcccttaaagtacttacagatcttaattaagttaatccccacaaaactctatgaggtagctaatagtattaataccatttgaaaaataaagacactgtggctaaataaatgaagaagtttcccaagtcatacagctaggaaaaatggagccaagattcacttaggtagcctgataccaaagcctgtgccctggatgcaaaatcgagtaagtattccttatctctcaagatcttgagaattatataagatggcagatatgaaaaacacattgtaatctggaaactgctaggggtatgttaggtggcatttcccaccactccccagattctattgtttaagccatttggatcataagtcaccactgttgaatgcttgttcactgtatgctgatggcctgtactagtctctcccaggaatattttcagttttatcatgtgtttctccagttgtggagctcttgcctgggacagttttctgtctaggtaaatgagttcaaggcacaactgctttgttgacacctctctgagaaagaagattgaaaggggtccatgttgcattcagacttggaatgaaccgaggacactccctccctgttgaggattccaaggcatgactatttgtgtgaccatatatagagctatgtgtaggtgtatgtgagtacgcctgtgtttcatcagtgaatgtaagtattggcagcatgtgaaagctggaaggactctttgagagctcattacataccacatttttatggttctgcacttagattatcacacttctgtgactccctcaaaaggtaagaactatatagtccagctttatatagtcaattattttatagatgggaaaaatgaggtgaagaaacttgcctaagttcaccctgaacaagtattagaacttgaaccagacccaactgatggaaaaatgtatacttgtgcttctttatgtcactttaacaatagctgttattgcccatctacttggcctccatcgccatgtcgtaatagatacacagcgacctctaaaaaatgacattctctctcaaggagtgtgtagtccaatctgggaaatgaagacagttcatgaggcaggtcatgagatggaaaggtaacaataatacagagtctgacttaatctaattgggtgctatagacagtaagtagccctgcagaggacagtgatatgaagaggctaaaggtggccttctggagcagttagtattcaaattaacccttggagtaggaatatagaaagtatgatggatgtgagactgtagagatgaattaacaaactgcagccaggagggaaaaggaagaggaaggcaaccagtagttactactgcctactatgttccaaacatggattatacttgtccgtttcatgtaagctttctgatttatttctccagggctgatattattatacccattttacagatgagaaaactggttctgagtggttaagtaatccccaaggctacacagctggtcagtgggagagccaggttttggaaaaaaggaccccaaaacagatcctctcttacatcaagagctttctgccaaatataatatggaatctagggattaacacttgggtcactgctgcgtatggagaggactgagagtttgtgaagtagtctataagtttatttcttaaaaagggtaaatatctggggattttctatccatatgtgaatctgtgcatatatttgattctcaattttttattaacaatgcctatttcatatgcttgggttgaagatttagcgaaataatttatataaagcactggacatggtgctactatgtaatgatctgtcagtgaatagtagccattatcatcattatcattaatataatctattagttatatctctgcctacatgagtatgtatgtctgtttgtaaagtgattataactgcatgtaattgcttgtttcagaatgtatgtgttttttcatagatatggctgttgctataggcatatgtatgttctctgtgtatatacatgtgagtgtgcaagtatatttttgtggaaggtagtacagcatggtgattatgctggagccacacttcctgggctcaaatcccaactctaccgatttttatctagatggccttgggcaaactgctttacacctctcttctgaagtttctccattgtaatatggggataataatggtgtctacttcatagggtggttgtgaggaataaatgatttaatctgtgtaaaacatttggaacagatgtaccatgcacatacgataaatatagctttattattattattctgaagttgactaagattttatataacagagtgattttatgtgtaaatggaagtgtgtgcatctctgcttttaggtaagactacatgtacctgtgtgtgcaagtttatgtatttatgtgatgttgtctgtgtttctgtgtttgactgtaactgtgtatggtatcactgagtgcttcgtcctagtcccaggaagtctaacgtcctgtcttatgcattgaagtgagaggttagaatcttgggtctgattctgactcaggattagacctatgaaatgaatttatgaatagccttgggaatcagcagacaacatttcttctgagaagttcaaaatacttccctcacatactgtcatttatttttggttcattgttaacttttgaagtataatacacataaagtgcacaaatcgtgtttatagctcaatgtattttcacaaactgaacacgcttttacaaccagcatgtagatcacaaaacagagcattacttagaagccctcctcttcccttcccagtcacagaatcctacttcaaggcaaacattatccttacttctaccagcatagattacattggcctgattttgtactgtatttaaatgaaatcatacaatatgtactcttttgtgtctatttttttaaacattacatttgtcataatcattcatattgttgtgtgtagttgtagtttgttcattattattgctataaagaatttcattttatgaataaaatgcaatgtattcattcattatagtgttcacgaacattttgactgtttctattttgggtttatgaatattctagtaaatattttttagtaaattctcacttgttgttaagtacaatttatagaggataggaagtggcaacaacaatgagtgttccccttttgcctatgggaaaagagaggcaaagggagaattagtgttagtggcccaataaggcttctggtgcctgtttcctgattcttgggacagagcacattcttcctgctacaccattgaaaaaactggatccagatctctcttctgaaggaactagtaatacatgattagcagcacgggtgactttttaactatgcccttcaaaatccaatcattgaaaacttattgaattaaaaggaatcaggtaagttaaagaaactgggctaaatgggttttgctttctcagtcactcaacctggctcttgcctcttcagttttctggacacgtagaaagcccctttgttctctttcttctacaccagcagtttttatttgcctgtttcccagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatgtaggtttaatttcttgtggtatttgaggggaagttatgggagcactcttgaggtcaggaagtagcctcttgaggcccctttcccagggtgtggtagcagccagctcctgattgctccgagctgtacatactcagtggcagatttcctgggaagaaggctagttgagtcagaagccagcatttcatctggagtttgccgtaacatttttagagtcctaaagagaattccatatttgctgttttctaatctcatacccacaatgcttacttatttaataacaactgtttgactttaaaaaagaataatgaaatatatacagtgtttgtaagatgtatgggtgggagctatgcttctatagtttggtgaagctactgtatatttatttcagatatgtgaaaatgtgaaaaaagaaagtaagccttagaatcaaggaattaatggtaataattctcacttatgtaatactctgtgacacagaccatactagaaatttacatactttgtctcaactctcacaaaaactctagaaggtaagtatgtgtgtagttattttatagatgagaaaactgaggctcagagaggtcaagtgacttatccaagtcctataactagtaaatgaaaaagataggatttgaacctcgataatgagaatgtaaactaatactcttctcaccactctgtccctcatagatcccacaggattaacctttcctgatcttagaaaatagcaagtgctccacaaatatctgttaaagaataaatgaatgtacgaaaaactattttgtgaccatgactcatttttttctctccaaagctttggagttttccaaagttgattgtaatatctctgagttctctgagaagaattagagtatagtaggaataacaactctgtcttttttgacacaaaatattcatctagtttcagagtcagagtccttgtattaatttttttgagggaataaattcattatccttcatccctaatactttgtagtaatattccacatttattgaacttttactatttgccactgtcctaagctcttcgtgtatttgaattttttttttttagtcaccagtaaaagctgtctgagttaggaactatgattatttccattccattttacagatgggcaaattgtgttcagagaagttaagtaacttgttcaacatcccactaatttggaagtggcagagtcagcaatcaatccaagtggcttggctccaaagcttggagttataagcactatgccctaaggcctcccatatgtatcagaatgatgctaagtcaggctacattgacgaggagtcgatcacttaaggagtcagtccacagttggttgtctctttgttactgcatattgtgtcaagctatgtgaaattgccttttatgtgggtttaaagtggtcaaatatgagcaatttcatatgctgatatttgaaatttttaatagttaaatctaaaactttcatgttttgatcagtacaatgccatttcctcttgttttgtcctaaacaaagatagtcactttttggtcagtatcctctggaaaaggaacctctcaaggcttgaagatggggggcaaaattatgactctttttcttctttcccagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggtaaaccattccaccgtttctttcccccatgcccaacaaatatcacttttcctttattgccaggtgaaggagaagaactggtagtgaagattttcttttcttcctatttatctgaggtggcaaagactctcctcagagtaaacaagggtgggcactggtatcagttctgccattcatatactgtgtgacttggacgagtcattgtctctctctgggtctcagattccttctcagaaatgtgaagacacagtctacctcttaacacaaggaactatttgaatggcatctccatagaatatttgaatattctatgaaaagaaaagagaatgctataaatgtgaaggattgtcatcctagtgtcacagtcttctgaaagttccattttgtttttccctaaaggggagttcagcttatttatctctatctcccttattcctggcccagtaatttataatactgacaacagtgagtaagaggaatagaaagggaagtcagaagactctggctgggccactaaatccctgtatgatcctggacaagttacttttccttagttttctcttccatacaatggagaagtgaaccaattaatcattaagttgactgcagactgaaattctgtgattgcctgcttttttattttaagtgagtgtttgaagggagggaattctgtcttcttgcttctatgccaccagctttatgctatggcattaccagatcaggccaagctgtacttttcctagccacagaacttttccagtggctacaagctttccacccattgttaatgtgaggactggattttttaggttaaatgttacctaaatctgtgctctccttaggttgtgaggaatactatgtaggtcattagcatgctacattttataagactggacctagggttctacatgtcagctctgtcttaatttatgtatttgccacggtccctcacttattctgggcctgtgcatgtacaatttcatttctaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggtacaggtcccaaggataagctatgaggtgtagtttgggacatctaggggtagcagtgatatggttgaaccacctacatattggacagcagcctgaggagtgctaattcagcactcttgtttattagcaagaaaaatctctgctaaactcactttgcactatttttttttttgcaatttcattactttttttctttgtttgtgggttaggaacaatttttttttcaataggttattgtggtacaggtggtatttggttacatgaataagttgtttagcggtgatttgtgagattttggtgcacctatctcctgagcactatacactacaccctgtttgtagtcttttatccctcgtgcccccccagccttttccccaaatccccaaagtccattgtatcattcttattcttttgcaccctcacagtttagcttccacatgtcagtgagaacatacaatgtttagttttccattcctgagttacttcacttagaataatagtctccaatctcattcaggtcgctgcagatgccgttaattcattcctttttattgctgagtagtagtccatcgtatatatgtaccacggtttcttgattcacttgttgattgatgggtatgtgagttggttccatgattttgcaattgtgaattgtgccactataaacatgcatgtgcaagtatcttttttgtataatgacttcttttcctctgggtagatgcccaatagtgggattgctggatcaaatggtaattctacttttaattcattaagcaatctccacactgttttccttgtggctctactagtttacattcccaccaacagtgtaaaagtagctgttccctgttcaccacatccaagccaacatctactgttttttgatttttttttgattatggtcattcttgcaagagtaaggtagtagcgcattgtggttttgacttgcatttccctaatcattagtgatgttgaggattttttcatatgtttgttggccatttgtatatcttcttgtgagaattgtctattcatgttcttagcccactttttgatgggattgtttatttttttattgttgatttgtttgagttcattgtagattctggatgttagtcctttgtcagacgtatggattgtgaagattttttcccactctatgggttgtctgtttactctgttgactgttcctgttggcgtgcaaaaactctttagtttaattaagtcccaactgtttgttttgattgcatttgcctttgggttcttggtcatgaaatccttgcctaagccaatgtctacaagggtttatctaatgttttcttctagaatttttatagtttcaggttttagatttaagtccttaattcatcttcatttgatttttgtataaggtgagcgttaaggatccagtttctcttacatgtggctagccaattatctcagtaccatttgtcgaaaatggtgtcctttctacactttatgtttttgtttgatttgtcaaagatcagttggctgtaagtgtttgggtttatttctgagttctctattctgttccactggtccaagtgcctatttttataccagtaccatgctgttttggtgaaatggcattatagtatagtttgaaatcaggtagtgtgatgcctccagatttgttttttttgcttagtcttgctttggctatgcaggcgcttttttggttccatctgaattttagaattgttttttccaattctgtgaagaatgatggtggtattttgatgggaattgcattgaatttgtagattgcttttggcagtgtggttattttcacaatattgatcctacccatccatgagcaggagatgtgtttccatttgtttgtgtcatccatgatttttttctgcagtgttttgtagttctccttgtagaggtctttcacctcctcagttaggtatattcctaagtatgtatgtatgtatttattttttcagctattgtaaaaggggttgagttcttgatttgattccctgcttggtcaatggtagtgtatagaagagctactgattttgtacattaatcttatatccagaaactttactgaattcttttatcagttctagaagctttctggaggagtctttagggttttcaaggtaaactatcatattgtcagcaaacagtgacagtttgacttcctctttacatatttagaggccctttatttctttctcttgtctgattgctctggctagcatttccagtactaagttgaagaggagtggtgagagtgggcatccttgtcttattccagttctcaaagggaatgctttcaacttttccacattcagtataatgttggctgtgggtttgtcatatatggcttttattacattggagtatgtcccttgtataccaattttgctgagagttttaatcataatgtaatgttggattttgttgaatgcattttctgcatctattgtgatgatcatgtaattttttaaaaattctgttcatgtggtgcatcacacatattgacttgcatatgttaaaccatccttgcattcctttcatatgcatcaagtgagtatgaaacccacttgatcacagtggatcatctttttgttatgttgttggattccattagcttgtattttgctaaggattttaggacctatgttcatcagggatatcggtctgtagttttcctttttttctttttattattatcatactttaagttttagggtacatgtgcacaatgtacaggtttgttacatatgtatacatgtgccatgttggtgcgctgcacccattacctcatcatttagcattaggtatatctcctaatgctatccctcccccctctccccaccccacaacagtccctggtgtgtgatgttcccattcctgtgtccatgtgttctcattgttcaattcccacctatgattgagaacatgcggtgtttggtttttttgtccttgtgatagtttgctgagaatgatggtttccagcttcatccatgtccctacaaaggacatgaactcatcattttttatggctgcgtagtattccatggtgtatatgtgacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatggaagaaaatttttgcaacctactcatctgacgaagggctaatatccagaatctacaatgaactcaaacaaatttacaagaaaaaaacaaacaaccccatcaaaaagtgggcgaaggatatgaacagatggtctgtagttttcttttctggttatgttctttcctggttttggtattagggtgatgctggcttcatagaatgaattaaggagggtttcctctttctctctcttgtgaaatagtgtcaaaaggattggtaccaattcttctttgaatgtctggtaggattccatggtgaatccatctagtcctgacttttttggttggtaatttttttaactgccattttaatcttgctgcctgttactggtgtattcaaggtacctaattcttcctggtttaatctaggaggattgtatttttacaggaatttatccatctcatttaggtttctagtttatgtgcagaaaggtgttcatagtagccttgaatcttttgtatttctgtggtgtcagttgtaatatcttaacgtttcatttcttaatgaggtcatttggattttccctcttcttttcttggttaatcttgctaatgatctatcaattttatttatttttttcaaagaaccagctttttgtttcatttatcttgtagtttttttgtttcaatttcatttagtttttctcttgatattggttatttcctttcatctctagggtttgggtttggtttgttcttgtttctctagttccttgaggtgtgaccttagaatgtcagtttgcactctttcaatctttttgatgtaggcgtttagagctatgaacttcccttttagcaccacttttgctgtatcccagaggtttggtttttataggttgtgttattattgtcaatcagattgaagaattttttttttattatactttaagttctagggtacatgtgcacaacgtgcaggtttgttacatatgtatacatgtgccatgttggtgtgctgcacccattaacttgtcatttacattaggtatatctcctaatgctatccctcccacatccccccaccccatgacaggccccagtgtgtgatgttccctttcctgtgtccaagtgttctcattgttcaattcccacctatgagtgagaacatgcagtgtttggttttttgtccttgcaatagtttgctaagaatgatggtttccagcttcatctatgtccctacaaaggacatgaactcatccttttttatggctgcatagtattccatggtgtatatgtgccacattttcttaatccagtctatcactgatggacatttaggttggttccaagtctttgctattgtgaataatgccgcaataaacatgcgtgtgcatgtgtctttatagcagcatgatttataatcctttgggtatatacccagtaatgggatggctgggtcaaatggcatttctagttctagatccttgaggaatcaccacactgtcttccacaatggatgaactagtttgtagtcccaccaacagtgtaagagtgttcctatttctccacatcctctccagcacctgttgtttcctgactttttaatgattgccattctaactggtgtgggatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttatttttttcttgtaaatttgtttgaattatttgtagattctggatattatccctttgtcagatgagtagattgcaaaaattttttcccattctgtaggttgcatgttcactctggtggtagtttcttttgctgtgtagaagctctttagtttagttacatcccatttgccaattttggcttttgttaccattgcttttggtgttttagacatgaagtccttgcccatgcctatgtcctaaatggtattgcctaggttttcttctagggtttttatggttttagatctaacatttaagtctttaattcatcttgaattaatttttgtataaggtgtaaggaagggatccagtttcagctttctacatatggctagccagttttcccagcaccatttattaaacagggaatcctttcgccatttcttgtttttgtcaggtttgtcaaagatcagatggttgtagatatgtggtattatttctgagggctctgttgtttttcattggtctatatctctgttttggtaccagtaccatgctgttttggttactgtagccttgtagtgtagtttgaagtcaggtagcgtcatgcctccagctttgttctttttgcttaggattgacttggcaatgcgggctcttttttggttccttatgaactttatagtagttttttccaattctgtgaagaaagtcattggtaccttgatggagatgacattgaatctataaattaccttgggcagtattggatgaaatattctgtatgtatctgttaagcctatttgttccaaggtatagtttaaatccactgtttctttgttgactttctgtcttggtgacctgtctagtgctgtcagtggagtattgaagtctcccactattattgtgtttctcccactattattgtgtttctatctatggcatttcttaggtctattagtaattgttttataaatttgggagctccagtgttaggtgcatatatgtttaggattgtaatatttttctgttgaacaaggccttttatcataatataatggccctctttgtctcttttaactgttgttgctttcatgtctgttttgtctgatataagaatagcttctcctactcacttttggtttccttttgcacgaaatgcctatttccaccccttgactttaagtttatgtgagtccttatgtgttaggtgagtctcctgaagcaggagatggttggtgacttcttttccattctgcatttttgtattttttaagtggggcatttaggccatttacattcaatgttagtattgagatatgaggtaccatagcattcatcatgctatttgttgcctgtgtaccttgttttttttttatttttttgtttttgcttttcaaattttatttttgtttcatagatcctgtgtgattgatttatgccttcaagaggttccatttttatgtatttcctggatttgtttcaagatttagagctccttttagcagttcttgtagtggtggcttggtagtggcaaattctctcagcgtatgtttgtctgaaaatgactgcatctttccttcatatatgatgcttagttttgctggatacagaattctcggctgataattgttttgtttgtggaagctgaagatagggccccaatcccttctagcttgtagagtttctgctgagaaatatgctgtttatctgataggttttcctttataggtgacctggtgtttttgtctcacagctcttaagattctttccttctttgtcttaactttagataacctgatggcaatgtacctaggtgataatctttttgtaatgaatttcccaggtgttcttttttttttttttcacagctgtattttttttttcagtcattatttgtttgtacagctgtgtgaatttttttttttttttaattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtatttggtttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagttcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaaagtttaaatctttaatccatcttgaattgatttttgtataaggtgtaaggaagggatccagtttcagctttctacatatggctagccagttttcacagcaccatttattaaatagggaatccttttcccattgcttgtttttctcaggtttgtcaaagataagatagttgtagatatgcggcattatttctgagggctctgttctgttccattgatctatatctctgttttggtaccagtaccatgctgttttggttactgtagccttgtagtatcgtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcggagcctgttattggtctattcagagattcaacttcttcctggtttagtcttgggagagtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagaattctgtagatgtctattaggtctgcttggtgcagagctgagttcaattcctgggtgtccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttctattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttctcgaggaatatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgcagaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccccccagttcgagcttccaggctgctttgtttacctaagcaagcctgggcaatggcgggcgcccctcccccagcctcgttgccgccttgcagtttgatctcagactgctgtgctagcaatcagcgagattccgtgggcgtaggaccctctgagccagttgtgggatatagtctcgtggtgcgcggtttcttaagccggtctgaaaagcgcaatattcgggtgggagtgacccgattttccaggtgcgtccatcacccctttctttgactcagaaagggaactccctgaccccttgtgcttcccggtgaggcaatgccttgccctgcttcggctcgcgcatggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatctttgctcctcctcccccaggtgttctttgtgcttcttgtatttggatgtctaggcctctatcaaggccagggaagttttcccctattgctcctccaaatatgttttcaaaacttttagaattcccttcttccttaggaataccaattattctttaggtttggtcatttaacataatctcagacttcgtaggggctttgttcattttttcttattcttttttctttgtctttgttggattgggttaatttgaagaccttgtcttcagactctgaatttttttcttctacttgttcaattctattgatgagactttccagaggattttgcatttctataagtgtgtccagtgtttcctgaagttttgattgttttttctttatgctatgctatctatttccttgaatatttatcccttcacttcttattttttttgttgttgttgttgtttttattatttcctttcactgggcttcacctttctctggtgcctccctgattagcttaataactaacctcctgaattcgttttcaggtaaatcagggatttttttttatcttggcttggatccattgctggtgagctagtgtgatttttttggggtgttaaagaaccttgttttgtcatattacctgagttgggtttctggttccttctcatttgagtgggctctgtcagagggaaactctagggctgaaggctgttcttcagattcttttgtctcaaagggtgttcccccatctctccctccttttttatggatgtggcttcctgtgagctgagctgcagtgattgttatctctcttttgggtctagccacccagcaagtctacctggctctgggctgatactggaggttgtctgcacagagtcctgtgatgcgaactgtgtatgggtctctctgctgtgaataccagcacagtatttggggtgtctcccgggtcctgcaggagcagtccatttccttcagagggtctgtgggtcctcttgggattcctggtgtgttcatgaagggtgctggagccaaaattcatgatgcaagcctccacatgctgctctgtccatccgagtctgagctgcaattactcctgactcttgtccaccatgatgatcctacgaaccttttttaaaattattgttattaaaaacaacaaaacaccaaacttttctcctttttattttttttcttgcttcacttttaaatctcaaattagtcattataggagtcaagtcgcattgaaatcagatatgtagtaagagtttagatatggataagattgaaagtgtggtcatcagggttttggaggattttgctgataataggatatgtcagacttgaagaccagagggtggcaggaatgtggtcaggttcaggccctgggttgaagacataggcagggatggtaggagggaattattgtagatcctatgtgtcctaacatcaagtcctaggttcaactgaattggtggttttaaatggggagtttggaaatggaaattaatctaagagggttatttctgcttttctgttgcttacagattcttaagacccctctctttctattcctttcttatgagtacccctttcagcttactattgctaaggaaaggatcttctcaagggaaactgtcttacttgccctaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatggtgagttgggaaaaggtggccacattgtgacagggaacattgttggagggtatccactgggcctagtatttggtggatgctttcacatacatagtcctttttagtcatcacgagggcaaggagtagtagatggctcttccctgttttacatgtgaggacactgaggctcctaagattatgcagcagataaatggcacagctaaaattccaaccttggtctctctgactgcatagattgtgctcttgccattaggctattctgcctcataatgtggaatagcacacagtctaaagttatatagtatatggtcaattactttgctgtgggttgcccactgatacaattaatcaatattgatttgttttaaaaaggaagaagttagcagaattatccactttgtggagaaaaatggtttctttcaagctaccttgcttatatctcccatcgtactctgtgcttatgtctataaggacattgaccatattaattaaattgaaaaagaaactaaaggcacagaagaaccgaggcatgaatattgaactgattttaggaatataaacaagtcagttttgtttttgtttcattaaggaagtcatttactggccattcatgacaggggtgggctaaaaaccatacagtccccaaaggaggtggaaattcagaaggaagatgtaaaggatggcttggatagctcaactttttcttgaattttataccaattgattataaaagccatgttaattagtcagccaatttgacaattgtcctgtggaaatttttagaatgaaaccaccctgaaagaatagcctgcaaaataactaaattccttagagagcttcttcacatttctggtttggaatattggctgtaagcatttattagctctatggcattgggaaagaagtaacttcacctctctgagtcttggttttctctctctctctcttttttaatgagactaatgatatctgcctatttctcagggatgtttttgagatttaaagaagataatacataggtcaacacagtgtgctgtttataacctcatttaaatattatctattattgtcaaatggtaaggcttcttccatttggctgtcctttcctaatcctgatattttctttgggttttcttttgcagcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgaggtgagatccaacatttctgaccattgggttgtaagagagaggtatgataatggtcaagggaggctgggtttctggcctgaagccataaataagtcctccagttgaggcatcttgggataaaggatagcacactagattagaagtcaggggacccaggttttttcctgaatctgctgggaaacttgctggataactttgggcacatctctctgtgtttaatcttccccatcttgaacataagacagcctggggatggataagtagacttttaatcagctttttattatttgcttagaattctaaacaattaatacctggagacattttcaacatattgaacagggagtgaaggagagattaattaaaagagagtaacatttctgtaggagatcatggtgtattgtgggtacatagttacactctggttggaactcaatagaagtaggagtggaaggttttattttcaaagggagaaacattaatgtcattgcagagcaatgtattgaggagcatcagatgcatcagaggggaggaagagcgtatgaagcaatggaaagaatagtagataagtggttaggtttgaatggtagtcttaagtttgtgaaaaactttatatgactttagacaggtgtctttccatttctaggtcacatttgccacatccgtaaaatgggaaagttggtctaaatcgtctcttaaatcctcttcagctgtcattttctagaattatttgatttatggtaaattagaagggtgtcagaaaaatgatatgtgagtacttgaagtggattttagtaggttaggagttgtagactaataggataataaatcttgggtgttaggtttgacacaataggggacagttacatgtactccattatccagggtatgtcttagccccaaagcttcctaggtaagagagtataaatatggattgggattagagatgcagcatgatagtggaataagcatagaccttagagacagacatgcttggattcaaatcctcgttccatcacttgtttagccacctttgataaatcatttcacttctctgagcctcttaatagaagtagtgatgtatacctcataaaattgtaatgaggttttagagtaaaaatgtgattttggatcttagagaatagggggatgatataaacaagatagtagatataagaaaataaaatgaacaattaagatctgtagttgaaagatgagagtttaactctcaactccacctctgactagctgtgcaaccttgggcaagttatttaacctgtctgacctttagttttcttcatccgcaaaaggggacattaaaagtctatttcatacaatggttgtaaggattgatagagataacatatgtactccctgggactgaaattttaaaaaagatgtaaagcacctgacacagaacctacctaacataatacatgttgaagaaaataaatattttttcctctcccttcatcatacctcaagtttctaatttacaaatttcaaatctccctgggatgctgtgggatgctaataaaataatatagctgagtgacctctataagttgctaagccaatataagacagtaccatccattgccattgtgacgcaatgtagtatattccacatttgaaaacactacttagaatctacattttccttacggtcccaagtctgaagctttatcttcactgatagaagatgttctattattttgggagcttcccagtttacaaataattaacccctattttaaatttgatgctcctaccagccccatgaggtggattttcctattctctcctttggcaaaagagggaagctcagattgaggaagtgacttgcctaaggtcctacagatagtgcttaaagcttgggcttgaactcgagtttccttacttctgtctctgtgatgttgctacaatgtgagcctttatgaagaggcaggaatgagtatctagtaaatgcatcagtggtggtataagcaagtggaggtacctgaattctaccctggactctctctctcagccatgcactttaagagtgagagaaagcggcccattttggagcaggagtaaagagagtagtggagggtgggtggaggaaacactaacagaaggaggaaggtgagtcctctgggttaaaatcctattggatagaatggggtcagccataatgttcttccttcagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcaggtaagaggcagtgggatccctctctttaattctttaattggtccagctccaaacatttattatctttcttccagaaatctctcactttactcagggatccaaatcattgtctggctggggttacatgaaccaactgttagccaagttcttgtgtccccctggagagcttgctcttggggagatacaggtagcaaagctttttgtggggttattccatatccccacaaagggtccaaacagagtttgaagttggtcctactataattcctggccattttcataaaggaaagcccaggtgggaccagttcttgtatcagttgaaatagcttttattccaggtttcttcactttacccattatttacctccttgctccttcatttcttttctatagtctgaatgaggcatttgagcaggggtataaaaagcactctgagaaatgtaggaagagaggcagcctgctttttggctatcacatgcccattcttttgaaggaatttctccaagttctcctgcctcatccatgacccagatatgggcaagatagagtaggaggttagtgccctactcagttgctgggtcttaagtcataccactcactgggaaatcgatgatgacaggtcttccacagaggaggcacttgataggtaactaagagaggggttgggggaagatccttcatggttatacttctagcaggaaataatagagtaaatctggagaaaacttaggaaagttggtgtttgagtctcagcatggattctacgatttccagctgggcttattaacatagtgggctttcattttggagtgaaaggattattaatacctaaggatgattaaggacagatgtagactatgaatctctggagggcagaactggtcccagtgcctggaaattataagcaagaatattccaacttacactaaaatagaattccaataatttaaaatatccaacagtaagggagattgtctcctctggatatgagtttcctatttttggaaaggctcaagcagaagctgtatataactttctagtggtgccaccaaaggagatatcttcactggtgggagttaacttagatgagctctgaggtccttcctaaatataaagattcataacttggtgagactaagggtgagatgggagtctatttgatacctaatgaaataatatcatattttcctttttatacatcagtatctcagataagtttttccagaagagctccagccgaattgggggcacttactggaaagtgcgatatgaagcctttcaagatgagacattccaagagaagatgcatttggaggaagataggcatcttggaatcctgggtgaggaatttttaaattatgaaattcatttactagagccagagaattgaggaagactttgaaactgaggcctggacatcacttaggagcacattgtagaccagcatctcccaaagtgagtcttatgagatgattgttttgtgaaagagttatgagtctgaatgtgttttaaaaccactaagttaagcagttaaatagtgctttttatgctacaggatttctaggagccttaggtttatttttgtttatcatgaatctccactttttttcagtgaatatcttccaataccactgatgtacagtacacatttttagaattccttctctagaagtattcctaaagggctatataaggaagtaagactgtataggttctcagcaatctggggccagtagcagattggcatgacatgcagacatacttgaaataggaggaatgcagaataggcttagagtctgaacttgaagaaggtatctagaagggctaaaccaaggttagaagtggtttagtagcatgatggaaccagaaaataaaataggccagatggaaaaaaaactttggaaattaatataatggaccatactcgggataggtgtgtgccagttgattctagatctgataatggacaatagatcttacatcagctggatagggagatacaatgaggagaaatccaccataggaaggagagatggtggtgagcctgaaggaattatcattggctggacttcagtatgagtgcccagtctttgagatgaggtgaaacattagatgtggaaattgaataggaaaccaagctagaaactctgaccaagagttagagccggaataagtgcccagttttggtactttttgtctgcttcaaagatgacctaagctagattacatgtggtgggtaatgaagttcagaagagtccaggagttgtggctagattacctagtacagtgcctggatagaagatatcataattctctttgctcagaattggtttcagattgaggcaagcacagatcttagataggtccacaaagacatgtagctatgggatctgggacaataaagtaagtgaaaatgagattggggctgacaatgggatgagagaaattgctggcctctggtcctggctgaatggcttatcaaccatttaaatttgcataggtaaattccacttctctcagctgaaattttctcatctgtaaattggagttaataatttttgccctatatgccttaaaatgatgtttgagaatcaaaataagataatggatttcccagtgttttctgtaattgtaaattgcaatatacttgaaaggaattgttcttattattacaaagaaaagttttttattttcttcttcactttcactttccttttctttccctccctcttcttccatttccttcctccctgtttatccctttcatcattctcattgtctctccttcccattttccagggccagtgatccgggctgaggtgggtgacaccattcaggtggtcttctacaaccgtgcctcccagccattcagcatgcagccccatggggtcttttatgagaaagactatgaaggcactgtgtacaatgatggtgagccaacagggtttctagtaaatgtgggctctaggtggtaccatgtgtctctagaaaacaaataaatgggagatggagaggatgaagtaggcagaattatttgccatatgtggatgttgttgaatgaatgaataatataatagtaaaacagagctgggcttcaataataagagaaaatttcttttaaatatatttaaatatatcctaattttaaaaataagtttattatagaactctgaaaagcagacaattacaaagtaaataagcatcatttatagattgtcatataaattttgatatacctttaaatatttttatgtgcttatacaagtctatatatagagatatgtgatcatatggtttgtacagttttgcatcctactattctcagttaccattgtattgtgtttgtttttctatgccattaaaatgctacaaacattttaatgactataaaacactttatctcaaggatttgtcgaaatttatttactttttcctctattgcttggacatgtaggtttttttcagtatttttgaatattgtaagtcaggttgcaatgaatgaatgcatatatcctagcttgcattttggattactgtatcaggagagaatcttagaagtgagagtattgtgtaattgattttttactttatctaagaatattaatgcatgctaattctagccaaactataaaagaaaaactgaaagcataaagagcaaagttgcagacaaatctagaatgaacattctataaggcaactggtctagtctcttcaagaagtcaataccatcaataaggggattagagacataacaaatgaaatgtgcaaattttgattgattctgcttgtaaaaatagctttaggagacattttggagataattgcaaaattcttgatatagactggatattagatgttattagggaattttcttaggtggaataatggcattatagcgacataggagatgcgtgctaatatcatgatgtttgtattctacttccaagtgattcaacaaaagcaaacaaacaaaaactgtatgtatgtgtgtgtagatgtatatacacatagagtagataaataaagatggcaaaatgttagcaatagactctaggtgataggttgatcattgcactattttttaaagttttctgtatatttgaaaatttgaaaagtaagaaataatgaatgaataaggaaaggtaggttaaaaccatcctaaattatagccccttgttataagctatactagaaatatccttccatatgtttctttgaatgtttttataaacctttcttcagaatatatttttaagttggggaattgctatatcagaggctatgtacattaaaatttttggtacctacacccaaattactctctggaaagatttgcagtcctatcagtttagagttccattagcagtacctgaggaggactccttttcttacaacctcatcagcactggggaaatctttttaatcttgtcaaaatgacagtcttgtaggcaaacgacagcatcaacaaaactcactgttgttttgatttacatttgtttgattatttcatgttgaacattcagtatttattgcatatattattctacttgtgcatatgaaccttttaaagaaatagctttgtctacattttggtgtactttttttttttcaaattttgtctatattttttttcaagtgttattcccttttacatttacactctttataggtgagtgagtagggtaggtgccatctaaaccacttcttaccatcatgcattattacaatttgtaaaatctttgctaaattaatttgtaaaaaagttatctagctattttcaattgtacttctttgattactgatggcatgaaaatttgaaaaaggtctgtgcattgcttgaccatgtcttgtgtccattttagaaattacagccttagtgttttatatatatatgtatatatatacatacatacataacatatacacacccacatgtacataatacatattaaaagaaaaaaattaaataatcagagctgttcaaagatgacatggactataatggcaggtagtgagtcccccatcactggagagttttaagcagaagtagggatgtaagagcagattaatgtatgttttcaagtgagagatgttccaaataagtcttaaagtccatttttagtcccaaagtcctatgattttggaaaactgaaacatagggaagattaaattgctgcatttcatatagcaagtaatggaagaacgagaaaataaactcatctcttgactccttgaccagagttctcctcattattcaatattccatgttgctgctactgctgctccaaaatgcctttgtagttcataatctttatttcactgtttggagctgatgattctcattctagtcaatctaagtaatgagtcccatattttcactacaggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcaggtattgtcagggttatctggctggaaagcctgctgggagaaggatgaagctgggttgctggataggagttaagcatggaactgggttctaaagtttagggaatagaagaaaaataatcaagctggtccatcagaaattaatagttggtgacctcatactatcttgcatgttattttttgtactgacaaatatatatcttccttagccttgcagataattcatgatatcctttcatcatcttcttctttcctccctccttccctccctccctctctctccctttccctctccccctctccctttccctctccctcacctcggtggcccctaaaccttgctcctgatccataaatctgctttaatatttgcttgtcttcttttgtattcagcccacaatttctagctgtgtaacattgggtgagctacttaacttctctttgactccgtttcctcatttgtaaaaatgggataacgatggaagaagacaccttggatttctgtgaagattaattaaaataacccatataaagtgcctagcacagtgtctggcacatattaagcactcagtaaatgttagtggtaacaataattatcactgatattacttatcttttattttctagtttccccccaagaccctcccctgcttttctagccacctcccctcattcctctccccaggtgattaccatctctcttcttttacactctatacctcttatttcttatcctatgctccttccctgcccactttcatacagtcttccctgtcaggcttgtacttttattgtgacattcttctctcatctgcaatttgaggttacctaaggaaaaactgctgcagctctggataggaggtatggtctcaaaatgggaaaaggaaatgggaaagaatctggcatcccttgatctgtaacgacacagtctacaactgctgaaactattgtcattattccctctactttcttctattgggcctgcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatggtatggggagtacttttgccctgggctaaattgagggtcccaagtaaaatctaactttaaccgtaatcatgaccaatcctgaaaacactgattttattggtcatctctgtccaagaggcgagctagattgagaggctcaaccgaacacaacagatcttatacttagtacctttgggtgctgtgtcctgtgttacacagtatgggggaaactggaagaaagtactgcaaaatgagggtgtgcacaagaaatctacaagagattgtgaagaataagccagatgatacctttccaatcttatctcccctcttccttatattttagtaccttgggtcccccccccccatactccagccaactggggctatttttctttgtgaacatgctgatttcatgcttttgcagtgctgttcccttcacttgaaatgctccatctcttgattcccattactagttagtttcatcatttggaaaaagtaaaaccatctcatgagcaaagttcattccagttagaatttactgagcgcctaattggtactaggtaatgtgctaggtgctcaggcagtcacatagatatagaaaaaaaatgatatgcttcctgttatgtcaatccagtgcaggaaatagatttgtaagtaaatcaccagaaagtatatcagttacaatccatggcaactgatactgcagaattttgtgggataaaattttcatggatcgaagagagagtaaagtatagctgaacgaagatacgacaggtaagtggtaggatgccatagaaagagaccataagggaagtttattccagaaagaggaaatcatgtgaaaagtcaacaggtattatcaaagcacctacaatatttaaagctttggtaatgcagagaaaaatagagctcacaggacaatggtgtgtgtgtgtgtgtgtatggaagaggatgggaggacagactgcaggtaggggtaccagagaggaggctattttagttcaggccagggaggatgagggccagaaccagggcagtagcagtgaagatgaagaggaggaaacaggttgagagctgaagatggaattttcagatccccaacacgtatgggggcgtggaaaatgagatctatatggaaaaggaacaatcagagtggttgtaaaaggaccagaaagtatgttgccacagaaaccaaggaaggagagtttcaagaaatagggaataggagagattggtgtgtgtgtgtgtgtgtgtgtgtgtgtgtgtttggtagtggagaatagttcaatgttgtcaggatgtggatcatggtggaggtgaggccagaaaggacagttgagcactcatcccaaagacagagatattcacgagtagagttaaagtggcatagagaggaaggcagaggtgttgaggatgactcagcagtttcaagttgtgtgaaaccatagtacatagctgatgccatgctcctggccagtgctggagtagtctggtctcatctccccaccttgtcttgtgtttttgttttccagccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttggtaagtgccttagcggctggccctagaggctttgttgggtatagggccaggaatggggtcgggaagagggagggatggtgaagagaaaataataggcatgttaagggttctaggaagtttttaaaaacacttgtctttttcttcttcaatgtgctctccatgttctggttacttggattccctactcagctgcaggcagaatagttagtagaaggtggaggaagctcttttctggaacaacagaagggaagttgggatgttgctcagctttagtgaagttcttatatggcagggagtggacttgacaacacagagattttataggtacagtacttttattgggaggaaggtcaataaaatgcacttataagtgctatcaaattgatattctgtgaggctttctacagactcatttctgatctctccctctctctttctctttctacccatgatgcgccccaccctctgccccctgccaccccgtgtgtgtgtttgtgtgtgtgtgtggtgatgtaacaatttcagcctggaaatcagaacacaggagccctagttcaggctctttcattaacttgctgcgtaactttggtctaattacttcccttctctctagctagatttcctgccttgattctttcctttctgccttccttccttctgtccttttgtcctccctccatctctccttccctctatatcctttttcttccttttatgaagatatttgactataatgtttcttcagattctatgtatttctagaatttcataatagagcagttatcttttctttagtccctatggtgtatttttttttccagccattagatggcaatagtgtttgtaagaacaacctgtcagctccacgcagttcctattaaacttttgttttactcctgtaaatttcattcatatctggggggaaaaacatccttgaacaagtgtcttcaacgctttaataatattaacctagtcctgagtttgacaaacacttgacataaagctggtctcctcagaaatagaaaggacaatttggaggctattgcagttttctctgtgagagaagcttgtggcttggactcgggaagtggcagtttaaacgaaaaaataattttgaaggaattgctgataggatttactgatgcaatagataacggtggtaagggaaatagaagaagtagatgtggaaagaaatgagtagaccctttctttcaacgtgtttataaactagtagaagggatcattttaaaagagaggggcacttagccctttaacatgtggtttagatataaagtgcattagaggtggagaagtgaagaatgtagaactctatttgggccaaaatagtcagggagggctttctggaaaagaaacatgaattgagtcttggataatgagtggactctcatagatacttgggggtggggtgggcaggtaagttccagaaagaggataacaaaatgaatgaagatttcaaggtaggaatgaatgagatgtgtgagagaaacagtcagagttccatgtagttggagtgctagttgagtttgagacaatgtgtgggaggtggaactggattggtagtttggtgccaactcatagaaggctttgaaagccaggaagaagagtttgtagtgatgggataagcactgagcagcaaagtaaggaaacaatgagagtaatgttctaagaaatttagcttcttttgatcgacattgagtttgagtatccttgagttagaaatttggagcttaagatctggtccaggcaacttcacaacacagacatttaagactgttacctgcacattccattgtaaaaaatgagtgaaggaccttctaaagctgtcttaggtaagcatccctctgcaatcaagacattctctttctttttacctaactattgaagtctactttatttctttggtacttgataggagacaactcatcaatgtttttcttggaataagaattattacagctatatttacttatttatagcatcacttaactgaacattgaatatgttctatactaagcactgttcacaaattattgtgtttaattgtaaaacaaccaaataaagtaaaataatcctcattttactgatgagggaactgaaaaacacagaggtttagcaattgccacaaggttttatgtgtgcatatatatatatatatatatatatatatacacacacacacacacataatatatttttatatatgtatatatatatgatttatatataataaatgaaagatagggttaccaaccatggcagtttgcctagtactgaggggtttctaggaatatgggacttacagtgctaaaactagaaacaccctggaagaagttggttattctagcggcagagtttagttttaataaacccagtgtatgtagctttggagccggagctcttaacctttgagcccattactctcaataaactttaaatactcttttatctatgtgtagttaaggcaagagccttatctgagactatctgaaactaactcttttctgcagtatgcctagggaaaggcaggaaatcccccaggcactacccagggatgttctgagtcagatttttctctctgatcctccctcagggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacaggtaaggcttcataaatggagagattacacttttagaaaaacattttgcaaatgagaatactgaaattctgagatgaggagactcttatctcaggtctcctaatgtgataccaacagatttgggagatggggctataatgcagctcttatgaattctagctcactgctgcttccatattgatatagggagggaataaagcttgcccacaccttcaccctcttaatctttgtctctcttctttcagttagctggaagtatttaccctgggacttaaattttacaggatttactcaagggattgaatgtctcaagctcagctgtcccttgacaaaatggcattgcatttattaaggtacagactaagctatgtagcagaaaatgtctaaaacagagtgatttaaatatgatagaattttatttcttattcacataataatacaaatatgagcaattcagggctggcaggtgaaccctatcatcctcagcacttgctttcctttctggggccaagatgtctgttccagttgtagctattcccggctatcatgaagaaagaaagaaagaagtccagggcaagcagcattgtctataaggacacagcatggaaattgtatatatcactttttcttatactctgttgttctgaactaattcttatggccataattggctgcaaaaagagtctaaaagatgtaatctctaattagtcagccatgtgctcagctaaaagttaggtgattctattactaaaaaagaaggagagaacggaaatggagatacaaattagcagtctccactactttgtttttggtgctgtcactacactttagcaatttttactctttgcgttgttcgttgaaggttgaagtcttcctgctaaacatctaaaaattttactttatttttaattcttgatttttgatgttcagatagacatacaattatgaaaacaaaaatccatggaatgtatgctaagttttctgtaaacagaagcagataactgggctggacatttttttgaagattccatctatcacctctgtctatatacatgctaaaaggaaaatatgttactaattgatactgactttgaaaacactaatttaagccacaattgaattatcagcaactactgagaataaaatttgactttatgtagaaatcagttatttatttagttcctctcacttgtttctgatcagaacccagtgagatacttctaacaagatcttataatttaaaaaaaagaaaaaggaaaagagatatttacatcagttttttaaaaatataatattagttgctagcattcaggtagggcccaagtgagaatggtttttttaataatttggacttttattatagattcaggcagtacatgtgcaggtttcttacatgggtatattgtgcaatgctacattttagaatataaatgatcctgtcatccaggtagtgagcatagtatccaatagttagtttttcaaccgttttccgcatccctcctccccctttagtaatccccagtgtctcttgttaaatctttcttttaattaatttcaacttttattttaggtatgggggtacatgtgcaggtttgttacatgggcatgttatgtgatgctgaggtttggggtacagatcccatcacataggtagtaagcatagtacccaatagtttttcaacccttgccctccaccccaatttctattgttgccatctttatgtccatatgtacccaatgcatagctaccacttataagtgagaacttttttgttttctgttcctgcattcatttgctgagaaattaatggcctccaggtacatccatgttgctgaaaaggacataatttcattctttttcaagtctgcatagaattccattgtttgtacataccacattttctttatccagtccaccactgatgggcacctaggttgattctatgtctttgctattgtgaatagtgctgtgatgaacatatgaatgcatgtgtctttttgatagaatgatctatttttcatgctttttttttttttgagatagagtctcagtctgtcacccaggctggagtgcagtggtgtgatcttggctcactgcaaccaccacctcccaggttcaagcaattctcctgcctcagcctcccaagtagctgggactacaggtgcacgctgccacacccatatattgcccatttttaatggggtgatttgttttttgcttgctgaattgtttcagtttttggaaattttaaaaagtgacttcccgtctctgaacctgggtatactcatcttgaaaatgatgcagtataagatgaaagaacaggactagaaaacgagggagggaaggagcagcagacttgaatctaaatcctggctcactttctggctaacaatgtcacttgtagaataagtcctgtcatctctgtgcaattgattgcacctctggcacctacctaccccataggcctattagaaatatcaaatgataaatctgtttgtaaactagacagaatcctataaggagaaaatctgtaagatttcattccctccctatgtctcaccatcctttgccctctggttgcagcagtagttaatactttcctgccaccttgtatcttgccttttgtaaaactaatttcatcaagacatcattagggctggagctaaagcctgtggcttctgattcttagcccagtgctcttatagtatgaattatataccaaatttgtatttggatgatggcaaacaaggaaacctgccatctttttttttttttttttttttttttttttttttttttttttttgacaaagcctcactctgttgcccaggctggagtgcagtggcatgatcttggctcacagcaacctctgcctcccaggttcaagtgattcttgtgcctcagccacccaagtagctgggattacgggcacaagccactacacccagctgattttttttttaatttttagtagagatagggttttgccatgttgggcaggctggtctcaaactcctgagcttaagcaatctaccggccttagcatcccaaagtgctgagattacaggtgtgagccactgtgtatggcatacctgccaactttaattgtggttatgcagccaatgtggtgagaagtctgacattagaagaaataggggccaggtgtggtggctcatgcctgtaatcccagcactttgggaggccaaggtgggtgaatcatctgaggtcaggagttcaaaaccagcctgaccaacatggagaaaccctgtctctactaaaaaatacaaaaagtagccgggcgtggtggcgcatgcctgtaatcccagctactctggaggctgaggcaggataatcgcttgaactcggaaggcggaggttgtggtgagccgagatcatgccattgcactccagcctgggcaacaagagcgaaactccgtctaaaataataataataataaataaatttaaaaaaaagaaaaaaaaagaaataggtccccccccttttttttttctgtctgtgacatgaagctggttctgacttagcttccccataaatactcaaatgaaaatgaggggttgatggccaggtgctgatagtactctttggattcctctagttatggttacattttcctgagcaacaaggatgggctcctgggttccagatacaagaaagctgtattcagggaatacactgatggtacattcaggatccctcggccaaggactggaccagaagaacacttgggaatcttgggtaagggaattctacttccctcctagtgtttagcagcctgaactccacctagggaagctatgttataccaggatggcctcactattccccattctcaatgttttcatatgatatactggaattatggaatattttatgaaacaaccatgacaataaacagtgaagggggaggaaggaaatcatgaattcatgaaccagattttactgggttttctatagcttcaaggtatgagtctctgaggatggtaagttgtaataaatgctaggggcagaataacttaggaacatcaaaatgtgaaaaaactatatatatacacaaggaatcagttttttcattgtaccgctgtttaattattgctttaggtggtttcccccttattctagttatggtacagaagggacccactgactcctaaagagatcctctcaattctttattgtctgccaaacttatcactctttatcgtcaatgattccacagcaccttgattctttagacccttgggctgttatagatagagggtaggggtgggaaaagtggaggtaattggaagtataatcttgtcattgaagtaccttcatcctgtgggtagtagtaacagtttaaggacttctgaatcttaaaatggagccagccatgccttctaggtcttagaaggatgttttgtcagggtaaaccactaattctatgaagtgctcatatatgtccctttctttaatgctccctgtgctcctgcattaatgaaactttatttatttaattatttttgtttacattaggtccacttatcaaaggtgaagttggtgatatcctgactgtggtattcaagaataatgccagccgcccctactctgtgcatgctcatggagtgctagaatctactactgtctggccactggctgctgagcctggtgagtggggacacttagtgaaagaacaaaggacatgcatcacgtctgcttcaggcttctggatttttccttaaaaaattaatgtacttcagactggagtgatagctcattcctgtaatcccagcagtttgagaggctgaggcgggtggatcacttgaggttaggagttcaagactagcctggccaacatggtgaaccctcatctctaccaaaaatacaaaaattagctgggtgcagtggtgtgcacctgtagtctcagctactcgggaggtttaggcaggagaatctcttgaacccaggaggtggaggctgcagtgagccaacatcatgccactgcactccagcctgggtgacaagtaagactccatctcaaatatatacatacatatatatatatatatatatatatatatatatatatatatatatatgagcttagatacctgaaataggaatatagccaaaactaagccacagcctgagtttttctctatcaaatactcattttctcaatccccgaataggctatggcttagacttggctaatattcctgtttcagatctctatatacccttggatacagtatgagctcctaatcttgactagagagtgatgtgacctaggccacaagctgatcattcagcccttagcccagtaaataaagttcttgtacccttcttgcagactgaattctaaccccagtcacatactaagctcctaatactaaatatagaataatcataatcttgtcaacattctcttttattaattcattcattgaataaacacttactggaggcctactgggtgacaagaacaactttagaatctatcgatgcagtagtgaacacttgctcctgtcttgaagaaacttgagctgttatgatagaaacaggtaaaactggtaactataatccagtgtgttaagtgttaataggagtttttacagtgtgataggcatgtgaagaaaagggtatttaatctaatgtttgaatagtcaggaatggttttccagattaggtgatatctcagctgagacctaaatcagtagttttcaaaccttagcatgtatcaggatcacctagaggcttgctaaaacacagatcgctggaatcaactttgaaagtctctgattcagtaggtgtgtgatggagctcaggaatttgctcattcaaataagttctcatgctgctagttcagaaactacactttggaaacaggtgacctaaaggatgaaaaaagggacatatgggtgaaggtaaagtacagtatggaagaaaagcagggaaaaggaagttccagatttaaagaatgcagtgtgcaaaggcaaagagattgaagttggtgtaaaggaaaaagaatagattctaaaaagatcaatgaggtaaaataagcaagatatggtgattaattggattttgaaggtgagaaagataagtattattgaatgatatcggtgtttttggagaaagattcttaaataatacccagtttttgatttggacaaccaggaaaatagtgatgccattcatcaagatagggaacataagagaaaggtgacttgagatggagtgggaggattggagtattggatgatgatgagttcccttttgaatttgttggatttggtatatttgtaagttgatcaaatataggtatctagacataaagatagacttacagatctggagcccaggaggaaagtatgctctgaaggaatagatgtgggaagcatcaacatctagatagtggttaaaagcataagagtgaacacagttaccccagaagagtatattgaatgagaaagtaaaaatactcagatgagaccccgaggaaggccaatttttaagggaggtaccgattgaaatgtgagcctgagaaaaagttagcaaaataggaggaaaatcaaaatgagattacagatgttaagaaaggtcatgtcaaggatgaagtagtcaacagcttcagctgctccaaagagttcaaataaaataagagcagaaaattttccattgcttatagcaatagggaaatggctgatgattttgataaattggggaaagaagctatattagaatgtattagagagtaatcgggagataagagattgaaaacagtgagtatggcttaattttaagacttaggcagaacaattttaggtaatgagaaggtcagggttgtgcccaaaggctaaagtaaagtggaggcaaaggacactacagttgaggagatctagggactaataggctagagtgttggataaatcatccacatgcaccttgaagtcactcagaaaaatggtggggattgggatggaaaagaggatggtgatccaggtactaaaataatcaataaatgaccattaagagagaagggatacattggaagttgggaaaccagttagaaggttgtagtgatctacaagtgatgataatggcttaaacaaaggtaatagaaaatgagaatggagacaactagataaatttgagagatgttaaggcagaataaataggatattttgattgaatgggtgttgagaagattagggagatggtggaatcaaggttcataaccaagtttttggattaagcacctggatgttggtaccactcacaaagaaaataaatgcaggaagcagggggcagttttttgtttgtttgtttgtttagagtggggagatgttgactttatttttgaaaatcttaatatgagatgccataaaacatcgaggtggaaatgagagagctgtacggatagaagattatcatcagtttgagatatggatctgtaacttggaagagacacctgggatagcataggaatttaacagtcataagtaattacaatggatgatagttgaaatcatgatatgcatgtaatcacccagtgagatagtgtgtaaagtgacaatggcatcagctgagaatgaaactttggaacatactattatttaagaggaggtactctatcttaaataatgtataggtttaaagtagttctaacttaaattacagttcgatattttattttatttgtacaaatgtaaggagtatatgagaaattttgttacatgtatattatgtatagtgatcaagtcagaatatgtacagtgtccatcatccaagtataatatatttttgttaagtatagtaatcttaatctgctatcaaacattgaattcattccattttactgcatatttgtaccctttaaatcagttttcttcatctttccctttctttcacactcaccacccttcccagtctctgttatctacctttccactcttcacttccatatgatcaaattttttagctcctgcatataagtgagaaaatgcaatgtttgtctttttgtgtctggtttattttacttaagataatgacctccatttccatccatgttgctgcagattatatgatttcattcttttttatggctgaatagtattccattgtgtatatataccacattttctttatccattcatcccttgatgaacacaggttgatttcatatctttattattgtgaatagtgctacaagaaatatataagtgcaggtattccattgatatattgttttcttttcatttgggtaaatacctagtagtgacattgctggattgaatagtaattttttagtttttttagaaattttcataccatgttttatagtggctccactagtttacatttccaccaatagtgtgtaagagttcccttttctctgaatccttgccagcatctgtcattattatttttttttctttttagtaatagccattctgactagggtaatatgatctgtcattgtggttttaatgtgcatttccctgataattagtaatgttgagcattttttcatatacctgttggccatttgtatgtcttattttgagaaatgtctattcatgtcctttacccactttttaatgtgttttttttttttttcctcttaacttgcttgagtttcttggtattctagtattagtctcctgtcaaatgaatactttgtaatttttttttcccattcagcaggttgtcttttcactctgttgattatttcctttgctgtgcaatagctatttagttaaatatagtcccgtgtgcctatttttggttttattaactgtatttttgaggtcataaattctttgcctcaaccaatgttcaggagagtttccctccagttttcttctagtatttttatagcttcacatatccatcgtgagataattttgtatatggtgagagatataggtccagttttattcttctgcatgtggctgtgcagttttctcagcactatttattaaagaggatgttctttctccaatgtaagtttttgtcagttttgtcaaagatcagttgttgactgtaaatatgtggcaatatttttggattttctattctgtttcattggtctatttgtctatttttataccatgctgttttgattaccatagccttttaatatattttgaagtcaggtaatgtaatgcctccagtggtttatttatttatttatttgtttatggctcaggactgctttggctatttgggctcttttttggtgtcatataaattttcaaatttttaaaaagttttgtgaagaatgacattgatattttgagaggaattgcattgattctgcagattgctttggacaatatggtcattttaatgatattaattcttttgattttttttatttgtttttatcctcttcaatttctttcatcagtgtttgtagttttttttaaattaatttatttattttatttatttattttaattattatactttaagttttagggtacatgtgcacaaaatgcaggttagttacatatgtatacatgtgacatgctggtgcgctgtacccactaactcatcatctagcattaggtctatctcccaatgctatccctccccccttcccccaccccacaacagtccccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggacatgtttattgtggcactattcacaatagcaaagacttggaaccaacccaaatgtccaacaatgatagactggattaagaaaatgtggcacatatacaccatggaatactatgcagccataaaaaatgatgagtgtttgtagtttctattgtaaagctctttcacctctttggttaaaatttttactatgtatttttattattcctaggtattttattattttgtataactacaactggatatatttttgtattgcaatgaaattcttgtatgcaaagttcatttggaaaaataaagaatacctgggcaagaagagccaaaacattaaaaaaaaatactggtgaaatcacactagtgtaacccaatagtatagcatattataaagatgaagttacaataattaaagtgacatgatactgtaaataaaaatcagtaggacaaaacaaacattcctgaagcagacccaagcttctgcctttgtcaatagcaatgggaatacagataatactagtctattactaactgcacaaatctgccttctagaactccatcagcttcagacaagaaagatgttaatttgattagtcagaacctaaaatgtttgctggaaatgtcttaccagtgggcaggattacagtttcttttatctcagcactccctattgcactacccccttccatgtggtaagttgacctatgcctgcaactgggtaaactggatatgtgaattagtacagggtctgtgctgtagatctagctatcttaatttaatgaaatttgagagtcatcagcatgtagatgatatttaaagtgataatatggatgagatcactcaaggagtgagttatacagtaaatagtgaccaaggtggctggattaattcaggtaagagatgatggcagcttggaccagcctgataaagtagaaagggtgagaagttttctaattctggatatattttgttggttaagacaattagcttgtgaattggggtttctagatattcttttttattttcggtagttgctatattttagtcattaatcccttctaggttttaaacatggcagatatcttttcccgatttgtcatctacttgttaactttgtttgtgatatcatttgttgaacagaaatccttgatgtgatgtgatcaaatcaatggaattttggcctcatagtttgtgcttttgaaattttgtttatcaagtccttcccaacccttggtcacaaagacgttctgctgcattatcttctgttaactttataagtttcttttttcacattcaaatctgtaatcagaccagagtttgcatttttatatgctattagctatagatccatttttaatttttctttatatagaaagaaaattttcttaataacatcttctaaaccattcaactttcccccctttgagttgctttgccaccattatttcatgtttagtttctgtaaatatattaatcagtctccaatctattctgttatatttgtcaattcagttcttgcaataatatcatattatttttattattatgggtttgaaatttgtcttactatttgaagaacaaacctcttttattgaggatttacttaggtgtatgttatttttccatatagattttagagtaagtttcaagtttctcaaatacagctaaaattttgattgacattgcattaaatttatagattaatttggagagaatttacatctttatattatttgttggaatggatttccatttattcagatggtcttctatgactttatagttttgtaaaaatgttgtcataaaggttgtacatatgcttggttaagctaatccattaatgcttcttagtttttcttactacttttaaattatatttctaatagattatttataatgtagagaaatgctattcatttgtgtaagttgaacctgtatctagtagtcttcttgaactcccttattagttttactagtttgttgattccagaaatattgagagttttattcttctatctcttattcctttccatttccatatatgtttgccaggatcaccaatactagtgatggtagtggtcatcttcaactttctcccaatctcaagagagtgcatgtaaagtttctctctctttgctatgattcctttttggaaatttatttaaatttccaaatgaacaaacatttatttaaaattttaatcaagataactgacctaaaaccttcagtagaagaataattttaaaaccatcttcggggtggaggagaaaatggtggataggaagactaacttgcagctcccactgggatggacagagcagcatgtgaagatccatatcatgaatctttgctccaggaactacagcagaaacataccactgagagaatccacagaccctttgatggaggtgcattgccgctgcaagctccatgggacagccaagggactgtgagttgtcttgctttctcagttgggaggcttgtagcctggggaaagttctcagccctgctcaccaactacctggaaataaactcagtgctgttggggaggcatggtgcaattgagaccagcctttcggctgtgggctgtcatctttctttcacttccctggtgacctgtgtgatgcagcagaggcagccataatccccctaggaacataactccactggcctgggaaccacacttgcatcccccaaagcagccacagcaagccctgcccaaggagagtctgagttcaggcacacctaattctgcactcctggtagccaaagacaacgaacacaatctcttagaggctctatgaccctgcgtacaacctgacaaaactgaacacttatccaaaggcgaccctatgagaagcatgtatcctccctacacacctgcagctgatgtgttcttgaaagcaccacctcctgattggaggccaaacaacacaaaaccaatgcacttaataaaaatacaaccgaggactcttacatagtccacttcactcccctgctacctccactggagcaggtgctgatatccatggctgagagacatgaagacggattatatctcaagattctttgcagacactccccattgccagtctggagcccagtagctctgctgggtggctggatccagaagagaaataacaatcactgcagtttctccctagggaaaggggagagcaccacatccagggagcaccctgtgggacaaaataatttgaacagcagcctctgagtcccagatcttccctctaacatagtctacccaaataagaaggaattggaacaccaattctggtaatatgacaaaacaaattatttaacaatccccaaagatcaaactaccttacagcaatggatccaaatcaagataaaaatctctgaatggccagaagaaaaaatcagaaggtagactattaagctaatcaaggaggcaccagagaaaggtgaataacaacttaaagaaattaaaaatatgatacaggatataaatgaaaaaatatccagtgaaatagacagcataagtaaatagttatggtatgacaaaatgcactgaaaagtcacagcagtagaattgaagaagtagaatagcttcagaattcaaagacaaggcttttaaattaactcaatccaacaaagaccaagaaaaaataattttaaagaaaagcctccaagaagtttgggattatgttaaatgaccaaacctaagaataattggtgttcgggaggaagaagagaaatctaaaagtttggaaaacatatttgagggaataatagaggaacatttccctggccttgctagagatctagacaccccaaaacaggaagctcaaagaacacttgggaaattcctctcaaacagatcgttgcctaggtacatagctgtcaggttatctaaagtcaaaactaaggaaagaattataaaaagttgggaggcaaaagcaccaggtaacatataaaggaaaacctatcagattaacagaagatttctcagcagaaaccctacaaagtagaagggttttgggtcctatcatcagcctcctcaaactaaacaattatcagccaagaattttttaaccagcaaaactaagcttcgtaaatgaaggaaagatactgtgtttttcagacaaagaaatgctgaaaagaatttgccactaccaagtcagcactacaagaactgctaaaaggaactctaaaacttgaaaccaatcctcaaactacaccaaaatagaacctccttaaagcataaacctcacaggacctataaaacagcaacaatgaaaaaaagccaaggtattcaggcaacaaacagcacaatgaatagaacaataccttacatctcactactaacatttaatgtaaatggcctaaatgctccatttaaaagatacagaatagcagaatagatacgaattcaccaactaagtatctactgtcttcaagggactcacctgatacataaggactcacataaacttaaggtaaaaggggggaaaaagatattccatgcaaagggacaccaaaagtgagcaggagtagctattcttatatcagacaaaacaaactttaaagcaacagcagttaaaaaaggcaaagaggaacagacattatataataataaaaggactaatgcaacaggaaaatataacaatcttaaatatatatgcacctaacactggagcccccaaatttataaaacaagacctaaaaaatgaggcagacagcaacagaataatagtgggggactttaatattccactgacagcactagataggtcatcaagacagaaagtcaacaaaggaacaatggacttaaactatacctagaacaattggacttaacagatatttacagaacattttaccaacaactgcagaatatgcattctattcatcagcacatagaatgttctccaagatagactatatgatagacaaagtccaagatagacaaaacaagtctcaacaaatttaagaaaactgaaattatataaaatactctctctgaccacagtggaataaaatgggaattcaactccaaaaggaaccctcagaaccactcaaatacctagatattaaataacctgctcttgaatgatcattggatcaacaatgacatcaagatagaaatttaaaaaaccttttgacatgagcaataatagtgacacaacctatcgaaacctctgggatacaatagtggtgcaaatgtagcaggacaagctacagacaaaaccctttagacactgagttaaagaagtaagggctttattcgactgagagcttcagcaagactcatgtttccaacaaccgagctccctgagtgagcaattcctgtcccttttaagggctcacaactttaagggggtccacatgagagggtcgtgatcgattgagcaagcagggggtacgtgactgggggctgcatgcaccggtaattagaatggaacagaacaggacagggatttttacagtgcttttctatacaatgtctgtaatctatagataacataactgattaggtcaggggtcaatctttaactaccaggcctagggtgtggcaccgggctgtctgtttgtggatttcatttctgccttttagtttttacttcctctttctttggaggcagaagttgggcataagacaatatgaggggtggtctcctcccttattcccccactttgagaatctcactcaatagtgggagttctcactttcattctcactacctatgtcttcttgcaagacagatcgatagtgattcatatagtacacttgtgccgaagtattttggtgaactaaggtagcaatgaagctttttatcatttgaagaagtacaggtagcaaggaagcagtaagcaggtttctattactattataactcctattataagagttttaaatctttttagcactgggaaccactttccaaacatggccccaggatcgaatccatgccacacttgcacgggcacatgtgccagttttgtcatatttctaactatgtcttcaactacttgcctttgatcgtctatgtgtagacagcaattagtaaggttaaattttctacagacccctccttcagttgctagcaagtagtcgagagccaatctattttgatagatagcatttctcatctgagtttcttgccaggcaagaatagtcaaggctctgctggtcttattagtgattatttctaagacagcttgtaaccatatgattcagttgagcatgtaaatgggggtcgggtatccccacgagctgtcttgtgccaaagtaccaggaccatagtattgtatgattctctcagggggccatgtatcatcttttaaattttctatagctatgcttctctttttgtgggaagcacagacagggaagcccaggagttcacctgtctttgtaggcagtaggaagaaagatggtttaatagtgccaataacacaactacctgcccactggtcgggtattttggtgtaagctctatgcccacaaatccagtataatccagtgggggctgtccagtcccggtgggactctgggtgggttcacagagtttgcaactttgggaatttactaaatggatttttcttagtgtggtttgaactccactaggtggctgtttttgtagtattactatacagtttttgcccgaggcagctgagtcttcccacaggaaaggtgaagtcctttccgactcttgctatacagtattgtctaatgattgaggcttttaggacccaaaagttatcagggtgattcttttgagccaggaattcatcaggaactgggtctgtaggtactaattattgggcttcctatggccattgatctcccattacagttcctctacatacataacaggaagtgacattgagagactgggctacatgctcagctaattgcaaaaacaaatttcttgtttttcctggaatttctggtactggcacattcagtttatcatagaaggtttgaaatactggctcaggagcacgtttataaacttctcctcaaaccacgatatttactcaaggatccagtccaaccccatcgattcctaggtctacacactccccttttttccagcaaggatcaagggggttggttattactagctttaaggggttacactgaccactggtacaggaagggccacttttccttttctgaaggtggacagcatcctttttattttttatccaagtagcctaaatgacacaagaccagcatccacattcatttccacacagtcctaactcatgacaaatgtacttattttctgccatatagcctctttcctaattaaaagaaccacatcttattcctaacattactattaataacagcacaggcatcaaacttcaaggtgacttgtttgggcacccctttttcttttgttttggctaacacattactcatatcatttatgagcccccaccagtcctcagaccttaatcttacttcaaaaactgtggtcatgggaggctcagatggatcataacacacatcaggttggtcatttcctgggctacataccttgcataggatagcatgatacaaacaagttttttttagattcccggtacacttataataatcataaaataataggactgtagcacatttttgtcctacctcagtaacttgatgtatacactgggaacagtcctcattctgaggaaggtcagttaataagtccttactgtacaagtctgaattttaaggaaaatgagtccccgcaatgagttttctcatgcttcggctgtgcgtggaccagtcagcttccgggtgtgactggaacagggcttgtcgtcttcttcagagtcactttgcaggggttggcacagctgctcctgtccgcgtaccactcacagtctactgatgttcaaggatggtttcagaggttgggcctcctagcataaactgagtccaacacctctacacagttatgcttgaccgggctctctgatactgggagcaaggtggcgggatttagggtgttgcaaacttcaatggttatgtggagattttcacatagcaagctttggtacttggttaatctagcatttgttaaccaataatgtcctttggttgtcattaaagttaccacagcatggggggcctttatattcagattttgcccaagggttattttgtctgcttcttgtgctaacagggccattgctgccagggcccttagacatgggggccagactttggaaaccctgcctagttgttttgaaagctaggccactggccttggccagggccccacagtctgggttaaaagtccaactgccatttttttctctttctgatacatagggtgtaaagggttttgtcgggtcaaatagccccagggctcgggctgacatgagtttttcttttaactcgtgaaaaggtaattgctgttggttgtaatagatgtagtttatccaatttacatttttattaactgtcacctaccaaaatattgactcaaatcctgcagctatttgatttcaagcttttaattaatctggtattctctgtgggactccaattgcgtctaaatggatgtgagagtcaaaagacccataaggggcttctcttgtgttacgatgtcttatttttcctccctatggttgatgaaatgccagggtgaaagggatagccaattggactaatgtacaagtgccactccagttatttggcagagtgcccagtgaaggtctaccacaataccaccacacatctgctcagggatgaacaagggctgactgattagtaagctcttgaaaatgtttaagctcactgcatcctttcaggtctccaaggaatgctaagtttcctccctgtcatgagagacacaaagtgaacttatgttgggagacggaggttggatggcccttgggggctgacccgcagggtgccagactttgggatacagcagagagagcttggcatgacttattactccaggctgtagaatcctggaaaagggttaccatgcagcccacacctggttgactggaggaccaccttagtggaaaggggacaatctgggcctctggcttgccatgtgcacaagcataacaattgcttttttttaacgtgtggatggaatatttgatccattccaaccaggcatttgcatcttggtatgctgtcttaattgccaaagtttgttttaagtctttaacttctatgatcctctagtaaaatgaatgtatgattttgggaaattaaaaaaactggttggggcagtccatccttgctctctagtggtccacagaatgttgggccaactatggcataaaagctctacatttggggagcaagactcctggttgacattggagtctttattgaaatttccccagattaaatggtcctaatttactaatgcccagtctgaggagagtcaggagggacagaggtacttttctgaagtagagagctgtctttgacttggcaagtccccacagggtataacaaggcaagcattaaatacaatagtttgaggcaaaatcgacttggttatgttaataaccagacggtcagcaatagaacgaggaaagaagaaagagcaatagaatagatgaaagagttaaatttttcttagctttagtttggtagggttttcccctgagactgcagtctaggagtctggagggggtggcgctttaactcaggtgtgatgagtccatcccttttctgctgtacgaacagcagtctcggaggttagcagcacaaggtagggtccttcctaggctggctagagtttttcttctttctgccctttgataagaaggtgatcttcaggctggtgctggtttactggaaattctagtggtggtacctgtgctaaaagacttttagttttgagggaaaggaaagtggaagataaacgaagtatataatttctaagaaattgactttttgttttaaatgtggggacatcaacagtggactttgtagtctttggtgccttcttactgagaaatttcctttagcacctatttttattagtttctagaccaaagaaacccaaacaccattttatatttaataatgcttcttgtatgatttttatgccagataagctaaatttcacctttatattagtatactattaatgttaaacttagttttagtaaaactttgtatacgtatttattcagtttttaatgtcggaccataaggtaagatttttatagactctttttaaccttttataatctttgttaaagagcaggttagtgctttaagaaaaacccattgtgtttttactttaatgtccagttcacagaaaaactggatgatacccctttaacattagctaatatgtttacacacagattttttttataattaacattttaaaacttgccaaaaccttcaaaacaattttttttaaccttttaatgtaggtaaaaatttacattcttatgcctccttctaatctttttaccaaaggcatattttacgttccttatacaccttgcacataaactttttttttccaatagttttacatttaggaagcctagttagttttaaattatacaacatttcttgcataaattcttttttataacatttttctctttcacgactttcacagacaattcttcgacatgccttaactttctgacttattacaaacatttctttctttaaacaaccagttaatgtatttcaggataagaatttaccatataacactctttttactaaattctgcagcccctctttcccccgcttttttttttttttgaagatgataaccattcttttccaaagtgaacttcttttatgtctgtggactagactgtctaaggccacaagattagaaattactataatatatgttatattgttaacttttagcaaactttacttttgttgaaaaccttgtaagtttgggattttaattatcctttgctattaatcagaccttgttttgtccaaattaacttagaattggtatagatgactttttttttttttccttcagttacctgggaggaaccattgattgtcctgtcctgaagggagttcctcctaggtctggttggaactttgtatggtaattaagatttagttcccctgttaggaaacctgctgggttaagggaattttcagtggttaatgttaaatcatccttttcttttattgccttaggatacttctcaactggtgaggtgtgctcacaatgaggtttcctctaaaagttatttttttacttttttctgttagcaaagctcttgctgctatagattgaatgcatttgggccatccaggggttactgggttaaggatttttgataggaaggcttcagtgctttctggatatgcccttgtttacactgacaacaaagtggtattggagtgttatagggttacagagaataccttcaattaccaattataggtttttaatttaccttggcttttaaaggaatagggtacactttttttttcttaactacttgtatctctctctctctctctttctttctctctctctgtctctgattttctgtctctttttctctttgactttccttttacctctgtctctttctctctctctgcctctctctttctctctctctctgctgatctttccttacctctgccagctgcttatgctgctgctctctcaaccactgtggtgggggttggtggtggaggggtctaaaaccagctgtaaccaagtgtctatatatgggaactggtctgggtaccttggcttacaggttaccttgtgccatacctttgaaacaagggacctgtccaggcttccttctgatggccaacccacctctaatgctggccagtctatcttacaaaaagttttaacttttcctggtgtaatagtactccatcgtctcccttaaatcctttcttgaaatttttcaacatagttcctagtggagtgggcttactttgtgcctgacccatgcttcttcaagacaaaacaccacgcttacatcacacacacaccacaaaacaaagaatgggtaaaaagggcacataaacacttttacagtttacaccaaagcagaatcaaaaccaaaatcagagtatcaagaaatccaagccaggtcaaaactaaaaccaaagtatcaagcaatccaagtcaagtcaaaaaaaagaactaaagtgctggtacaggcacaccatgggtgatcaggccacgcttccactcaaatggagtaggcaagttccaaagactagtcttaccaactttcagatgtctggactccaggtgccatttccttcccggtgttcagccactgcattgatcctccacaggggcctgccatgcgctgctctggcaaggcattccactggggcaattgcctacttgggagcactctcaggatctgtgtcactcaagctggccagagtcccccgcagggatgctccacagggcaggcctaagccgcctaaggggctgcctcgactgtctgttaatcaccttgcttcctggtcaaggaaccaagaaatgtagcaggaaaagccacagataaaacccctcagacactgagttaaagaaggaagggttttattcggccgggagcttcggcaagactcatgtctccaacaactgagctccctgagtgagcaattcctgtcccttttaagggctcacaactttaagggggtctgtgtgagagggttgtgatctattgagaaagcagggggtatgtgactgggggctgcattcactggtaattagaatggaacagaacaggacagggatttttacagtgcttttctatacagtgtctgtaatctacagataacataaccgattaggctggggttgatctttaactaccaggcccagggtgtggtgccgggctgtctgcttatggaattcatttctgccttttagtttttacttcttctttctttggaggcagaaattgggcataagtcaatatgaggggtggtctcctcccttactaagagaaaagtttaaacatttaaatgcctacatcaggaattctgaaaaagcatatatagacaatctatggtcatgcctcaaggaactggagaaacaagaacaaatcaagcccaaactcagcagaagaaaggaaataaccaagatcagagcagagctaaatacaactgaaacaaaaatatacaaaagataaatgaaataaaaaactggttctttgaaaagacaaataaaattgatagaccgttagggagattaaccaagaaaataagagaatccaaataagctcaactagaaaagaaacaggagatattacaactgataccatagaaattcaaaagatcactcaaggctactatgaacacctttacatgcataaactagaaaacctagagaagattgataaattcctggaaatatacaatgctcctagtttaaagcagaaagaaatagaaacctgtacagaccaacagcaagcaacgagattgaaatggtaataaaaaaattgccaacaacaacaaaaaacccagggtacacagctgaattctatcagacatgcaaagaagatttggtacccatgttattgacactattccaaaatacagagaaagatggaatcctcctcaaatcattttatgaagccagtgtcaccctaataccaaaaccaggaaaggacacaacaaaaaaagagaactacagaccaatatccctgatgaacatagatgcagaaatcctctatgaaatactggtgaatggaatccaacagcatatcaaaaataatctaccatgatcaggtgggtttcatacaaagtatgcagggatgttttaacacccaacagtaaataaatgtgatacaccacataaatagaattaaaaacaaaaattacatggtcatttcaatagatgcagaaaaagcatttgacaaaatctagcatccctcagtaaaatcggcatagaaggcgcataccttaaggtatgacaggccataccttaagatatgtcaagccatctatgacaaacccacaaccaacattatattgaatggggaaaagttgaaagccttccccctgagaactgaaacaagacaaggatgcccactttcaccacttctattcaacatattactggaaatcacacaagggaaagaaatcaagggcatccaaattggtaaagaggaagtcaaactgtcactgtttgctgatgacatgattgtatacctacaaaaccctaaagacacatctggaaagctcctagaactggtaaatgaattcagcaaagtttcagaatacaaaattaatatacacaaatcagtaccatttgtcataccagtacccagcaccttctgttgaatagggtattctttctacactttatgtttttgtttgctttgttgaagattagttgactgtaaacatttggctttatttctggttctctattctgttccattgctctatgtgcctttttttatactagtaccatgctgttttggtgactatggccttatagtatagtttaaagttgggtaatgtgattcctccagatttcttctttttgcttcaccttgctttggctatgtgggatcttttttggttccatatgaattttaggattttttttctagttctatgaagaataatgttggtattttgatggaaattgcattgaatgtaaaaaaatgaaactgaatcctcacctctcactgtattggtccattttcctgctgctgataaatacatacctgagactggacaatttacaaaagaaagaggtttaatggactcacagttccatgcagctggggagacctcacaatcagagcagaaggtgaaagtcacatcccacatggcagcagaaaagagaagagaatgaaaatcaagcaaaaggggtttcctcttataaaaccatcagttattgtgagacttatttactactatgagacagtatggaggaaagcacggccatgattcaatgatctcccactgggtttctcccacaacatgaattataggagctacaattcaagatgagattcgtgtggaacacagcaaaaccatatcgctcaccttatataaaaatcaactcaagatggatcaaagtcttaaatctaagacctgaaaccataaaaattctagaagataacattggaaaaatccttctagacattggcttgtgccaagattttatgatcaagaacccaaaaacaaatgtatcaaaatcaaagataaatagatgggacttaaataaactaaagttactgcacagcaaaagaaataatcagtagaataaacagacatcccagagagtgagataaaatcttcataatctatacatctgacaaagtattaatatctggaatctacaaggaactcaaacaaatcagcaagaaaaaaaatcccatcaaaatgtgggctaaggacatgaatagacaattctcaaaagaagatatacaaatggccaaaaacatatggaaaaaaatgctcaacagcactaaggatcagggaaattcaaatcaaaaccacagtgtgatatcacattacttctgcaagaatggccatagtcaaaaaaataaaaaaaagtaatgggtgttggcatggatatggtgaaaagggcacacttttaaactgttggcggaaatgtaaactagtacagcctctatggaaaacagtgtgaagattccttaaagaactagaagtagaactaccatttgatccagcaattccactcctgcgtatctacccagtgaaaagaagtcattatacgaaaaaagatacttgcacatgcatgtttatagcagcacgatttgcaattgcaaaaatatggaaccagcttaaatgcccatcaatcagagtggaaaaataaaatgtgagatagatatagatatagacatagacatagatatagacatagacatagatatagatatatagatatagatgtagatatatatgtgccatggaatactactcagacagaaaaagtaatgaaatagtagcatttgcagcaacctggatggaattggaaactgttattctaagtgaagtaactcaggaatggaaaaccaaacatcgtatattctcactcataagtgagagctgagctatgaggatgcaaatgcataagaatgatacaatgaactttggggattcaggggaaagggtgggagggaggtgagggataaaagactacacattgaatacagtgtacactgctcaggtgatgggtgcacaaaagtatcagaaatcaccactaaagaactcattcatgtaaccaaataccacctgttccccaaaaacctattgaaataaaaataaaacattttgaagactacctctataaagtaccttttccaagatgtttataccagatatatcttaatctctaaattgtattagatggcatagattctaataagctttgataagcttggaatttgttcctttcatcctactctccaaagaaaatttactctttttttttgttttgttttattatactttaagttttagggtacatgtgcacattgtgcaggttagttacatatatatacatgtgccatgctggtgcgctgcacccactaacccgtcatcttgcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttgctgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctatatccctgaggaatcgccacactgacttccacaatggttcaactagtttacagtcccaccaacagtgtaagagtgttcctatttctccacatcctctccagcacctgttgtttcctgacttttgaatgattgccattctaactggtgtgagatggtatctcatagtggttttgatttgcatttctctgatggccagtgatgatgaacattttttcatgtgttttttggcagcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttttaggttgcctgttcactctgatggtagtttcttttgctgtgcagaagctcttgagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttggtaaggtgtaaggaaaggatccagtttcagctttctacatatggctagccagttttcccagcaccatttattaaatagggaatcctttccccattgcttgtttttctcaggtttgtcaaagatcagatagttgtaggtatgcggcgtcatttctgagggctctgttctgttccattgatctatatctctgttttggtacaagtaccatgctgttttggttactgtagccttgtagtatagtttgaagtcaggtagtgtgatgcctccagctttgttcttttggcttaggattgacttggtgatgcgggctcttttttggttccatatgaactttgaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtatgttggattcctaggtattttattttctttgaagcaattgtgaatgggagttcactcatgatttggctctctgtttgtctgttgttggtgtataagaatgtttgtgatttttgtacattgattttgtatcctgagactttgctgaagttgcttatcagcttaaggagattttgggctgagacagtggggttttctagatatacaatcatgtcttctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagttttttcccattcagtatgatattggctgtgggtttgtcatagatagctcttattattttgaagtacgtcccatgaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattccgtttgccagtattttactgaggatttttgcatcaatgttcatcaaggctattggtctaaaattctcttttttggttgtgtctctgcccggctttggtatcagaatgatgctggcctcataaaatgagttagggaggattccctctttttctattgattggaatagaaaatttactctaagtgttgttacaataatactgcagaaggcatacagcttctcctgtatttagttttctcttaatagagaataaaaatccaacctagttatgacatcaaccataccactattgaaaatatgtaatatctgcttcagaatgctgacataagcaatttttatgttttaatataatgtccgtatgaaatcctagtgtagtattagtattgtcagttataaggttggttaatatgtggtgcaatgggggcatatgaaagttataatgtagcataacatcttatttttacgaaaacaattatagtctagtcaggagaaaactacctgtacacccaccttaatgataagctctcctatgtatcaatgtacaatatttaattttaaaatatataaaaaatacataaatagcaccaaaatacataaaatcattatgataaatgcatatggtatattctatcagtaaatctgatgccagatttactttttttagggtactgtaaattattacatagaaaaattataccctttgaaaagcttttgctctgtcatagtgatgtgtgattggacttaatgggcccaattattaaatatctggatttaggtatgagttgtattttataaggaccctgtatacaagtatatcaattatagtaccttaagagctaaccaaaaaatcattaacctacagaagcatgattatgatctaagcaaaaaatgggcttacttaagtaaaaatgcagcatattataaacaactttttacaaatatgtcacacgttaaaattaacatagtttacacaattaattacaaaacaccatacaaactgcctctgtatataaccaattggccaactggatatatatgtgtatgatgaactaattattgagaaaggatggtacatatgtgagcatgctgcaaaatcccaccaggtatgattcaccagcctcctgaaaggcatccatcactgccttaccaaacctcaagcctgttttgaggccccagagagcagttgtcatattagatgctttgttcatgtctggtaatgacaacaattctgggtctgtgaggaggctttgtagtgctttggctgagagtgttgctctttgtgtctgccttaattgccagctatttgtgaggagctttcctagagtggatttatgagcactgggcttactgagcagtttgtttggacagaacattttcttttgcccaatgttaaacttttaactacttcactgccaacattaaacattaaaaccattaacataaaaaaatttaagtaactcagtgaagaaaatcttcttcaacaatggctaatctgtgcatctagtattagatttttgtctttctcaaggaaacattattagtgactatactatatattaaaattaaattgaatatatacatttccaaaaagcataacatggaaatcaaggcatccatcaaatttatgtactgaaccaaagtcttgattttcagaattcactggtcagtcatgattctagaccaaggctgtcaaaacatgtttttatttttatgtatttatttatttagtttatttaatttttaattttttattttaagttcaggggtacatgttcaagtttgttatataggtaaacttgtgtcatggacatttgttgtacagactattatctcactgaggtactaagcctagtacccaatagttattttttctgatcctttccctcttcccacccctcacatttgagtaagctccagtgtctgttgttccctgatatgtgtccatgtgttcttatcatttagctcccacttataagtgagaacatgcagtatttggttttctgttcctgcattagtttgctaaggataatggcctccagctccatctatgtttctgccaaggacatgatctcattcttttttatggctgcgtaatctacagtgtacttataatgcttctttttttaaaaaaaaaaatccaatctactattgatgggcatttcagatgactctgtgtctttcctattgcgaatagtgctgcaatgaacatattcattcatgtctttatgatagaacaattcatattatttgagtatatacccagtaatgggattgctgagttgaatggtagttctgtttttatgtctgtgaggaatcgccatactgttttccaccatggttgaattaatttacactcccaccaacagtgtataagcattcccttttctctgcaatcttgccaccatctggtttttttttttgacattttaataataactgtatgggtatgagatgttatctcatgtggttttgattttttttttttagaggtagtcttgctctgttgcccatgctagactgcagttgcataatctcagctcactgcaacctccgcctcctgggttcaagcaattctcatgcctcagccttgcgggtagctgggattgcaggcacatgacaccacacctggctatcttttttgttttgttttgtatttttagtagagacggggtttcaccatgttgggcaggttggtcttgaactcctgacctcaagtgatctgcctacctcagcctcctaaaaagctgggattacaggcgtgaaccaccacacctggccattgagcagttttttttttcctatatgattgttggctgcatgtatgtcttcttttgagaagggtctgttcatgtcctttgcccacttttaaatggggttgtttttaccttgtaaatttgtttaagttccttatagatattgaatattagacccttcttggatgcatagtttgcaaaacttttttcaattctgtaggttttcagttcactcaattgatagtttctttcactgtgtagaaactctttagtttaactagatgccatttgtcaatttttgcttttgttgcaattacttcctgtgtcttcgtcatgaaatcattgcctttttgtagatccaggatggtattgcctaagttttcttccagtatttttatacttttggatttcacatttaagtctttaatccatattgagttgatttttgaataaggcgtaaggaaggggtccagtttcagtcttctgcatatggctagtgagttatcctagcaccatttattcaattaggggattgtttgtttccccactgcctgtttcatttttagcttgttgaagatcagatagttgtaggtatgtggccttctttttgggctcattatcctgttatattggtctatgtgtctatttttgtaccagtaccatgctgttttggttactgtagcttgttagtatagtttgaaatcaggtattgtgatgcctccagctttgctctttttgctttggtgaactatttgggctctttttggttccacatgaattttaaaatagtattttctatttatttgaaaaatggcatctgtagtttgataggaatagcattgaatctatacattgctttggactgtatggccattttagtgatattgattctgtctattcatgatcccatatttgcatttgtataatctctgatttctttggcagtgttttaggaatggaatggaatggaatggaatagcattcctgatttagctcgtggcttaactgttgttggtgtataggaatgctagtgattttcctgagactttgctgaagttgcttatcagcttaagagcttttgggctgacactgtgtggttttctagatataggatcatgttgcctgcacacagggatagtttgacttcctctcttcctattcatattccctttttttatttctcttacctgaatgctctggccagaacttccaatactatgttgattgggagttgtgggagagtgcatcctcttctcgtgctggttttcaagggacaaaaggtggtttccagtttttgcccattcagtatgatgttggctgtgtgtttgtcatagatggctcttattattttgagatatgttacctcattacctagtttattgagagtttttaacatgaaggagtgttgaatttcactgaaagcctttcctgcatctattgtgataatcatgtggtttttgtctttagttctgcttatgagatgaatcccatttattgatgtgcatatgttgaactgatcttgcatcccagggataaagccaattttatcatggtggataagccttttgatgtgctgtggaattcggtttgccagtattttgttgatgatattttcatcagtgttcatcaaggatatggcctgaagttttctacttttgttgtgtctctgtcgggttttggtatcagggtgatgctggcctcgtagaatgagttagggaggagtccctccttctcatttttttgcaataggtttagtaggaattgtagcagatctttgtacaccttgtagaattgggttgtgaatctgtctggtcctgtgctctttttttatggaggatgtggctggtaggctattactgattcaacttcagggctttttattggcctgttcagaaatttaattttttcctggctctgtcttgggagggcgtatatgtccagaaatttatcaatttcctctagattgtctagtttatgtgcatagaggtgttaataatattctttgttggctatctgtatttctgtagggtcaatggtaatgtcccctttgtcatttctaattgtgtttatttggatattctttctttcttctttattaatctaactagaagtctattttattagttacttcaaaaaacaaacccctggattcattaatcttttgaatttttttttgtgtgtgtttgtgtttctcagtctccttcagttcagctctgatttttttttttcttctactagctttgggattgtttttttcttgtgcttctttagttcttttagttgtgatgttaggttgttaaatggagatctttccaactttgtgatgtgggcattttgtgctgtaaactttccttttccctcttcatactgccttagctgtgtcccagagattctgtaatgctgcacctttgttctcactggtttcaaagaaggccttgatttatgccttaatttcattatttaccaaaaagtcattcagaagcaggttattcagtttccatgtaattgtatggttttgagtgaatttcttagtcttgatttctaatatgattggactttgttctgagagactgttatgatttcagtttttttgcatttgcttagcagtattctgtgttcgattatgtggttgattttgatgtacatgtggtgatgagaaggatgcatattctgttgttttgggtggatagttatgtagatttctatcaagtccattttatccagtgctgagttcacatgttgaatatctttgttcattttctgcctcagtgatcagtctaatactgtaagtgggatgttgaagtattccactgttattgtgtgggagtctaaaagtatctttgaaggtctctaagaatttgctttatgaatctgtgtgctcttgtgttggatgcatatatatttgggatagttaggtgctcttgttgaagtgaaccctttgctattatgtaataccttttctttcttgatctttgttggtttaaagtctgttttgtcagaaacttggattgcaacccctgcttctttgtgtttccatttgcttggtagatttttttcatccctttattttaagcctgtaggtgtcactgcatgtgagataggtttcttgaggacagcatgccaacagggtcttggttccttacgcagcttgccactttgtgtcttttaaatgggggcctttagcccatttacattcaaggttagtataggtatgtgtggatttgaatctgtcatcatattagctggttattatgcagactcgttagtgtggttgctttatgttgtcattagtctgtgtacttcagtatttttctggagtggctggtaatggtctttcctttccatatttagtgtttccttcaggagctcttgtaaggcagttctggtgggagcaaattcccttgacatttgcttatctgaaaaggatcttatttttcctttgcttatgaagcttagcttggccagatatggaattctgagttgcaatttatttcctttaagaatgttgaacttgggtggctgaagtgcgaggatcccttgagcccaggaattcaaggttgcatgtagctatgatcatgccactgcactccagcctgcatgacaaagtgagaccctgtcaaaacaaacaaacaaacaaacaaaagaatgttgaacattgcctggcttgtagggtttctgctgagaggtccactgttagtctgatgggtgtccttttgtaggtgacctgccctttctgtctagctgcatttaacatttttttcttttattttgaccttggagaaactgatgacacagaagtatagagctgtgaaatgggaaatcaggggtctcacagccttcagagctgagagccccaaacagagatttacccacgtatttattaacaacaagccagtcattagcattgtttctatagatattagattaactaaaagtatcccttatgggaaatgaaggaatgggccaaaataaagggatgggttgggctagttatctgcagcaggagcatgttctttaggcacagatcgctcatgctattgtttgtggtttaagaatgcctttaagtggttttctgccctgggtgggccaggtgttccttgccctcattccagtaaacccacaaccttccaatgtgggtgttatggccatcatgaacatcacagtgctgcagatattttgtttatggccagttttggggccagtttatggccagatttttggggcctgttcccaacatccagtatccctggtggttgaagggtctctttctgttggaatttcagaggcccgtggtgacaggaggttgctccttgtcggttcaactcacccattccccttaatttgttggggaccaggaataagtccgagtgcatggtagccccttgtagagtccccagagtcttcccccttcaacccagcttttgtgtcttccttccatctattctcagtatcttccctttgaatactttttaggagcatgccatttgtgtcagtacctcagtggcatctgttccacctggctgtgtctggtcagccactttacttaacaagtgtttataaatggttaagatttcttgttcataaatggaacagaccatcctctatgtgataattactttcacataatcattttggggtcctagatattttaattgttgttctacttcatcatgtgaagatatgcatgattctcagccagagaaaaatgtgaaaccaagcaggatctagaccctgacctcatagagcatggcctggccaaatcctatggttccagagcagaaaggacacactcttctaagatttttaaaatttaaattaaaactttatatttagtaaaattctctcataatgtagtgtttttatgagtttacaaaatgagtcatatatctaccataacaatcaagataaaaattaaatcacctcacaattatcccttatgctgtccctttgttgtcaagcccttctcccaccttcgtcacccttggtaaacactgccactattttctacgtttctaagctttatcttcttcacaatggcatataaatagaataatacagtccatactcctgagaaacaaacacatcaaacaaaccagattctgataatgatatagatgttggaaatgcctgaaagggaagtaaaaataactatgattaaaatgttaaaggctctaatagaaaaggtgaaccacctgcaaaataagatgggtaatttcattagagagattaaaactctaagaataaaatggaaatgctagaaattaaaaacacaataatagatatagtctctttattggccttatcaggagacttgacacagctgagaaaatcattagtgaccttaaagatatgtcgataaaactcgtccaaactgaaacactaggaaaaagaaaaggaagaaaatgaaatatatcatccaggatctgtgggataatatcaaactccctaatataaatgcaattctaattgtataaggaaaagaaatatgtgacagaagaaagacttcaaataaaatggctgataattttccaaaattgttgacagatattaaaccacagactcaaaaaactcaaaacaccacaacttggctaattattaaaaaaaaaaaatgcacccaccccagacatacaacgtaaaatctactgaaaaccaaagacattcagaaaatcttaaaaaaacagagaaaataaaatgaaatatagaaagaaaagttatagcaattttttcatcagaagccacagaagccagaagttaatgttacaaaaatcttttacatgctgaaagaaaaaatagtttactcagaattctgtacactgaaaataaaaagaaaacacaaacaacattttcagaaagaaaagtctatgaggattcattccctacatacctatactacaaaaaatgttaaataaattacttcaggatgaacatccccaatacacatagtcatcagatcctgcaaggtcaacataaaagaaaaaatattacaccaggcccagtggatcatgcctgtaatcccagcattttgggaggccaaggcaggcagattgcttgaggtcaggagtttgcaataagcctggccaacttggagaaaccccatctctactaaaaatatagacaagcacttagcatttgttaagggaattcattaccaccacacctgtctcacaagaggtccttaaggaagtgctaaacatggaaataaaaaaccactaccatccacgacaaacaccaacttacatgaatagtccatggacactattaagcaactataggatcatgcctaaataaaaaccagctaacatcatgatgataggatcaaatctccacatatcagtattggccttgaatgaaaatgggctaaacacctcaattaaaaggcatggagtggcaagttggataaagaagcaatacccaattctatgctgtcttcaagaaacccaactcacatgcaatgacacccataggatcaaagtaaagtgatggaggaagatctatcaagaaaacagaaaacaaaaaagagctgaggtagctattattattcaagataaaacagactttaaaccaacaacaatcaaaaaggccaaacaggggtactatataatgataaagggtttaattcaacaggaagacataactatcctaaacataaatgcgttcaacattggagcacccagattgataaaacaagtttttagagacctatgaagatacttagataaccaaacaataatagtgggagactgcaacaccccaatgacaatgttggacagattatcaagagataatattaacaaagatatttgggacataaacttgacattcaaccaaatttcattcacaatagccacaaaaagaataaaatacttaggaatagagcaattcagggaggtggaggatgtctgtaacagaattacaaaacaccactcaaagaaatcagagatgacataaacaaatggaagaggattccatgctcatgggtagaaagaatcattattgttaaaatgaccataccacccaaaacaatttgtagattcaatggtattcctatcaaaccactaaggacattcttcacagaattagaaaaaaaactattttaaaatatatatgagccaaaaaatagcttgagtaggcaagacaatcctaagcagaaaaaaaaaaaaactgaaggcatcacattacccaactttaaactatactacaaggctatattaaccaaaacagtggggtattggtacaaaagcagacacatagaccaatataacaggttagagaatgaagaaataaagctgcacatgtagaaccatctgatcttttttaaatatgacaaaagcaaggaatgggaaaagaagttcctaatcaataaatgatgctgtgataaatgactagcaatatgcagaagattgaaactggaccctttctttaatcatatacaaaaatcaactcaaaattgattaaagacttaaatgtaaaacctaaaactataaagaccctagaagaaacctaggacatatcattatgcacataggccttggcaagattttatgagaaatactccaaaatcaattgtagcaaaaacaaacattgtcaagtagaatctaattaaactaaaaagcttctgtaccaaataaactaccaacaaaggaaacagacagcctacagaatgggagaaaatattttcaaactatgcatccaacaaaggtctaatatccagaatctataaagaacttaaacaaatcaacaagcaagaatcaaacaaccctatggacaaaagacacgaacagatacttcttgaagacatagacgttatattctgtggccaacaagcatatgaaaaaattctcaacaacactaattattagagaaatgcagattgaaaccgcaatgagatgccatctcacacctgtcagagcagctgttattaaatagtcaaaaaccaacaaatgccaatgagattgtggataaaagggaatgctcatacactgctggcagaaatgtaaattagtttagtcactgtggaaagcagtttgaagatttctccaggaacttaaaacggaactactgtttgacccagcagtctcattaatgggtatataaccaaggaaatacaaataattctatcataaagacacctgacgtgcatattcatcacagcacttttcatgatagcatgaacagtgtattgaataataaaaagtggtactattcactatggtgtactaggcatccatgaaaaagaatgacatatttttgcagaaacatagatggaactggaggccataatcctaagtgaactaatgcagaaacagaaaaccaaatactgcatgttttcacttataagtgggagctaaacttagagtacaagcaaacgtgtactcaaagttatgggtaacaatagacaccagggtgtacttgagggtggaggatgccaggaggctaaggatcaaaaagctagttaggtatttttgttgaattgaaccctttaccattatggaatgctcttctttgtctttttttgatcattgttggtttaaagtctgttttgtctgaaattggaatagcaactcctgctttcttcagttttccatttgcttggtggatttttatccatctctatactttgaccctatgggtgtcattgcatatgatatggatctcttttaaacagcatgcagttgaatcttgcttgtttatccaacttggcacttcgtgcctttgaattggggcatttaaccagtttacattcggttaatattgatacatgtaggtttgatcctgtcattgtgttgttacctggttattatgcagacttgattgtgtgctttctttatagtgtcaatggtctacgtatttaatcatgtttttgtggtcattggtaagggtctttccttttccaggtttggcacttccttaatgacctcttgtaagccaggtgtgatgataactaattcccttagcatttgcctgcctgaaaaggatcttaggatcttatttctccttcttgtataaagcttagtttcactggttatgaaattcttggtttgaatttcttttctttaaagatgctttatataggcccccagtctcttctgccttgtagagtttctgctgagaagtacactgttagcccaatggggttcctttgtaggtgacctgcccctttcctctatctgcctttaacattttttcctctattttgaccttgaagaaaactgaagactatgcacactaggaatagtcatcttgtatagtatctttcaggtgtgctatgcaattcctggatttgaatgctggcttctcaagtgagctaggtgaaattttcatggatattttcaagtgtgtttttcaagttgtttgctctctctctttttcagggttgtcaatgagtcatagatttggtatctttacataatctgatatttctcagagattttgttcatttatttttatttttgtcttaatgggttatttcagagaactagtctccgagctttgaggttctttcctcagcttggttgattctgctgttaatacttgcaattttattatgaaattattgaggtgaattattcagctctatcagattagcttggttctttcttaaaatgcctattttcttttatctcctatatcattttattatatcccttagatttttttaaattgggtttctactttctcctgaatgttgatcttcattcctatccatactctgaattttatttctgacattttacccatttcagcctgattaagaaccatggctggataactagtgtggtcatttggaggtaagaggacactctagctttttgagttttcagagtttgtgtgctgattctttttcatctgtgtaggctgatgttccttcagtctttgaagttgctgtccttcagataagtttttcttgcttttatattctttgattcccttggggatttgattgtggtgcaaggtgggttcagtagaatgtttttttttttttaagtgatcctcttaaaaatattttagtacatagaaagtcatttatacatattattaaagcaaattatgaaacattatgtgtagaaaacttccatttatgtgaaaaataggccaactgaggaccaattgtaaagaccatcaaggctaggaagaaaccgcatcaactaatgagcaaaataaccagctaacatcataaagacaggatcaaattcacacataacagtattcaccttaaatgtaaatgggctaaatgctccaattaaaagacactgactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttcaaccaacaaagatcaaaagagaaaaagaaggccattacataatggtaaagggatcaagtcaacaagaagagctaactatcctaaatatatgtgcacccaatacaggagcacccagattcataaagcaagtccttagagacctacaaagagacttagatacccacacaataataatgggagactttaacaccccactgtcaacattagacagatcaacgagacagaaagttaacaaggatatccaggaactgaactcagctctgcaccaagtggacctaatagacatctacagagctctccactccaaatcaaaagaatatacattcttttcagcaccacaccacacctattccaaaattgaccacatagttggaagaaaagcactcctcagcaaatgtaaaagaacagaaattataacaaactatcactcagaccacagtgcaatcaaactagaactcaggattaagaaactcactcaaaaccgctcaactacatggaaactgagtagaatggttttgattctagtctactccttggtgtttaaataactccctctgattactgtctctgtgcctatgtttcttttgttgggtgttcttgtccatgaagctccctcaggcagaggctgcagttgcagacaggccatgtccttgccgggtcagctgtaatctgctgtcggagtatttcctgggggaacatggggttgtgcctgcccacagagtcccagcagaagtgggactgctgggttggaagctctagcaggtgtagcctgtctgtccatgagaggtggaggtggatggaattgattgccctgttgtctgggtgtttcctgggaaaacaggaagctgaataggactgagttcagacagaagtgagactgttgggttagaaaatctagcaggcattacctgcctggctaccagtggcaggagtgggtgggattgccctttctgccatctgggtgctttttaagacagcagggggctacagatgttggctgagtttaggtagaagtgagaccattgtgccagaagctggtgctaagccctgtctgatgaggggcagtagagcaatcttactccttctaggcaccatgactttagtctttattggggctgtggtgtcagtgctggtctattctgtggcctaagacttgtagagtttcccttggagtcaagagtttcccctgcaaagcatccaggtggtcctctgcctcagtctagaagcatggtgggggcagtgtgtgggggccagggtgattctgctgttcccagtcttgcataggctcctgtggaggatgtgagtatcccagaagattctcacttactcacctttcccctgttggagaggttcttctggctctttgctgtgcccatacaggctggtgctcagcttccctcttctctgatttctgtagccctgctaccttgatgaatcctgacatggtttctctgttgattggccttcagggccagtgtttattaaactttttgtttcttctctgtgagagtggagtacatgagctgcttctattctgccatattggcccctcccaccctctcatttttgaagggtcattttgtcaaatatagaattctttattgacgagtatttttttctttcagcactttaaatatgtcagttaacttatttctaacctccatggtctcagagaagaaattggctattaatcttattgagaatttcttttctgtgacaaatcttgttttgcatcttttcaggttctctttgtcttttttaaaatagtttaattacaatgtgccttggtgtgggtagagttttgctaatcctacttttagtcagctgagcttctcggatgtgtagatttacatgttttgtcaaatgtgagacatttttagccattattgtttcagatgttttttctcctttctctctcctccttctttgacttccataatacatatattaatccgcttgatgttgtcctacaggtcccttatgctctgttcacttttcttcattattctctccttctgctcctcatactagatattttccattgtcctatcatcaagttatctgattctgccttctgcctgctcaaatctgctgtttaactcttctagtgaattaaaatttcaattctccttttctattccagaatttgtttggttcctttttatttccatatctttatttatatttgaattttgttcagatatggttttaagtttttctttactttttatttatgttttcagttctttaagcatacttaagcagctgttataagtaattacatcagtgatatagtgggaacaaaagtcaagttacatgaaccaaaaagtaaaaaggagttgtgggaatgaaaatagggagtatcaacaacttttctcaaggcttgttttaaagggtattgaaaaatgggatattgtagttcgatagaaatgtgtgactaaggaaggttttttaaattgcatagtttgggctaactgtccaataccatagccaccagttacatatggctgtatgaacttaaattcattataattaaactaaattataaattaagttcctcagttatattagccacatgtgactactgtattggacagcactgaaaactcctctgatttgcaccatcttccctttcttttatccagttacaaataataaggcatcttttctctcattaaatattaattcctatcattcatactctggaccccattccctctccatttttttacttacctaagtcctatggttattatttctctctctctctcccacctaattatcagtctctccctctttgctagatcaacatgctctagtactgtagtaccacctcattcctggtttcactttctatgctttcaattattcatgttcaatcataatctgataatattaaatgaaaacttccagaaataaaccatttttaagttttaaactttgtataagtggtgtgataacatctcatactatcccacctgggatgagaatgtttcctttgtccagcatatccacactggatatgccacctgcccattcggcacttagctgtctcagttaccagatcaactgtcacagttttgcaattcttgcgttaatgtagcttttattttacttaataaaggccccaaagtggtagagtaatgatgctggcaatttgtatgtgccaaagagaagccgtaaagtgcttcttttagtgaaaaggtgaaagtttttgaattaataatgaaaaaacttgtatgctgaggttgctaagattgatggtaagaatgaatattctatctatgcaattgtgaagaaggaaaaataaattcatgcaagtttttctgtagcacttcaaactacaaaagctatggccacaatgtatgataagtgcttagttaagatgaaaaaggcattacatttgtgggtggaagatataaacagaaatgtgtttcaattgacagtaatcggcttcagtactatctgtgctttcaggtttccactggttttggaatgtatcctccttggatagaggggactactgtatagtgagagaagtttgcggattttacaatagtatgatgagagttttttctgatggtttcaattttcttattcatatctaagtaaaggccatcagtgttgtggaggtgggtgtgctggtgtaggaggtttgaagaaaaggaaaaaatgtatgaaattgttgattcaaagggtagaaaaacaaacttttctgagaaatggaataagactgatgaacagtatagaggacccacgtgagtagaaacacttccccctctgaggctcaagggcttggtagacatggataaggaatggaattttaaaggatgagagcttttgtagagtagtggtaaaaggaattttcaagatagactgcatgggctcaaatttcagctatgatgtgtgatcttcagaaagtgatataatatctatgagctgaagccttacttatttcatatatacaatggaattaatagtaatatctgtctcatagggattttgaattaatgtattttaagtgctatgcaagtttttgccaatattattcttattctgtgaaatttgagttgaattcagttgttgagagtgaggaggtaaggaacaaatgaggcttgaggagtgtattgaaagtttgtacttgtcacccagaggaacaggattggaagctattgaaccaaacagcactgaggacacaattgtgactggaaaatagaaatttgaagaagcagcactacagaaggctgtagagttttctccagctgtgttcagcacatcacagtctaagatcagagaaggcagattgtaaaatacacctagggaggttagtggtacccaactttagtggacatgacaatcacttagagggattgttagattgcccataggctgctgagcccatgcccagagtttctgaatcttcaggtgtggagagattcccaacaatttgcatttctacaaattgctaagtggattctgatgctgctggtggaagaaataaactttgaggaccactgatttacaggaagttattatggggtgggagtggtgaaggggatgcattgtgtagaatagagtaacaggcaagaagacatgagagtgcaggatatttgtaaaagagtagttcaaatgctgaccatggcagtgagggaatttggaccagatagggaaaagaatggagtcaggaggaacctgatttaaaaaggtagaggagagtagggatcttctcaaggacatagcacttatcccaccttgtaattctacatggtttttttgttggtttacttgtatgttgtttcctctcctgactagattctaagaggacaggcactatgttgttttgttgatgactctttccaacactcaacatgtagtatttgttcaatacagctttgttgattgtatgagtgaaaaaaaattgcatgctttcacctctgactcttctttaagctctcctcattccttgagattcagaccaagcctaaactcttctataacactttatccggtgattaatacctctaaactcctgtagttgtttaagtcttacagtataattgacttttttgatgtacagttgtatgaattttagcacatgaatagattagtataatcaccaccgcaatcaggaattagagcagttactttcttgctatccccgccctctttgaaccactgatctggtctcaattcctattgttacatctttcctagaaaaaatatgcatatatatgtatatatattctttgatttacataagtgatatctacatataaatggaatatatttatgtatataaatggaataatacagtatgcaatacttcaggattaacctttttcactcagcgtaattctctggagattcatctaagttgttgtatgtgtcaatagtttactatttgttattgctgagtagtattccatggtatgaatgtaccacattttgtacaacttttcactgttaaagggaatttagattttatccagttattagctcttgttaataaaattactatgactatctgtatagaggcattgattgattgagacagagtctcgctctgtcacttaggctggagtttagtggcacaatcttggctaactgcaacctctgcccccaaggttcaaatgactctcatacatcagcctcccgagtagctgggattacaggtgcccaccaccacattaagctaatttttgtatttttagcagagataggttttgccatgttagccaggctggtctcaaactcctgacctcaagtgatccacccactgtggcctcccagtgtgctgggattacaggtgctgtgtagaagcttttgtgtgaacatcattcacatttctctttggtggatacctagaactaggatttctggatcatatagtaaggggatatttaactttataaggaactgccaaacttttttccagagtgtctgaaccattttacattcccatcagcaaagtgtgagtgattcagttgttccacatccttgccagcatttggtgttatcactgatttttaaaggccattgtgacaggtatgtaatgatatctcattgtaattttgatttgcattttccaaatggctaataatgtttaacatctatcatatgtttatttgtcattcttatatcttgtgttgtgaaatgtccgttcaatttttttttgcctatttttaattgggctgtttttattttgttaaaatttaagagttctttatgtattttggatacaagagtgaagccttgactactatggtcagtccagggctctctgaggaaattatatttaggctgatatttgaatgtagcatagaaatcagccatattaagaaagttacaggacagcttcaactgcaagtgtaaataccttgagacaggaatgatctcaatgtatttaaggaataataagaagacagtgtggctgtagcatactgagaatgatgaagaataataagaaatgagtttgtagatataaagaatgataagtaagatcatgtagagtctcgcaagccatggtagggaatttttgtttagatttactcacagtgaggagctgttgcagagatgtggcatggtttactttgtattttaaaaggttacatttgttgttatgtgaagcatatgttatgagaggaacaagagaggtggctattgtagtttttcaggtgccagaagataatagcgcagactatggtggtagcagtggagatgggtagaagtggataatatgagatagacttttcaggtagatccctcagaattttgatgatggatatgagatgtgaggagtgataataatcaaagataactcttgtgtttttggcttacataactggtggcactatctattgagataaggaagactgaagaggagaaggtttgggggaaaatcaaatatttatttttaatatgttgagtctgagataaaaattagacaaatggaggtgccaagaatgcagttgaataagtcttgaactcgatggagaggttggagagaagttcatgtaaacagaacaacatgacaaaagatacagagctgtgaaagtatgaggtatgcccagaggtgagcatgtagttaggttcgaccagtatatattttgcagaaccagaaagagtaagagatatggctgaaaaggcaggccagggctgagttagagagtgcttagctgatggggaaatttttgaaatttattatttgaatattagggagccattacaggcctttgataaaaggtatgacatgaacaaagagagattttggaaagattaatatggcatagccaaaacaatgttaaaaaagaacaacaaagttggagaactcatacttactggtttctaaacttactacaaagcatagaattcaagattgtgtggcattggcataaggatagacagatagatcaatagaatagaattgaagatccagaaataaaccctctaatttttggtcaattgattttcaacaaaagtgccaagacctttcaatggaaaaaaatagtcttttcaataaattgtgctgaggcaattggatatccacatgcaaaactatgaagttggacctctaactcacaacatacagaaaaatcaactcaaaatgggtcaaagacctaaatataaaagctaaagctataaaacttttagaagaaaacaaaggagcaaaccttcataaccttggattaggcaatggtttcttatatacaacactaaaagcacaagtgaacaaataaattgaaataccttaaaatttgaaatatgctttaaaggacaccataaaaaagtgaaaagacaatccacaggatgtgaaacaatttgacaatcatatatctgataagggacttgtatccagaatccataaggaactattgcttgatgtcattgttatttgacaatgctattatcaaaaaacccataacccaatttaaaatgggcaaaggatttgaataaacattgctcccaagaagatgttaaaatggatattaagcacaagagaagattctcaacatggttaaccgtcagagaaatggaaatcaaaactatagtgagataacacttttcacatgctaggataactaaaataaaagatttttaaaagcagacaataactaattttcatgcagatgttgagaaattggaaccctaatatgttgctggtgagaatgcaaaatggtgcacgtgctttggaaagcagtttggcaattctttaagtggttaaacatagcattaccatacaactcaggaataaatgaaaacatatatccacataaaaacttgtacacaaatgctgatagcagcactattcataataactaaaaagtggaaatgacccaaatgttcatcaactgaagaatgaatgaataaaatatggtgtatctattcaatggactattatttggcaataaacacaactaagtattgatatgtgctacaaagggggtggacaatgaaaacatattaaataaaaaaattcagtcacaaaataaaatgtatgatataattcaatatctatggaatgcccctaatggacaagtctatagagacagaaagtggaatattgattaccttgggtggggtggggcaggaatggatgggtggattaggggatgagggcagtacaggagtttttttggtggtaatgaaatggaaaatgaatcgtggtggttacaaagttctggtaatatactaaaaacattgaattgaacattttaaaagggtgaattgtatggcatgcaaattacatctcaataaagttgttagaaaagattaatatagcattatttggaagatgaattggagggggcaaggctggaggcagagaaacatgttaggaagctttgtaatggttgagttaagaaaacaagggtccaaactagggcaagagtaatgataattgaaaggagaagaggatggttctaaaatatagggtagaggtataatcaataagacctgccatttggttagatgttgaattacgaaagtgaagaagtaaagattaaagttttgagtctgagtaagtaaaagagtgataatgttatttctagatagacactgagagcacagattgggaaacggtggtttttcaaaggagggaggtgagttcatacaatctgttttcctggtgctgtcaggacaatctttaaaagatattcagcatctaattgaatatttggagttggagcttagtaacaaggggagtctggctggaactaagtatttaagagtcatcgatgcacagatcatagttgaagtcagaaaggtgactaaaggttccaaggagagagtatggaaagagagaagagaactgagacagaactttgtgcaaacaactgcatttaggatatagcagctggaaaaaataaaccaaagcagagcaccccaccccacccccgccccgcaaagaaaaagatgatattaaaagcagagaaaaaaaagtagcaaggctgccttactagaggattggacctgggcctttgaggatagggaaagtagaaaagaaaggttgagggtgtcccaggagggagaagagcaaggtcacaaaaataaaatgatggaggaatgatgaagaaagatcttaaagaagatgggattcactcaccactgcctcttggggagacctgggagttgagagaaatttctgacccggtgcaactggaggttccttgttacacttctaggtgaggtggtcacttatcagtggaacatcccagagaggtctggccctgggcccaatgactctgcttgtgtttcctggatctattattctgcagtggatcccatcaaggtaaatacaagattggctacctggaggtgggtcaaactccctggcaaaaagaagctattaaccaggtgtagtaagaagcttactcctgagattctagagcctagaatttggggaacattcttcaaaagctggacttattttaatagacaggaggagggacgaagggaatgggtagcaccagatatttgtcatgaagattttcttccttatcttttcattttggatcctataaagcaacatgttctcattataaaaaaaacaaacacacaaacaaacaaaaaacacaaaagaaacctgggattggttgtacagagattgaggttctagtcccaaatttggttatagcatgcttttagagtgaccttaaataagtcattctgcctctgttttctcatctggaaaatggatttatcgatctagccatccatctacagccagccattagtaatcatttattgagtgcctaccacattttaggcattttacttggtgctttggatgatataaatttaagatacatttcccaccttcaaagagtatggtctagttgagcaagagggaacctggagaaggcatcacaatgggaggtgcatgtactctgggccttgaaagctgagtcacattatgccatcagataagggatatgatgatggagagggcattgcaggcagaggaaacagcacaaaaaaacactaggttgtaaaaatgcttggtaggctaagagatcaataaatagtttagcctagataaagcataggtcagatagtgcatcttaactgagtcccaagataattgttagaatgaattcaaataacatagtggggtacttataaatgtaagatatcatgaggaaatgctgagaggcacagtgggcttgtatgagaagctggctccctgcggagtactgctacccagaaacaactccatctctttctctctctcccacttcctcccttcctcaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatggtcagtagtaaaaaacctactcttgttccaaagcagtccctactggttacatggggatatttaataggcctattgctacctaagggaacataatcccagagaggacacgaacatgggaaggtgaaatggggatgagttagaagaagcatttcctattattgtacatttacatatacaaaggcagatatgtggtccaggttagattgggtgcccagaaagcaggaagttgactctgtaaattgccatggcgataccagaaaattttaacatattagagaaggcaaaatggacatgtatgaccttcaatgtacttgtcaagctggctgcttagtgcccctctattttaaaaccctgagtttagtctgccaatatcatcttatttatttaccactctaaatttgggatctgttttctcaatggattccaatacagccagatgaaagcttgtattttagtctctttttaaaagagtttcaatttatagatggaagaattgaagagatcctcagtgagaagcatactggatttatgtcagatacaaggaagaactttttggtacttgaatggattttggagagaaattgtgcatcaaagccttcctttgtttgagagatctgtgtagcttttcaaaaacaagagaaagaggggagagcataagtgcagtagaatgaagtgatctctcactattccttctagcccaagatttctttgatctgagaatgaggagcatctttgatagtgattctaatggaactaaaaagtcgtatattattatcccacagattttagctatttcaccttgatggagtgatgaatgattcacattagaacagatgattcacagacttcacaaggcagaaattttagcgcctgtcaaatcagagaaatggtccaggataaaaagggaaagaggacacagttaggtcctgttaatgcaggggtttggctaatgcttactttcttctgtttgtttatgtgtctatccacactcttcaggtataagtctacctacctatcgatcgagcaggtatttgttaagcagtttctgagtgctagccctggagatatttgcatctgaggggtaaataaataacatccctctcttccttttcaggttcctgaaccaactgagaaagagagatgcttaagatcaaatgtgaaccttaatactaagaaggctaattgaaaaactgatttcagttctacaactaaatgggcttactaacacttctctggcaacagatagacatttccaccttgtcattgacatagatgggcagcaatactcacctctttggcagagggagaatcataccccacagtgaaataatgaatcggctattgcccatttctgtggcctgattgatgagggagagaaaagatcaataagaggctgagttgatcatgtttagtttcctctctgaaatccacaatttggtagaggtagacatagagacagattataaatgattgcttcctctcttgggtgataaagtggaaattatcttctctctgtaagaacataagaagtgggggaaaattgtccagggaaaagtcctggaagtgtgaattattgtaacaatgagtagtttgatgtccttggagcataggatgtggcctgggaagagacccatgcattaatatcattattaattccatgcattaatatcattattaattctatgcattaatgttattaattccatgaatgtggcaggtatttttttaacatttattgtaggctcagctgtctactgggtgttctgagaaaatacaaggaagctatagtaatgcagtgtatacatacattctttcctgcatattaggaacctatagtctaattggggatgtaagctttcacgcatgaaaagacaggtaaatgtagaagacaatttcttatgagtttcagtgagtcatgcagacagtactggaggagttcacaggtggaaggggatgcagggaatgagagttatggagaggaactaggagatcaggaaagtctttctgggggagtgaagatttgactggactttaaaaaatgggtaaaagaaggcaggatttctagtagggaatcttagaaacacaaggacacaaagaacatgcatggaccatttgagggatggtgaagaaatcaccccaactggaataaatgtgttgggtagtgggagatgaatctaggaaggtggtttggagttatattttgaaggatcttgttgggtgaagtaaggatccatggacttgctctttggagcaggagagagtaattaaaatattttaagcagcagaatgatgtcatcagattcagtcacttagagagataattttgataatatcaatgtaagaagataccttgaagagggacagatggaaaaaagatgagacaaattagaagcccattgctatcttcggtaaaaaagattaggcctaggatagtggaaatgggaagtccaaaggagagatgtaagaagctttttcttttcttttcttttcttttctttttttttgacagcaatcaatgggaaactctatgccaaccttaggggtcttaccatgtaccaaggagaacgagtggcctggtacatgctggccatgggccaagatgtggatctacacaccatccactttcatgcagagagcttcctctatcgggtgagctggaaaatgggctgagtccctcaaggatgattagaacagtggtttaacagcaattgagaaaaaaggtaacagtgtggaacaggtaacaattagttaaagagcagaggtctagtacatggagcactgagctggaaattctagtctggctgtatatcctagactcaataacttcccgctaggccctagctttcccttctgatgtggaagacaaaaaaggcccatttatcagtaaggagactgaaggaatcaatatcaagtctcagtcaaggacttgagactcaatgagcagtgatttttaagaacaaggaatttcagagtggcatctcagaattgctgaaagtccttaatctattataagaagagcttcaacttagggggtacatggaacaatatgtagattttgaaaacagtttagtcttaggtaaaggaggaagagttgggggcattgatacagacttcgagatttagaagtgctgaaaaagacaatggcaaagataactttatttgaatcaatttctaaaggaaatatatgcctcattcataggggtcaaagcttaagccaaattccccatattttagcctgctgaaaattataaagatacttgttttgaaccttctaaagtaacctagaaattctttttctttgggacattttaagaggagaaagtcacctctgttgatttagcttcggtgggtgggttcattggagatatgaataaagtggactttttttttttttttgagatggagtctcactctgtcatccaggctggagtgcagtggtgtgatctcagttcactgcaagctacggcttctgggttcacaccattcttctgcctcagcctcccgagtagctgggactacaagcgcctgctaccatgcccggcaattttttttattttttttattttttattttttttagtagagacggggtttcatcatgttagccaggatggtcttggtaaagtggacttttaaaaccactcactggtctaggaaccttgaagtctcagctccctaatgtggacatcacaattttttggttcctgaaagctctaagatgatttttatacccttcacttcctctccctcattcccaatctctcttgcagaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacaggtaagtcctaacttccccaaaatgatcatcttctaacactttatctagcctataggaagcaggtaataccaaaaagcctcttgattgtctccttctgatcccacaataagcaggtcttaaggcagagcatagcctccctctaggtattgccccaaccagtatttctaatcctccattgcacctgtccctccattgccccaactgatatttctaatcccctgacacctgtccctctccaaattacttcaaaacctgttgagctcacatgaattgacccagcctgaaaccggtttggctctatgcattgaagcctagtgcaggcctgcttcttttgaaataaatttaacttatatacaaatgtattacttgacttcattagagtaactgattatttcaaggaatattgctgattagtctttctaaaaagagaataaaaataattctaatagtcacccattaaattgatttgttctatggggttgtgaaaggcaattctttctttttttctttttttttttcttagagtaaaggtcttgatctgtcacccaggctggagtgctgtggtgcaatcatggctcattggagcctcagactcttagactcaagcagtcctcccacatcagcctcccaagtagctgggactgcaggaatgtgccaccacataaggctaatttttatactttttgtagagaagggggtctacctatgttgcacaggctggttctaaactcttggcctccttctgcagcagcaatcctcccgccttggtctcccaaagtgctgggattgcaggcataaggcactgaacctggcctagtttttattttttaggcagggttttgcctaggctggtttcaaatttctgggctcaaaccatccttccacatcagcctcccaaatcgctgggattacaggaatgggccaccacatctagcaagacagttctttttggtttttgaatatcttcatctaaggctagaaagagagattgtccttcagttacagcttatctgagttactaccaagggtggaaacaactttttctttatattttatatggagagggagcagctgggacaatttctttaccagccactctttgttcctcaccaaaaaatgtagatgggtaggctgtgttggcttttgtgtctttgagtaattaaagggtcaaatgtcttacttcttaaggttcttgacctgagtccaatccccaacactatttgccttccaagaagccctgtagagccttttgggacccatacaaatcaaggctgtgtttttttttttttttctatgcttttaaagaatatatagccaccatttgaacaaaaatggttttctggggttgtcagtcattggcattctatcaacaagaatagtgaaggggaaaatgtctttgaatattcatacagacttagcaaatgtgggtggagaatacaactcttctgtttacccttagagagagagatgaatgattgcacattatgacttcctatataatttaaaatatttattctctatcaactaatactgctagaatgcagcttccacttaactactcaggagctattccctagcacccagatttacagaaacttctttgttgtgttgtaagtacatagaacaaaagtcaagtgatcaattgatacatcatcaggttgatatagatccaagacaacaggttttctctatatgtagtaatgggttatcccaaatatgaaccatccaatatatgagaccatttcaatacatattgccagggtacttccatgaggaaggatagctcatatctctctatgacaatgagccagcccataaatcttttctatttgcccttttgtttttttataacccgctatggcctaatttcatattgtttcaactccatgtgtgttaacaggccaacaggaaggaagagttgaaaagacagagggaaaagactaatttttggaacaaggtttctgataaggcagcagggaatgagaatcagagctaacatgaaagattagtgcaagagtggaggaaagtcatctttctactctaagaagaaagaagacagaaaatataaggatcaatgtgtaggtttgaccagggggtttgacagactgacagataatttcagcctatggtctttctcttctctctgatggagcaaatagagtcatctgctgagaatgaaaggcaggttatagggtacagggcttgagaaaagtggatgaaagtttgaaatagccactctgggggatgggaaataaataattatcaccagccagcattgagggcttagttgaaattggacacaaaggataataatctttacaattgtgttattttctctaacagcaattaagcataccagacaaaatacagggtaattacagttactggagttttggtagattattgcaacactcttggtagattagtagttgaagtgatagaccttggagtctcacttggtcaggaatggaagaaaagacaggatgaagctactaggttgaggaaaaaaactgaaggttttgaaagctagaggtctcatggcaggggaggataacaggtttttgaaataaagtgtattagagcactgaaaggatgggaggttgttgttagattttagatttctgagatgtaacaattcttgataacaaggttaatgtgaccatgggagtggttggtagaattggagtagacatcaaagttattggagttaaaagggctagaaactgtgaggcttgagtatttgatgggtcagcacccatggttggaattgagggagaggaagactgagccaggtactaaagacttccataaatgaagagaactgctagctaacaataacaagaaatgattgtagttctagccaaataatatgagcctcaaaagagatatgtttttacaaaaagaggaggaacaatgatctcaaagaagtattgagatgatgtaaatgaagtatggtcctcagagaagaactcagctttattaaatcaaggagaggaagaagtgttctgagaagatgttgaatgtgtagagaagtaggtttcacaaggagcagggatttcctgaaggaagtgtggcaaatggttggaaatagagcaataatggggatagaggaagtgccaagaaatatttaaataatagcagaggggtgatttacattttggactccaagcctgttctcttgcccatatttcatgtcactgttcaaaatcaaatcaacataccaatattgacttggactataaagtagtaaattctgcctttattttgcttacttaatcacagagaaatttctgcaaccaatgttgacctttcatagggggcctatggattggtaggaagaacaataaggctaacctcttgtcttttttccccccaaccagaacacttaagccctctcaccgtcatcaccaaagagactgaaaaaggtacgtaaaatgatgcacagactgggtacttatacatagtgtgtctgtgtatgaggttgggtgaagtacctttagggtatgggacttatgtgactgagagttagaatacatcagcagaaagtatcctgagacttctgcaagacttcagaagccaaagaaccaaggtttagcttccctcagcaggtttattctctctggcttccacctcaaacctcctgagttggggaaaacagcctcctccccatttaaaggctgctgtcttagcctctcatctaatgtgtgaggggggaagtaaattctagatactagtcgaaaaccaaatactgcatgttctcacttataagtgggagttaagctatgaatatgcaaaggtatacagaatggcataatggacattggagactcagaagcaaggagagtagaagggcagtgaggaataaaaaactacctattaagtacaacgtacactacttgggtgatgggtgccctaaaatcccagactttacctctacacaattcatccatgtaaccaaaaaccacttgtactcctgaagctgttgaaatatatatatatatatgtaaaatatatatattaaatatatatatatattaaatctaggtcctgctgggttggacatggaaaagttatagcacaaatatgaatcccccctagggacagtatgagactagttccaacaccatatgttcttcaacagctatttttattcttgcctctttccctttcatctatggaataccaaggagttaaacctttggaaccagccatttctgaccttgaatactgtagagattatttttctgtgcagcccaggtccaaatagtgttgttattctccacctcatttgtctctggactaggaaagatccagaaaggtatgagagctaaaaggaacattagagataattagtagtttagtctgaggttttacagctgtttggagaagtcttaatgatctgcctaagtatctcatgaactgttaaccaggggaccaggatatgtcctggaggggatggggaaaggtaaggtgtgattgtgtgggtgggctttcaggccatgtctctttcaacctgagcaactaaattattttatatatatattatatatatatatttttatatatattttaaatatttaaatattttatatattttaaatattatatatatatttgtgttcacacatactttgtgtgtatatttgtatatatacatacatattttgtgtacatatatacattcctcataagctctcatttgttaaaaagtttctacaatggggaaaaaagcctttgaaactgttgttctaataaaactcaataattttctacatgagaagctgagaaattgaaaatgatttgttcaatgtcacaaaaggagtatgtggtagaatgtaaactcagaaccagaaagttttgagcttctatttgaactcattatattctgtcttctctcagttgtgttagaacattaattcaaccagttatgttgaattacattgattgatgttgatgaacaatcatcaaacaagtgtcaggtaccagggatatcaaaataagtaagacatagccgctatttttcagcgtctataaatggaatgaggcacagaaataataatgctggatgctgtgtgctgtacaaaaagggcaagcaataataacagttaacatgtattgggtacttcctgtctgctaggtgctatactagatattttataagtattaattcacttaaattttacaatatgcctctgtgttaggtatggttgttattctgattttataaaagaagaaactgaggtttagatgggaagtgagggattaggtctcttggcccaaggtcacacaataagttaattatgggggtacaaggtacaggcgcttggaaaacatagaggaaagaacaattgtctaatgaaatcaaagaaaactttgcagagacatgtaaaatttaaggtagggctagaaagataaggagtaaagtgtgttcagacaaagggattagcatgagcaaagtcttagaagcctgaaaggggatcactttttatgaggaggaaagaatgtgttgctatggctgaaaactagtagataggactagaaggatagattagagcctgatactgagagttggaatgtctggtttaaaagtctgagcttttctctgtaggctaattgggaatcatcaaaagtgtgtatgccaagaactaacaatcagatatttctcttggaaaggtctatgtgacatcagcgttaacatgacccaaagaggtaagactggacagcctagtagcaggttcttgtcatggtttaattgtcaaaattgctattgataagctggatgactgagtcaaatttctttctgaagtttcccttattgcctccaattctaccctctgaagccatacagaacaagtcaaattcatcttttttttttatatcacagtcctttagatatttgagaacatgtatcaagggccttcccaatctgagtcttagctctttccatgaatggactggggcctcagtgattctcaaggacccttatagctgttacatcatgttttcttgattctctaacctctaaatctgtcttcatcagctagttttgtgaaggataaggacaggtctcctgtcctatttggattgacttgtttttttcaggtgatgactatagatagttaccttttagagtactccccatcccaggatgcccattttttttttctccatttcagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaagactgaatttggtgatttttgacagtctctgtggcttctgtcactgtgattgaaacagaaaatacttagggggtgagtgagtatagtatgtatttgtctagcctttgtagaacctacaagtttttgttttagagatgaggaagctgttccagaggaagcatcaaagagtgctgggtaccaccctagaaaaggagctgtcgcataaatgacaaaaattttctgagtgtcaagaaaatttgccagagggaaatagaagtctgagacgagactcaaacctgtccagtgggccaggggaagtaggaccatatcttatggggcctttttggcagtggtggtgtgaaaggtctagttgcaactttgggggcttccttataggatggagtcattctttctggtattttacagcaatattcctttgttacatgcaaatttgagccaaatattggttagagagcacagataagtgataaattttagattgggtaagatggcccaccccactgcaatatccataatattgtaccacatggcaagtggagaacagaagaggtatcaaggagagaaaagatgataactatgtactgttttacactttaaaaagcattttaattcttgattgcgtttggattacctcagggcaagtcattttacatttgagtaatgttatccatttatacatttgagtgaacaaaagcttatggacattaagtaacttcatccaagatccctcaggtagaagttgagcagggattcatgtattcatctgtttgactccaaatacctatttcatcctcatatatcatggaaacatccactaatctccatccaccttacccatattgattccaacttttctgtctgtccagcaatctgtctgtctaggtagcaatctcttgaagataaaatgtagaaactcacagagctggtgttcagttacgatataagtttggaggagaaaacacaatccagaagctatgattcctcttgtttttccatggtcaatgggtttctggagagctttactgagaatctcagaaataaagtgtgggtggaagggggatttagatggctagttatccaagagttagtgtttaggccattgcagaatcaatgatttaacagcagcagaactgttttggcctgcagttaacatgaatgttaatgaagaccaagtacatgctaggaattccagtcaattaatggttataatttacatgcaactaggaggttcttagcttggtctcagttataactctaagagactaggagaggtagatgagatgg
